United States Patent 6,812,339 (POLYMORPHISMS IN KNOWN GENES ASSOCIATED WITH HUMAN DISEASE, METHODS OF DETECTION AND USES THEREOF) - sequence listing, part 62

SEQ ID NO: 15976 - DNA, 76124 bp, Human
atgccctcgggcaatatttagattgtaagccattttttttagcttttgttttacacagctatcatcagagtcaagtaacaagttttgactaagactgttagaccttaaaacgaatctccgaacgtccgctcttgcctatagtaaattggaagaaaaaatgcaacaaaacactgtaaaacctgcggaattcttttgaagaaagattccagtggctatccatggaaatacttatagtgcatcaggtggaaatgggagtctgatttaaagggggaaggggggcagtcttgggagagaattatcctccacagtagcagaagttgaagaaaaagcaatgagaccaatgtcttttttttttttttttttgaggcggagtttcgctcttgttgtccaggctggagtgcaatggcgagacctccgcccactgccacctccgcctcgcgggttcaagcgattctcctgcctcagcctcccgagtagctgggattacaggcgcgcgccaccacacccatctaacttttatatttttagtagagatggagtcttaccatgttggccaggctggtctcgaactcttgacctcaggtgatccacccgcctcagcctaccaaagtgctgggattacaggagtgagccaccgcgcccggccagagaccactgtcatcttaagacagaacggggaaaacgtctaaggacgaaatcagcctctctgaatcgaggatgcttatatgctgcttttcccataggcaactctaactctaaacagagtgctttagaacacgtaattttagcaatctcttttacaaagggaaacattctcaagcaataaagggttgaggatagctgactcaagcaatgaaataactcacaaaggttccaaaatgtgtttcttaaaaaggtaacatctatgcctttagctttcccttagcagtcttcattctgcgtaagaatttggtttttggtttaaggagtgaattcacaaccaactgggagggggaaaaaagcaaaagcgagttaagttggaaggcatgaattctaatccaggctttgccaatgaccacccctaccaccataaaacattactcaaataattagctcctgtgttaagtacctggaattaccgagacccccctccccccgccccactcagctccctccctccttcaaagagctcgcagtctggccaactcaaaaaaatacagtataaaaataagtgtggcagccaagtatcaggccctacaccgatagacagagatggtattttaacactcaacttaaaggccttaaaaatcaaaaagtacacttcttttcttctgatgactggtcaaaatgcaggtctaggacaggcgctcctctaaattttgcttccttactggccgccacccctactcggatgcaatctgaacctcccgcctctctgcccggaaataaattcagttactttttttcttggtgtcgccagcaggttcctctgttcccggggaaactgcagcggaagacgggggctccggggtggttgtttctggggagacatccgtaagtccttcccctccagcagcaattgaagtaggaagctgcaacacagactgcggctcctccgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacgtgagtatccagccgccgctgatccgggcgagggggagtcgttggcgacgggcagcgcccagcgcggctttctcagagcgaccccctccggcgcgctgcggcccttgtcccgtcccggccgcctggcgctcgccagctgtcagcctcctggtgggtgtggacagggtgcccacctccctgccgcgcggtcagccaccgacgtggctttgcccgggcggttcctccgcccgtcggtgggctgcatgctttcctggctgcgcgggcgaggccctggagacttcccggggcccggccctcgccgatcgggcagccgcagcccagccgcgccgcggagccctgcgcccagtccccaagagcccaccccgcgcggctgccttcctgccgcccgcggctgcagttagcccgggaggaggaagacggcgtggaactcgttcttctcgcccccctccgccgactcccatcctttccaggtggacttctttctgttctttggacagatgggctaccgtttttcactgtggtcctctcatagcacaggaactttggcttcctgcgtttgataactgcacgttctgtacagtctctcttctgcatgtttcgatacgtgacagactgcccagtgtgactttcaggtgtctccttattgaaaaggaagatatgtgaggacctaatatttttatcaggctttttaccagctggctgcaaattatttaccctcgaagtaaccggcgacgtttgtagttgactgattggagctgtggttctatacctaaaagttatgatttcagcttctggtttggcatttttccacgtatgggaatttgccctcatttatagtttttttctatttatgaagaatagtagcatttgtagaacttctcttttagacgtgtaaatactgtttagtatggacaagtgcaggaggcattaaggtagtagagataagtgatttgttgatgatcgaggaagggttttatagagttatgtgcttacctgagggcagaattcgctagctgaaacacataaaattggactcccagtggtaggattaatgtgaggtataactgttgtgtggtattgtggcactttgcttatagcaagaaatgagctttcaattcaattttgaaattgtgccaaggctaacacttttatgcagataagtcccagatggaaatcaatcttgccattacaaagtaaatgtgaaaatgtcagtttgcctaaaatgataatgcagtctggaggtgttagttgaagtgagaaatcttgagcttattcttcatttttttcagttgttttgcttttgctagctataaagaatattttctgctactcgtgtgtggttttaatttagtataacttcaatactaatggtctgtttaaaaattctacatcattctttaatccagattaaattctagttgatcctcccgaatgggaaaaaatgccattaactttacctgtttgttaaaatatagtaccagcctttattgaaggagtctttgtcataaccattttgccagtgtcatccatttgcagtgtaaaaaaggtatgttgcaatagtaaaacaattcaaaaaattatttttccatatctaaacttaagcaatattaaaaatagtgggtttcctggctaatccatgtaatcggtgtatactactcgtatagtgtataatttaactatctattgaaaaatgcatttaatttagaaactcagaaatctgtctttcccttgtccaaaagtgggaacagaagtattgtttaccatcacttactaggtagcagtgacggttaatgtgggaagtggcagttttggcaggagtggcagctctggtggcatttttggccattgtatgagtgacagtgccactgagggcacagagctagaagatataaaaagaagaatctggtggtcactggccgtttataggtggagtatgagaagttgtttctgtgttttaagtttctataagttgggttttgccgagtgtttttttgtctttcaggaataatttaagattatttatttatacatttgcttcctccactagaccataacctttttgagggcagttattttttttcagtcattcattccatcagtttgtcaacggataaatttaatttatgcctaccatgtgcaggcactgttttaaaatctgaagatgaacagataactttcgctcttgtgtgaggaacatagcactattaaggagtaggctgtattatagcatgccagatagtattacgtgctgtggaaaaaaaaataaagcgggtaagagtcttagagagtgagaggatgacagtttaaaatagggtagtctggtaagttctcactgagaaggtggcatttgagcaaagacttgaaggaggtaagaaaggcagccttgcagatatctgggggaagagcatcccgggtagaaggagcagcaaatgcaaaaaccctgaggagagcgcctgtttgaagaaccccaggaacttgtacatagcaggagcagactgtgtaagggaacattagttggaagtgtctgtttgtgtagggcgtcattctattcttgctgcctggaatgtccttcctttccattgccacgtgtacaaattcaaccccttgttctagacccagcacaaacatcacctaaacattccgtgaagcctttgatcttgctcaaagcctcctcctggtttttaggatttttttcatctttgttatgacacagtattctcgttcacagcctataattcctcgtggcagccatcctatagaatacttgaaggaacgtatcagattttaggtatatttttgtcattctaagcagtcaacactgagtcttgaacatagaaaactctctaactctttgctaaatgcatttatttagaatctcctagcttgggatagagttgggattagttaacttgctgagtttccttctatctcttaaaatgtagtccttcactaactagaggttttaagaatctctgcctttagcataaaagtaatgatggcatatgtgttactcagctgtttctgttttaaggggtctctaagaagtatatgtccaatatgaataaaaatattgagtttaatttattaaacaatatctagaggtgtgactgagctaacaattccatatactggcaggatgctgaggtttgagtccaacagtaatcgtttaacactgagcagtttaaaaaatgtttaaccatttgccaacaagtttatcctactgcacttcattttcattcctcatttatctccctcaaatataacaacttacatattcatctctgccctttaacagtgcacatttccatttcatgctgtaatagattgttagattcgattgtggctccaagctgttatatgtgagaaataggaagttgcgcacctgttttgctaaacagaagttttggttcattctgctagagtcagacattacgaattcaagtgtgggctgggtgccatggctcatgcctgtaatctcagcactttgggaggccaaggcaggcggatcacctgaggtcaagagttcaagaccagtgtggccaacatggtgaaaccccatctctactaaaaatacaaaaattagccaggcatggtagcgcacgcctataagtgcagctactcgctcgaggctgagataggagaattgcttgaacctggggaggtggagaatgcagtgagctgagatcgtgccactgcattccagcctgggtgacagagtgagactccatctcaaaaaaaaaaaaaaaaaaaaaaaaaaaaaaaattcaagtctggactcaaaatgcatcccttttcgtttttgccttctatatccttggtctatgactgcacaaattcaaatgttttgcttggtttgtctttttaagttgatacttagcttcagcgacttgacaacagtaacctttagtcttttaatacttacctgacagtatttgtgcattactgtaaataactaatgagacttatattttataaactaaatatatttttacatagctatcaaacaaaaaaatcccttcggttgtgattccatagtgtatcctctggtgaattacttttaaaaaatttttctttttttatagagaaaaggtctcactatgttgctcaggctggtcttaacctcctggcctcaaacactcctccagctttggcttcccaaagtgctgggatgacagatctgagccaccatgcctggcctgtgaattacttttataaagtggaaatgtctttcttttgtgtgaattatcttagttgtttcttcagatataaaatactgtgtgtatgtatgcatgtgtgtgtacacaccacacacatattaagtgcaagcaggaaaaatttcaaattaacctatatgagttgcctcaatttttttaataaactgtatttaattaaactgttaaccaaatgcaagccttaggaggaactctaagattcttctttctcgtttttttttttttttttaaatcttaacataaaaatacaaagtgttgaaagtatagataacttcttttttcttttaaaaatatcccttaaaaagatccatccatgttcactcatgtctttttttagtgactattaagacgttgtggcagatgggataattaaacttatgtctgtgatcaagatagaattatcaacactcctgagtatgagggtgttaacacatactaacacacggcatttcagctttttgttaagaagaaaattccatacgatttggtttccttccatattagttataatgcgtttgtctgcataaattgggttttatgtagcctgactcaagtgcttggaaagaactatgttaggtacattataggaagtgcagagtagtagaccgattccaaaagtatttgattcagcaaatcaatgactttattgtagatccaatttctttctctttctctgctttactcatcacaaaattactattatccaaaggctgtttttctcctttggtaatcagttcaattcagaaagagacaaccatctgtttctgcagtcctggactgtgtctttcccttcattctggttagacccacccaagaccaatattcttaccctaatcaacatccaactttggattggagctgaagatgagagtgaaaacgggaataaaatggatattctgttggaaagatgaaagaaaggagtggatggtgggtaggcaaacaagggtctgctatttcttcttctaaacttttaaaaaaatatttatttttatggccgggtacagtggctcatgcctgtaatcccagcacgttgggaggcctagatgggaggattgtttgagcccaggagttcaagacaagcctgggcaacgtggcaaaaccctgtctctatgccaaaaatacaaaaattagtgagtcatgttagcacacacctatagtcttagctgcttaggtggctgaggtgagaggatcactgagctccggagatcaaggctgcaatgagctgagattgcgccattgcgctccagcctgggtgacagaggagaccctgtctcaacaaatttaaaaaaatatatgtttttattgaggtatagatgacaaaaaaaaattacatatatttaccgtgtacatgttatttttgtatatgtatatattgtgaaatgggtaaatcaagctaactaacatgtctatcaccactattccctctttattagcttttaatatatattagttttctgaaattttagattgcttctgaggttgttaatatcaggaatagttccttgtaatatgcaatactgaacctgtgtcacaatagatcttaatttcaggttttccttatatcaaagtatcctcgaaaaacccaaatgcttatacgttcacagtttttatgtggagtatgctggaaaacttgctttttaaaaattaagactaaaccttttgaatatttaattgtaaaggaggaaataaagtcttcaaagttaaaatgatttttggttatgaggtaagtgttataaataggacaatgttataggtcatttcatggcttttctaaaagaaggccttacgtgacgtacctatattatattctttagcaaagttgttttcaattttaagtaagtttctttttttgtgactgtggaaaattaaatattaaggccactaaggtcattcttgattttaccacacacagataattattaacacttagtgtatttccccccggtctttatttttcttttcagaatgtcccagtgaataggatataccttttagacattaataacacaaataaatgctttgaagctgatgatggatttattaaacattgtggctttaagataactgaatatgttaatgttcagccactctcttgttaaaatttaaaaaagacagtatatggtaatagcacattaataatttgcatgtcctaagaaatgtgtatatatctttcttttgtataaaattaaacttacctgtgtaacctgaggttatcagtgtccttgtctttttcgttctgaaaggaaatctttgctaatttttgtttgaaagtcaagagttcattcttacctttagcacttagtcttttttgtacctgtggattatggattttgtcactgctgttttataattcaaggtgattctgagttgttaccatctagagggcccagtccccttccaacttcttgtcgtataaaactgtcacattaggctaactaaacacattttttcctcacccatctgccttttcagctttcctctcatcaaatcctttgaagtacaatatagttaaaacagctttctttgctgaagaatcaagcaactcttagaaggatattgaagtgaataaaggacaattctagctaataactgttttcttaagattccaagtggaggaagcccttgtagagttaggcctctgactaggccttctagagataggcctctgggaagaggggtggtctttctggatactttctgatctgtctctccattacactctttctcttttcctgtccatattctttcaagtatttatttgttgtttgtatggccctattctaagcactagtaatacagtgataagtaagacggatgtcacccttgccctgtgggtttacattctggtgataggagataggcagtaaattatttaagattgtaattagtctgaagacaaatgaaacagtataagggaataaagcttgatggaggaaagcctatattagatagggtcattgggaatacctctttgacgacctgacatttgagaggaaaactgaatgagataagagaggaagaatatgaaaacagtaaagaaaagaatgtttcaggcagaaagaagtgcagtgtccctcaaatgggaccacacttgatgtgttcaggaatagcaagaaggcaagctgagaaatcacggggaagagaggcaggagataaagctaaagagaacgatggggacagatcatgcctgtatgccacaccatgccccttcttgacataattcagtttgatgacatcatgcccagcatgttctccacaagaggagatactcctctttgaatcacacttgcattttgccatttaaacagtgcctctgcagaaggggcagtgaggctctcctctgattggttactttcttctctacccagttattgttaggctctgtaaagaaggtgttgctaggccagtgaatgaaggtaaaagtcagtgcatcaaaaccaggcatggtgtgtgcctatagtcccagctacttgggagggtaaggtgggaggattgcctgagcccaggagttgaggctatgctaggcaaccatagcagggcccctgtcttctaaaaaaaaaacaaaaacaaaggaaacaaaaaacatgagtgctccagttctgtatagcctctctatcaatgagacctgtgatcaagctttcgtaagtcacctgtgaagtaacagaactcaagaagaaaaccatttttttcttagcttattgtcttaattatatgtgaatagagtttatgtgaagcccactagacccacctctattgtactgaaaagcatttacatttttccactcttgcaagcctggtgtaattacaagaatcacttgctgtcagtcacagttctctttgttactcaggaggaaagggctatcttttaatattccagacccactgaattgttttgattaccttgtgcttactgaggaagagtactagttgattctaccgcatacatatcctatttcctgtcattaatatatcttagtgtgacatgaaagggttataaaataaattttattgtagtaaaaaatatataacaaaatttatcattttaacagttgcaagtgtacagttttgtggcatgaagtatattcacattgttgtgtcaccatcaccacccatccatctgtagaacttagtctttcccaacagaaacttcttacacattaaacactaacttcctattctccccttctcctagtacctggcaaacaccattctactttgtgtctctatgaatttgactgctctaaaaacctcatataggaggaatcatagaatttttgtgttttggaaactggcttttcttttagcacgtcttcgaagttcactcatgttatgtagcatgtatcaaaatttccgtaatttttaaggcggaataatatttcattgtatgtgtgtacataccatcgacctaaaaggaagaggctgaagcacaaaataggattcaaagagtttacttgagccaaaatgagaacagttgcctgggagactcagactcaagtatccttggatatgagctccctttggccattgttacaagcaggtttgtgaaggcattaaataaaggggacatggagtgggctgatactaagttgtctgtcaggaattctcactagtttatagaaataactttggttaatgattgactaacattgttgagatgcagggagtagtttatagtgtgtggtgcagcattattaggttattttctagttacttgtggcagtataaagcagtttcaatagataaatatttctcatagctcaaaggagagaagtaggatgtgattgctgtcacattttaatgcctttctgggccagatcatttaaaaggacttgcattcctcagataaaagtttctttcttgatgccgtattttgtttatccgtttgtcagtggaaacttgggttgcttccatcctttggctattatgaataatgctgtgaacatagatgtactgatatctgtttgagtgcctgcttttactttttataggtacatacccagaagtggaattgttagattatatggtaattttatgttttgcttttttgtggggaagcggcacatcattttccacagtggctgtaccattttacattcccaccagcaatgcacaaaggttctagtttctctacatccacgttattttttgttttttgaaaatagccatcttaatgtttatgaagtggtgcctcattatggttttgatttgcatttctttagtgactagtgctgttgtgggtctgtttgtgtgtttattgaccatttgtatgtctttggaaaaatatctatttgagtcttttgcccattttaatattcagttgtttgtttttgttgttaagttgtaggagttttaaaaatatattctagatatcagtctcctgttgtatatatgatttgcaaatattttctctgattctgtggttgcctttttactctgttgatagtgtcctttgatacacacaactgtttaatgagatttaacttacgtttttgttgttgttgttgttgttgttgctggtgcttgcttttggtatcatacccagaaaatatttttttaattactatataatagtacattgtatagtatactataatttaaccaatcaatgtggacttcaattttgagtaaggttttttgatgagattaaataagagaatggttgtggagcttgacatacaaagacttagtaactgctgtgtaaataataatgattacttttattactgcttgttactttctacttctaagtggaagatcatgtagtcagtcataggactatagaacacaccagagattgttctcaaatactctttgtgttttctcagaatgaattatctcttttattttattttttttccaaaaaccccagtgtttaaattatatgggccctgttttggtaaaaggcaaaaggtttgtaagatctgaagagaaaccagagtatgtgggccctgttttggaatgaacttgctgcttataaaatggaaagtcctcaaacactcttccacagaaaagttctgtaagaagacttttataggagaaagtatggctgtaaaagttgccccagcttctttcattttctctgagaaattagctaaccttttaaaaaaaatcttaattaaaatatagctctcacatgctataagattcacccatttaaagtatataatacagtggcttctagaattatatcatggttgtgcaaccatcgccacaatctaagtttagaacatttttgtcaaactaaatgaaatttagtaactattagcagtcactcttcaatccccactccccactgtccctggcaaccactaatctgttttgtttccttagatttttctattctgaacattctatataaatggaatcatgaaatattacagtcttgtgattggcttcttttactttacatgatgctttcaggatttgcctatgttgtagcatatattaatatttcattactttttatagctaaataatattttagtatggggaaatatatatacactgtatcttgtttgtccatttatcaattgatggacatctgggttgtttccactttttggttactatgaataatggtgctatgaacattcatgtatgaatttttctgtgaccatatgttctcatttctctagggtatataactgggagtaaaattgccaaatcatatggtaagaatatgtttaattatttgaagaaatgccagactatattctaaagtgactgtaccattttacattcccaccaacaatgtctgagggctccagtttcttcatatcctaaccaactcttgttattgttggttatttttattctagctgtcctgatgggtatcaagtagtatcttattgtgattttcacttacattttcctgatgacagatgatgttgaacatctcttcatgtgattatcatccatttacatacctttttgaaagaaatatatattcaaatcctttgcctgtttttaagttgtctttttattattgacttgtaagagttcttaatatactctaagtgcagatcctttgtcaggtatatgatgtgcatgtatctcctcccattccataggttgtctttttactttcttgctgctatcacttgtagcacagtggttttgaattttgatatcatctagtttatctctttttttcttcacttgagcttttggtatcctatctaaaaaatctttgcctactccaaggtcaaaatcttgtaactgtgtttcctttcaagagtttagtagccttaattcttatacctaggtctgtggtccatttcaggttagttttgtgtatggtgtgaggtggggatccagttttattcttttacatgtggatatttagttgtttgagcaccatttgttgattattctttccctattgaattgccttggtactttactccaaggtttcctcccagattttatcttgttcttggagttcttagaccttccagctgccaccatggttgactctctaaatatttcaaactcagtctgtcaccttctcagctttttgttatttcagtaatagagtgtttgccattgaaattgggaaatattttaatatgtgtctttgttcattttttgcttctataacagaatacttgagactcagtaatttatagtgaacagaaatttatttggttcatggttctggaggctgggaagtccaaggtcaaggagccacgtgtggtgagggccttcctgctgcatcataacatggtgaaaggcatcacatggtatgcacacgtgggcaagtgtgggagaaaacttgctttgataacccactcctgtaataatgaccttcattcattcatgagagcagagccctcatgaccttatcaccttttaaaggtcttacgttttaacactgttgcgttggagattaaatttccaacacatgaactttgggggagacattcaaaccaaagcagaatggttgatggtggtttagggcgttaattatacctgccatttattgagtacttttttgtgcatgctaagcattttttatacattgtaagagaaaataggagagaattcttctctaaagaaatttaatgagatatcttggagagttctaattaagttactattgtaggtgccccagtctcttcttgtttgggatttgaggatactgctatcctgattgctggttctttgcacactctggctgaagttaggcctgcccatgtacacagagtctccagccagacttcttaggagaggccttggcagaaaacacactaactgaattttctttgctagggtcttctctttttcatgattcctaaatgtttggagtgctctgaggctttgtcctcagatatctctttttttttttttaagtgcaacataaactattattattcttcatatattttcttgattctgtgattttgtccacattttacttctgcccttcatgtaacttcatactccccattctctatatttttgaattctacctattctttaatgcccttcctcagtatttgtcacttttctttgaagatgacagtcttgctgctcaaaatcattgttcctcttgacttcttacagtatgttatttgtactactcttatgtcagaaatcgccctctaccttttattataaagttattttctatatatgtatgcttatatatgtgtgtgtgtgtatgtatatattttatatctatctatctatctatctatctatctatctatctatctatctctgtctctgtcacccaggctggagtgcagtggtgcaatctcggctcactgcaacctccacctcctgggttcaagcgattctcctgcctcagcctcctgagtagctgggactacaggcatacaccaccatgcctcaccactttttttgtatttttagtagagatggggtttcaccatgttgatcaggctggttttgaactcctgacctcaaatgatctgcctgcgttggcctcccagagtgctggaattacaggcgtgagccaccgtgcctagtcctattttaatatttttattcaaccagggcctcgctcagccacctaggctggagtccggtggtatatcacggctcactgcagccttgatctccctgggctcaggtgatcctctaacctcagcctcctgagtaactgggactacaggcatgcatcaccatgcccagctaatttttgtattttttgtagagatggggtttcaccatgttgcccaggcttgtctggaactcctggcttcaggtgatcctcccaccttggcctcccaaagtgctgggattacaggcttgagccactgcacccagttgattatgaggaattcggtttctttttttgaaatataaaaaaggcaaaatacaaaactataaattcaaaataatgatatctatattttacttcttgtattagatcataagctgtttgagaaaaggatctatttgtctttgatcttggtaatcctctgtattttaacatttaccagagtgaatgaatgcattttaagaaaatactttcctaaatttttaaaagaatgatgaggatgggagatgacattgactatgattagagggaagttttaaagttgcctgtgtgatatatgcataaggacaggagggaaacgtaggaaaagagaaaatattgttagtgggtttctgttttttttaaagtttatttttgtttttcattactacattaagaaatattaaaataataaaagtttgtgcccttttgtaactgtagttgtctttagactgatgtaatctaggagttgtgaccaactgaaatatagctcttttgacttcggttgtgaaactatagtgttaggaaatctgatcagcctgaagcaagttctaggctccttaatgaaagctgctaagttaaataaggaaaatagttttatgtcagcagatacttatttaattttagcttagcctttggatgtttgattaaaattttaaggcattctttcctatattgttttcttttttcttcatttttaattgatataataactgtgcatatttatggggtacagtgtgatgttttgatctatgtatacattataaaaggatccaatcaagctagttaatacatccagcatcttttttttttttttctagagatagcatcttgccctgtctcccaggctggaatgccctgatgcccaggctgatgggcagtggtgtgatcattagctcactgcagcctcaacctccagggctcaagggcctcaagggatacttttggctcagcctccttggtagccaggactacaggtgcccaccaccatgctcaactaagtttttaaaacatttttgttgttgttgtttagatggggtctcactttgtagcccaggctggtatgaaattcctggcttcaagcaatcctccggcctcggcctcccaaagtgctgggattacaaacgtgagccactgcacctagcaacgtatctataatctcaccaacttattatttctttgtggggagaatgttaaaaatacattcttctggaagttttaaaatatatattattattaactgtggtcaccatgcagttcagtagatcacaaaaacttattcctccagtctgactgaaactttgtgccctttgatcaacatttttgctttccccgttcctccttttattcccaccaccagccgctggtaaccaccgctactgattttcttagttgagtattgccagcattctaagaagattccaagtggcagcagttgaagttcctatgagaaattctttcactatcaatgtaatgaaacatagttaaaggttagcacagttgacctcttccttgataagcagtaatataatacagaaagataacattccttaaaagaaaacttcctatgagattttattgtccttagaattgtagagctgacttttcagataaggcccagaggtagtacttaaaaataagtcagtgttaatgcatgcttattatatgccagatatcattctacaagtatgtacacgtatgtataaagtaagtgtatgaactcagttctcacaacaccaccatgaggtagatattgttgcattctccatgctacaaatgaggaaaactcaggcacagagaggataagtaacttgctcaaagtcacagagttaacaaagagtacatccaggaataaacccatatatctggttgcagattatttactctcctcctttccttcttttagtttgtttcttcaagttatacgtacatattggttaaagaatctaatagtttcataaggtttgttatgaaaaataacatttcatttctccctttccacaagtaactatttttagctgctgatttcagtgtttatgtacgtgtctaaataatgtacttgttttactgcctgatttattacttgtagacatgatttattctgctattaaaaatgattatttggctgtcctctcctccacaactaattcccagtcccctcatagttatttcataattttggttagatcagtgtttgatgtttacgttaatttattatgtaaacactatcttcagctgagccatgttgtaaactgtactgttttttctttcctgacactttttcttcaaaggttgtaattaccttttcatttgatgtagtttttaatgcacttatcactagtttacatctttgccagttgtctgaatcatacacatcttttctcagttttaggttcttaaataaatctcttctggagccttttgactaggaccaatccagaccagttgtatggcagtcatgctgggatctttattattttaggggattccttttgcttgtttcctgtgttggacctcctattgcttcatttctttgtttactatcctgccatggtggagccagtaataccctccagcaatttcttgagaaaaaggtcatgggaagtagattttttgtgatctggcatgctgcccaaaaatttttattatgactccacattgactgcatataaaattttaggttagaattttttctcagaactttgattatatgcttcatcaccttttagtttccagtgttgctatttaaaagtctgaagcagttctgattacttacctttgatgtgtgatcatttataccttccaaaaagttgtagattcctgttttttgggcagagtttctacagtttcacagacccttgccattggtctgttttcattagttgtgctgggtacttgatgggtcctttggtcgtagaaacttttgacccctgctggaaacatttcttcattttctgttctcgagtctccttttttcagtttttctgaatttctttggactcttctacgtatcttattctttctctttcattttctatctttgtgccctttgggtcaatttcccacctttattctccagttttctactgaatttttaaaatttctccatatattttaaattcccatgagcttctttatttctgaatttcactcttttataatatactgttattttatagttgtattatcttttcttacttctcttatattaatgatatatatttttaaattttcttctttttacttggtttgtttcctctgagttgctttttcccctattttatgtttaactttttaaaaaaatttatttattttttattttttattttttattatactttaaattctgggatacatgtgcagaatgggcaggtttgttacataggtatacaagtgccatggtggtttgctgcacctatattagagttgtcttcagctgtccaataatccttgactgactgctcctttctaaggatagggtactgaaagctgattggaagctctcaatccatgattagaggttgcctgtgcgatctttacttgaggtaatcaagctaggcagtttaggtagtgtaggaattggaattgtgactacaactccccaaatcgtcatgacttaacgtaatacaagtttgtttctcacttggataaagcccagcgttggtgttcttggtcaactagaacctttcatgtgggcctttttttatcattcttgagaaggggccaaaggaacttctacatctagttagcatggaagattttgcaggaatttttatgagtgaggcttgggtagtatatttttaacaacctgatcatctgggaggaaaaagctctgatttatagcatttgctgatctttatggtataaatacttcatcatgaccaatttcaggctactgacatgatgtcaccaaatgcagaattaggaagagatacacccagtaggctttcatgccagctctggcataccactgtaactactagccacattccactggccagaactgtgttgtatggctccacctaaattcaagggagggtgaaattgtgtgccctggaagtaagggaactagattttagtgaacagctaacagttttctgtcatagttggtatctctattatcattatctttagatctagttagagttcctacagagttatgttccaatctcctgcctagacggtgaagaaggcctgcctctaggtattctgagaactgattagacaggatctggtggtatctgtacatttacctaatccccatgttttcagtgtggtccctgaatttattttatgttactgtaacaaattaccacagacttagtggcttaaaacaacccaaacttatcgttgtacggttctgtaggtaagaagtcagatgtgggttttactggactaaaatcaaggtattggtatagctgcatccctttctggaggctctgggagagaatctatgttcttgtcttttctagctcctagaggccaccctcattccttgctcatggcttccattctccatgttcatagccagcggcatagcagtatatctgtgattctttttctctagtcacatctccctctgaccacagcccaggaaagattctcagattttaaagtgccatgcgatgcaattagctccacctatataatctgggataatatcttcatctcagagtccttaatcacatctgcaaaggcatttgtcatgttaaccacacatatttacaggttccagggattaggatgttgtcattttttggtgggccgtttttctggctaccacagtaccccttgctctccgaagaccctccctttgatctattcctagtaataaaattatgaacttttgttggggatggtagtgggaatttagtgatccttctgcttttcaaacaaactttccatccttattttacagtactctctttatcttcacttccagacatatgtaaaagcaccaattcatgaggtttttgcctagtttgtgacacaaattgagttagttttatgatttccctctcaccaatttaggattaaattttctgagaatactttaacacttatttaaacactttcaagattttgttgttgttgtcttcctttcccattctcctcatccttgtgtgtttatgcctttaccaaaaaagccctttaatattgtcttagctggggtttgggcaggcaacaaaggcagatgtgtgtttaatttaccatcttaattagaacacagcttgcacttttaacttctgtaccatactgccttaactttattgccttttttatgtgtaaggtaacccagattttggataatataaatggttgtggatcctgtcttctagattacaaatttatttattcaatacgcttttattggctactctacatcagccactttgctgagcatttcaaatacaaagctcaggttccggtgttagaattcagactactacaaaggaaatttgagcacattgttataagtgtatgataggaatagaaacaatactaaggaaccatggagaaaaaagggactaattttaattgagagtcaggaaagacttcatagaagtcataatgttctagctgtgtcttagaaagggtgttgctagagaatggagtgtggaagttgttcccagacggaagtgggaaaatgtgaagaaggtgaatggtaagaagttcaatgtggctggagcagatcataaaggggagaagaaagagatgatgaaacttcagggattagtctggcttagattttggagaacgttttatggcatggtagggagtttgtatttaggtcagataaaaactagagatctttaagaaaggaagtaacacggcttgcacatctttggttaaatttatttctaagttttttatttgtttaatttcttgtttgggatgatattgtgaatggattttaaaaagttattattaaaaaaattttttttgaggcagggtcttgctctgtcatccagactggattgtggtggcatgatcttggctcactgtaacctccacctcccaggctcaagcaatcctcctacctcagcctcccaagtagctgggactacagacatgcactaccatgcctgggtaattttttgtagagacagggttttgccatgttgaccaggctggtcttaaacttctagactcaagagatcatcccacctcagcctcccaaagtgttgggattacagacgtgagtcactgaaccaggccaaaattttcttttcttttctttttttttttttttttttgagatggggtctcgctatgttgcccaggctgatcttgaacttctgggctcaagtgatgatccccttcagcctcccaaagtgctgagattataggtgtgagccactgtgcccaactcagaatcattcatatttaagggcgtggttcggttctttaacttactttttataggattccattgtacaattccattccgtaattatccttctgtgactggtggacatttgggtcattttcaacttttcttattacaaacagcgcttttatgaacattcttctgtttgtctcctggtacagaggttaagagattttttttatgtacagtcaactcttgcaagggtctacttacacacagctttttttcagtaagtttattgggaagttttttggagatttttgacaaattgaaaaaacttgccaattgtgtagcctagaaatataaaaaaaaattaaaaactttggagatatgttatcaatgcataaaacacagtagatactagtttattttatcatttactaccataaaatatatacaaatccattgtaaaaagttaaaatgtatcaaaatttatgcaaacacgtagagactggacgtggtgctattctcagtacgtggtgctactctcagtggagagaactgtaaacaaatgtaaagatgcagtattaaattataactgtataaaattaactgtagtttgtactgtactactgtaataattccaacattctgttgctattgtggtaaattcaggtgttttgagaatctgcttaaaatgctgtgtgatgctaatcatctcctggtgagcaatttgtctctctagtaaattgcacatcacagtaaaaagtgctttctcccaattcctgtgtaatttgttatcatgtttgttgtaatatcataaaccttgaataacactatgggagtcatatgaagtgctactagtgatgttggaagtgctcccaagcagcagagaaatatcatgacgctacaagaaaaagttgaattgcttgttatgtaccttagatagaggtctgtggctgtggttgcccagtattcaatgaatccagcaaaaggactattgtaaagaaaataaaattcatggtcaggcacggtggctcatgcctgtaatcccagcactttgggaggccaaggcaggtggatcacttgaggtcaggagttcgagaccagcctggccaatatggcaaaaccccttttctactacaagtacaaaaattatggctgggcgtggtggctcccatctgtaatcctagcactttgggagaccgaggcgggtggatcacctcggtcgagttcaagaccagcctggccaatatggtgaaacctcgtctctactaaaaatacaaaaattagctgggcatggtggtgggcgcctgtaatcccagctacttgggaggctgaggcaggagaatcgcttgaacccaggaggcggaggttgcagtgagcgagatcatgccattgcactccagcctgggcaacagagcaaaaactatctcgaaaaaaaataaaaataaaaatacaaaaattagctgggcatggtggcgggaacctgtaatcccagctactcgggaggctgaggcaggagaattgcttgaaccctggaggtgggttgcagtgagtcaaaattgcaccactgcactccagcctgggcaacagagggagactccatctcaaaaaaaagaaaagaaaaagaaaattcatgaatctgtagctatagctatgccagtgtgtgagaaaactttgcaccttttgcaaaatccctttttacgtcgtattgaaaatccagctcttatgtgggcacaggaatgctataagaaaggcatatctatagaatatgatttgagaaaaaatgaagtcattatatgataacataaagcataaggaaggtaaaggatctaaagctggaaaatttaatgccagcaaaggatggtttgatgcttatagaaagaggtttgagtttaaaaatgtcaagatgacaggagaagccagctgttgctgaccaagaggtagcagacgagttcccaggcaccattaagaaaaccattgcagagaaaagatgtctgcctgaacagatttttaatgcagacgaaagtgccttattctggaaaaagaaaaaaatctaccacaaaagatattttttagtaaggaagaggaacaagcaccaggatttaaagttggaagggataggctaactctactgttttgtgcaaatgcattcaggtttatgatgaggactatctttatctataaagctgctaatccctgagccttgaagggaaaagataaacaccagctgctagtctcttggttctataagaaggagtggatgagaaccccttttctggattgagtccatagatactttgttcctgaagctaggaaattccttgctagtaagtgactgccttttaaagtttttttgatattggacaatccccctggcatcccagaaccccatgagttcaacaccaaaggcattgaagtggtcaccttgcccccagtcacaaagtttgtaattcagcctaaagatcagggtcataaggacctttagggctcattacacttggtatttatggaaaggattttcaacactatgcaagagaatcttaatagaatatcatgcaagtctggaagggtgacatcattaaagatgtcattgttgttatagaaaaagctgtgaaagccatgaggcctgaaacagtgcattcctgctgaagaaaaccgtgtctatatgttgagcatgacttcacaggatttatgacacaaccaatcaaagaaatcatggaagagattgtgaatgtagcaaaaaaggtgggagaatgaagggtttcaagataagggtttcagagaaatctaagagcgcatagcacaacagagtaattagcagaacacattttgatggagatgagtgcttctgaacaatgccagatgataaggaagtagacttagaagaagcagcgccagaaaacaaattgacattagacaatctggcagaagagttccagttattcaagactgctttgacttcttttaatgacatggacccttctgtaatatgatgctaaagctaaagcagacagtggaacaaggattagtactgtatagaaacatttttagagaaatgaaaaagcaaaacggcagacagaaattactgtgtatttccataaagttatatcaagtatgcctgcctctccagcctccccatccactacctccaccttttctgcctttgccatacttaagacaacaaaacaaacacctctcctcgtcctctgcttcttcagcctacttaacatgaagacaaagaggaagcctttttgatgatctgtttccactcagtgaatagtaaatatattttctcttatgattttcttaataacattttcttttctctagcttactttaagaattgttaagagaaaaagtgtagtggagttaacatttttggggagtgaaaacttatgcatagatttccaaatgcatgggggatcagcatccctaactgccacattgttcaagggtcaactgtctatgtaattgccaatgtgcaattgtttttgatcttcaaaaactggtttcatatggtttagattagtatctaggagagaaagtgctggttaataaaactgtttccccaagtgattatatgtttaccctcccactggtgagatgagagtttctttggctctacatcgttgtcaacattttttactatcatatttttatacttttgctgatatggtacatgtggagctatctcattgttttaatttgtatttcacttaattactactgcgatttagtatcttttcatttctttgtggaccattcacatcctttcctgtgaaattggtgttcatgattttggtcagtcttctattgcagtgtttaggaagcttactcttgttttgttttgtttgagatagaatctcactctgtcgccaggctggagtgcagtggcgcgatctcagctcactgtaatctctgcctcctgggttcaagcgattctcctgcttcagcctcccgagtagctgggattacaggcacgtgccaccacacccagctatttttgtatttttagtagagacggggtttcactgtgttggccaggatggtctcgatctcctgaccttgtgatccacccatctcggcctctcagagtgctgggattacaggcatgagccactgtgcccggccaggacgctgactcttactggaatatgaattgcttggtccaggttaataaatgtttattgacccaatccttggctttagatcggcttatataaagatgagtaagatggatggactcttacctcagtctatatttagtaaaggttaaacttaattggaagctccatagttctatttctttcctccattcaaatatagattagctacactatttatatctttacctttctgattcagtttactcatttgtaagataatcagctttgactagttaatatctagtttcccttttaccagtgtatgtaattcatctaatattttttcttgttggtttttgaaacttagaaatgtgttacttttattatagtggtaaatataaataattgggttttttttctttttcatcaaaaaatactgggttttgcttctgtaaggtataatttaagtcacttctccaaggacccctctcttagatggatttcccagacagatattgctacctttgattttaaaaattcttaaaatgctattaaacctatacactccatcctaatatatatgaattattcttcctcagagtgaagatacacaacagcaaatcatcagggagactttccatttggtatctaagagagatgaaaatgtttgtaatttcctagaaggaggattgtaagtaaagcatttcatagacatttctaagttttgactatgtgattaaaatatatactgtttaatcagtttatggtaaaagttttctacttttgattaattggattaggtgaattaattgccacctatgttagctataaatctaacttaaagaattatttttaaaagatatgcaatcttttttcctcttaaaaattttggaagggaattttatataaaggtaatatattaaatcgtaaaaattccaacattacagggaagtataaaatgtaaaataagaatctctcaaccttagtccttctacccaatttcttgtgtatccttctagaaaatagtttgtattgactaacatataaagtatgttatatgtgttgactaacctacaaccttaaaatttttatttatgagatcacactttgtatgctcatttgcatgttgctggttctcagtattttcaaaagctttgcatagaaacacatctaggacaagcttattctttttaatgactacagagtattcctttttgtgaatgttcataaaaattagattacattctttattttactgttacaagactgaagtctgtttttcaaatatacctaattcagctaatcaatttttctatttttaaaatgaataagaatattgccaaatattacaaacaaatacttttaaactaataacttccatgaaaatggtttgttctcaaacataaatcagtcagagaaacttagaattttctgtattttactgtgtatgatggatgagaaatactctggataacagggaatccatggtcataaggtactttttatcatgtggaacacttaacttgggtttcctgaaagattatatcatgctgtccttaaatgtccaatacatacttacaaattttgctgttaactcaaggcttctaatttaataattgagacaagtgtacctgcttctgtttttgaattttacttgtacttatttaattttagttgtctttgacattactatcacttcctctcatcctagcctcttgatttcttatctcctaggaaacttaccacccagcacagtgcactgcatgtaagaacttgattaatcttactagggtgctatttgaattagaaattgtggctggaaattgtgattgttcttttttaaccttacaaaaaatagaaagcaaatattgcagcagagatgaggcctcacatctagtttaatcctagttttgtcactaactagctgatttccttggacaggttacttaaattctcaggcctcagttttctcctctataaaatgagttatttggactaacaggatttctcagtcctgtggttttatatgatgtattacattctgtacaggaatttttgtcagtattatactatagcttaaagataagattatatttttaaaggcaaaatatgtacttgccgcattaatattttgcttgcttttaatagcattactggcctttttgaaacttatattcttcagaagtttgctgtccttttaaagtaaagcaaaagttttaagataatcactaaatcgctgattcagaatggagtaaagcctcctatttgtgttctttttgcctctttcagggaacaattgcagtcatagtctgtaaatatactctcagaatctttaaattgcatgtagatatttttaaattaaacatcttctctagaagagtatctagcatagtaggaaatttttattcttgtcaaagatcatttctccttttgctattagaagacatagaagtagtatataccttgggaagttgtttctacagaacttataagtttagtattatttttactgtgtaagaaatagatgctggccaggcgcagtggctcacgcctgtaatcctagcattttgggaggcctaggcgtgcagatctcctgagctcaggagttcgagaccagcctgggcaacatggtgaaaccccatctctactaaaagtacaaaaatcagccaggtgtggtggtgtgcgcctgtaattgcagctactttggtggctgaggcaggagaattgcttgaagccaggaggcagaggctgcagtgagctgagatagcaccattgcactccagcctgggtgacagagtgaaactctgtctcaaaaagaaagagagagagagagacagagaaagagaggatgaagggagggagggagggaaggaaggaaggaagggagggagggagggagggagggagggagagatgccattttcccatattctgttgggatggatgttagtttaattttggttacatatagccttgattgtaaattatgtaagtgtttaggggtcttttaagaaggtgaattcattattgtaaacttaactatgaaatagctaaactatatttagaaaaatatgtttggaatgattcctaaattattatttctaaaatactaaaattccagtcattataaataaaagtatttcatgaaagagtttagtatcttagctcagttttcttgcatttatgtcaaaacaatgtaattttggaagagatcttgacggtaaatctatccaaaacttaagaagtgtcattcttcttttttttctggttgataatcagtcttaagctgtgtaacttactgtgacgtatggagttaaatctagtaagcacttacaaatgccccatgatctaatttccgcctacttctctgactttatcatttactaatcttttcttatctactggccttttttctcttccctgaacatacatactttgttcttgatgaaatgtccttttagtacttactaccttagcctgaaatgctcttctctaaattttttccaagccaactccttatcattagatctcagcttaaatgccactcttgcttaatattcagcctgaagtagggaacccatcaatatatcatcattgtattttgattgtcagtgtaacacttgccactatctgatgatgttctgatgtgtgtgtttgttgcttcttccccactaccagtgcttggcacatagtagttactcagagaatagtttaatgaatgaatgaactgaaattaagcactggcttcttttacttgatgtttctgaagaaaacagccaccttaattcacctagtctctgaataagttcacttaaatactttgccattgaatgtcacctttcatttgacaagtggtttttaaacaaattgtcagtttgcttgagctaatgaaaatgattcgcattttgtttccaataacattacaatttttttgtcatttagattaattggaggatctgacaacaaactgatttatagacattatgcaacgttatattttgtcttctgtgtggattcttcagaaagtgaacttggcattttagatctaattcaagtaagttaacacttgcttcttactatcttaaataacagtttgacatttaaatttttaaaaacttatatattctaaattttctaaaatgatgttagtaagaaataaagcatttcataatagatattgtgttggtaaaagaggtcagaggacatagaaacaagcaaacatttgatctgattaaaactatcataactagtttaatcatgacattttatcttgctcatgtaagttacagcaaggagcttaagactcgtgggtttcttaacacatgtatccaaaactaaccctaaaccctacctctccctgtctcctgaaaatctttcataatgtccctggaactcaaggtcagtcatcagcaaatttctttttatcttcagcctcttctgttaatattactttacattttgctctaaattaaatcttgcttccctgatgatactacgtgcaaccctttgaagtagtggccattttctctcctgcttctttctgcctttgagcctggaggtgtaatcttagcttctcattgcattttccagaccattctttcttctcaaacacctccaaattttatcttatgttatcagactataccaccttctatccatttagttatagtcatcactcatctccatctctccttcattggagattttgttaagaattgtgaagggtctgagatttgctctacttgcaaactaagaagttaacctgccataatttcatggatgctggcagaaggcaggagatttctgggccagagacaaaggaccttattactaatagcaaaaacattagctaaagtgacagcatttgcttgcacgaattctctaattcccaaagggtgatatgaagaggtccagatgatacctgcacacacagtggattaaatgacagatgaggaacgccaagtttagggaactggaatcttttataatggatactaagcatgtctgcccttgtttggaaggaagactgtctcttccaagagtgtaaggaaacctatcctttgctgtggaagaagacactgtctattttccagggctgtttgatatacaagcatgcttaaaaagatagcccagaacaaagacagtcaatgcctctgctcacaatacgtgtggaaacacaagatccatctaaaattgtctcctaatagattttggttcttggttccctggcattcattccagtactgcttgttttgtaattcttggtgattccattgttcatatgtataattctcccaatatcctggtgtcttcaaaatctggaactcctctcttccaataaattttgccctccactccatctcactatgtacccatttctagattttatctttgtctaaactgtaacccctccataatctcaatttcacagttttgaagtcgttagacctattgcaaccctcagttttaaaaatccatcatttttttcactctgattttactgatgtcttactttccttatccagcttaaatttcataatcatggtagtgatatagccttgtgtacactgaactccttgcccacacccatacatctgaacatacctagaggaaaaaaaaaagtaaccatatttaccagtctcactttaaattaatgatcccttagctcattgagtcctttatgctacgcaagaatcattttctgtttccccggtccatttactctcccatacctctagatgactactcatacagtctcctctctcctaaaatatctagcacttctagcaccttgcttcccagtgcacagataaaattggcttttgaagttagcaagaaggtggcatggtttgagctctagttggcgttacagaatagacaagaaattaacccaagcagacaacttaggtaacaaattcttagcactgtggctaaggctttaaaaataaaaacattgtggccaggtgtggtagttcacacctgtaatcctagcactttggaaggctaagctgagcagatcacttgagcccaggagttcgagaccagcctgggcaaccccatctctacaaaaattagacaggcatgctgttctgcacctgtcgtcccaatcacttgggaggctgaggcgggagccagggaggatggcttgtagtgagctgagattgtgccactcactccagcccaggtaacagagtgagaccctgtctcaaaaaaaatagaaataaaaacattgttaataaaataaaaaaggagataaatgataaattgatctatttgtatgccatattactcttaaatctgtaattcttaaactgggtttttgggaggagctgggtatcaaagttacatgaaaccacaaggtaatcatggcacatattcctggtatatgtttcttctttgttttgaagattggcggcagtgaggaaatgaacgtaaacatgtatatattatgaggtagaatacaaatttttcataatatttaaagctctaagtggagacttgaaagaaattttgagcttgaggtaaaggtgccccaagatcccttgggtatatgttcactttcctcctggggcctacttgagaaacactgctgagttatgttttgctttctcaaggcttttctagtaaagaaaaagaagccaaatcttacttttgatgacattgaagggttgatcaggactatatattgcattgccttgtaactttgtttattcttacatttcttagtttatcccacctaggggagtagttaattcattttatcattatgtcaagagagcattatatttttacagaaaaaaaattaatatagaaccatgctttctatttctctgtttcccatgactgaagagagtggtagacatgcacactatgttccaaaacactgtttttatttacctgagcctagccactagaattacaggaagaaaaacaggagaaagtgtaccatttcaaatttagtctcttattgaagagaaatgttgctattaagaaagaccaaaacaaatgtgtcttttcctagaggtaaatcagaagtattttatgcttgcgtcctgagattaagtcatcaccattgattattattttgatgctgttgttgatcttcttatgagaaagtagttctatctccaaaggggattagatggggagttttcaaagaacaaacatggtattaatatatcatatccaaagtaaattctgtcatgtactcgtggaaagtagaaactatcttttgtgttttgcaaaattttttatccatgcttcacacgttgatcacttgttttgatattagataacatacagaagaaaggatttcaggaggactttgtcattttccgattactaaagtaggctagagctgtttttacaatacccctgagttaccacatgctgatgtattgtgtcacaaaaaagaagatttctgtaattcaccttataggtactatgtctgtcactatcaggaacatgttggaagttctgtggttgtgatctttccccttcaattaccacagttcattaaatactgaagagggagtgtactgagcacacatgagtcagtcactttaaaaaacatcagttgaataaacaaagatggaagtgcatagcttattatttctgcttctgtttcatcaaatagctattcagagagaactgattttcttaatttgttcatcctctagtttttagaaaggcaattttaatgtaaaaagtaaaagtggaaaattataaaccaagagagtttacatcaaaacctcttggtcttgcatattcttttagagaacagatcaagaaaactcaatatgtaactattaaacctatgcttataattttgatattttaaatatcaaagtgataccattcatataactggaagcatatattttaatgcagagagttagtgtctctaaggtatgcatatgttgtcccaaatatgactttgtatctgtataaaatctgggagaaggcattattaataaattcgttatggaatttacaccgctattccaccagtactgaatttacattggtagtccacagaatttacaccagctacccaaacgaatgatcagtttttgttttcttttgtttctttttaaaaattccttgtaagtttggaaaaaaggggtggacttttttttattgatatataccattttagtgtgatattaactgctatgtatgccatatatgctagagttaatagctagctttttaaggagtcctttctgttgtagcatattgttattggaagtgttaaaatatttacaggatgagaatagaagtttattaaatattaatgttgggttgagttatttataagcagttgtattgtccttaattagtttattatgccaagctgataatggaggcatataaattcactggataattccaaatctctgttacagttttctgtaccacatgtaacagtaatcagagcatcagtcttattcagttgtagctagattaaaaaaacaacaaaattgagaactaacagctaaactttctttaggtttagaaagatacgttctgaccatgttgttagaatgtatatttaaactggagctccatatataatatttgttattattacagtactgttaaactaccttttgaggaattattttattcatggctgctaatgctcatttagtatgatgttgagcaagttatttattctttatagaccttaattttttttttaactttacatgcttgtttcaacatgttgcctacagacaagaggttgttagaaagacctgtgaattaaagctatctattatcttgtagtggttaaaaccatttagctctgccatatactatgtaattttggcaagttatttaacctctttgaccctaactttcctcatccacaaaacagggataataataataacaccaattcacagagtaggtgtgagcgttaaaaaaagatatttcatgtgaaacccatgactaaatgattaacatttcagtggtttttagctaacattatcactaaagcatatatttgtaagaaaggcatataaaatattattttgttagtacacaaactgaagtaaatatgtttttttttaatctttctgactttctcattgttagaagcatttttgaatctttttatcctatatgttgtttgatggcttggaatgaattttatatgacacatttatgtgataagaaatagtcttcattggggaaatttataagccaagaatacttaagtgaggaaaggtctctgatcttcccagcatcacctggcaaattatggcgaggtaggtacttctgaccgactgaatatacagtggtgtgccgatgaaggcccacccaattatggttctcatctatcatgatggtaggcctgaaagcacacttggtggtggggtgacagatacactgtttaagccttgggctatgtaggtttgggtaccacctgttttttaaaattgcctaggaaaaccgactgtccagcacttggaaattgtgggaatttgcaactctcctgttggagatgaaccaactcttggtcccagaggaagatgagtttctggtgcagttcctcctgctggagcaagagggattcctggcctagcgagcttattttccaggcactcaagtgaatgcccaggatcattttaggaaaattctgcctcctacattatactgtattaccaggttatttaaaactttctgttttcagtaagatttgtttctcatgtatttttgggcaacccccagtttttttaaaatagtttgggtcagattgttagagttgtgcaggattcctaaaattattttcctgtgttattttcatgcttgagaagtctgatttccagcaattgcaaatataataattctcagttatttacattgctatttgtgacaaatcctggtatcaaatttgatgataactgcttttctaatttacatgtttcattgatgtcttagcagttcttttaggaggcatcatggcgtcaggtttagagtgtcagggtgttagagtcaggtagtatggatttgaatcttggctctgtcacataacagttatataactttaggcaattacttaacctcatctgtccccagttttcttttttgtaagtgctgatattcatacttatctcaccagcattgttgtaagaattagaactaatttatataaacaatcagcaaatggtctagaatatagtagacacgcttttcttagttacttcacagtagtgaaggaagtagtttagaactcaagtgcttaaagtcagagttttggagctggaagtgacttaaaatttattttcttcccttcaatgtaggtttaagagaaaaactcaggttatgttggtctttttctttgatttaaggtaaattcatcatgtcctaatgtagaatggttggttttcaggaaggaattggacatggtggagagactccccaaatttaacattaaccacagtacagctattaacccaagaaattaacattgatacactactatataatctgtaggccttgtttacaatttgccacttgtcccattcaaatgtcctttttctcattctggatgtaattcacacattccatttagctgccatgtcttcttaatctcctttactgtgtaacaattctttaactttgtctttcattcatgtctttcatatactgatccttttgatgagtactagccagttattttgatattccccaatttgggtttgtttgatacttcttaatgatttagattgtgcattttgggcaagaataccacagaaataatgttatgtccatagtgcatcatatcaggaggtatatgatgtccatttgttccactacttgtgatatttgtgatgatcacttggttaagtttgagtccaacaggtttatgcaccataaagtttcattttcccatggtgctagtatttttatggggaatatttgagactatgtaaatatactttttctagtcatatatttgttaattcatcttaatatctattgatcattcttacctaaaagaattattaatatttatggtgtttaccaaatggtggggtttttttctatcatacctcaatatttaatagttgaaattctcctgtgaggaaaagctttgtaatatatatatatttttattgtactttaagttctgagatacatatgtagaaggtgtaggtttgttacataggtatacacatgccatggtggtttcctgcacccatcaacccgtcatctacattaggtagatgtaggacagcattatcttctaatgctatccctcccctagccctccaccccctgacaagtcccggtgtgtgatgttcccctccctgtgtccatgtgttctcattgtgcaactcccacttatgaatgagaacatgcagtgtttggttttctgttcccgtgttcgtttgctgagagtgatggtttccagcttcatccatgtccctgcaaaggacaggaactcatcctttttatggctgcatagtattccatggtgtatgtgtgccacattttctttatctactctatcactgatgggcatttgggttggttccaagtctttgctattgtgaacggtgctgcagtaaacatatgtgtgcatgtgtctttatagtagaatgattcgtaatcctttgggtatatacccagtaatggggttgctaggtcaaatggtatttctggttctagatccttgaggaatcaccacactgtcttccacagtggttgaactaatttacactcccaccaacagtgtaaaagcgttcctgtttcttcacatcctcgccagcatctgttgtttcctgactttttaatgatcgccattctaactgaatgagatggtatctcattgtggttttgatttgcatttccataatgaccagtgatgatgaggttttcttcatatgtgcgttgactgcataaatgtcttcttttgagaagtttctgtttatatcctttgcccactttttgatgggattgtttgctttttccttgtaaatttgtttaagttccttgtagattctggatattagccctttgtcagatggctagattgcaaaaattttctcccattctgtaggttgcctgttcactctgatgatagtttcttttgctgttcagaaactctttagtttaattagatcccatttgtcaattttggcttttgttgcaattgcttttggtgttttagtcatgtagtctttgcccatgcctatgtcctgaatggtattgcctaggttttcttctagggtttttatggttttgggtcttacgtttaactctttaatccatcttgacttaatttttgtataaggtgtaaggaaggggtccgctttcagttttctgcatatggctagccagttttcccaacatctattaaacagggatcttttccccatttcttgtttttgtcagatttaccaaaggtcagatggttgtagatgtgtggcattatttctgaggcctctgtcctgttcccttggtgtgtatacctgttttggcaccagtaccatgctgtttgggttactctagccttatagtatagtttgaagtcaggtattgtgatgccttcagctttattccttttgtttaggattgtcttggctgtacaggctcttttttggttccatatgaagtttaaagtacttttttgtaattctgtgaagaaagtcaatggtagcttgatggggataacattgaatctataaattacgttggacagtgtggccattttcacgatactgattcttcctatccatgagcatggaatgtttttccatttgtttgtgttctgtcttatttccttgagcagtagtttgtaattctccttgaagaggcccttcacatcccttgtaagttgtattcctaggtattttattctctttgtagcaattgtgaatgggagttcactcctaatttggctctccgtttgtctattattggtgtataggaatgcttgtgacttttgcacattggttttgtatcctgagactttgctgaagttacttatcagcttcaggagattttgggctgagactatggagttttctaaatatacaatcatgtcatctgcaaacagagacagtttgactttctctcttcctctatgaatacagtttatttctttctcttgcctgattgccctggccagaacttccaatactgtgttgaataggagtggtgagagagggcatccttgtcttgtgccagttttcaaagggaatgcttccagcttttgcccattcagtatgatattggctatggttttgtcataaatagctcttattattttgagatatgttccatctatacgtagtttactgagagtttttagtgtgaaggggtgttgaattttatcaaaggccttttctgcatctattgaaataatcatgtggtttttgtgactggttctgtttatgtgatggattacgtttattgatttgcgtatgttaaaccagccttgcatcccagggatgaagccgacttgattgtgttggataagctttttgatgtgctgctagattcggtttgccaggattttattgaggattttcgcatcaatgttcatcagggttattggcctaaaattctctcttttttcttgtgtctctctcaggctctggtatcatatcaggatgatgatggcctcaaaaaatgagttagggaggagactctctttttccattgatcggagtagtttcagaaggaatgataccatctcctctttgtgcctctggtagaattcggctgtcaacctgtctggtcctgggctttttttggttgttaggctattaattactgcctcaatttcagaacttgttattggtctggttcagagattcgacttcttcctggtttaagtcttgggagggtgtatgtgtccaggaatttatccatttcttctagatttttctagtttatttgcgtagagttgtttatagtattctctgatggtagtttgtatttctgtgggatcagtagtgatatcccctgtataattttttattgtgtctatttgattacccttttcttctttattagtctggctagtggtctatatattttgttagtcttttcaaaaaaccagctcctggagtcattgattttttgaagggtttttcatgtctctgtctccttcagttctactctgatcttagttatttcttgtcttctgctagcttttgaatttgctcttgcttctctagttcttttaattgtgatgttagggtgtcgatattagatctttcccgctttctcctgtggagattttagtgctatgaatttccactgaaacactgctttagctgtgtcccagaaattctggtacattgtatctttgttctcattggtttcaaagaactcatttatttctaccttaatttcattatttacccagtagtcactctggagcaggttgttcagtttccatgtagttgtaaggttttgagtgagtttcttaatcctgagttctaatttgatagcactgtggtctgagagtctgttcattatgatttctgttcttttgcatttgctggggagtattttacttccaattatgtggtcaattttagaataagtgtgatgtggtgctgagaagaatgtatattctgttgatttggggtggagcattctgtagatgtctattaggtccacttggtccacagctgagttgaagttccgaatatccttgttaattttctgtcttgtggatctgtctaatattgacaatggggtgttaaactctcccactattatgtgggagtctgaatctctttgtatgtttctaagaacttgctttatgaatctgggtgctcctgtgttgggtgcatatatatttaggaaagctagctcttcttgttgggttgatccctttaccattatgtgatgcccttctttgtcttttttgatctttgttggtttaaagtctgttttattggagacaaggattgcaacccctgcttttttttttgctttccattttcttggtaaatattcctccataccattattttgagcctgtgtgtgtctttgcacgtgaaggggtcttctgaatacagcacactgatgggtcttgaccttttatccagtttgcccatctgtgtcttttaattagggtatttagcctgtttacatttaaggttaatattgttttgtgtgtatttgatcctgtcattatggtgctagctggttattttgcctgttagttggtgcagtttcttcatagtgtcaatggtcttcacaatttagtatgtttttgcaatggctggtaccggtttttcctttccatatttagtgcttccttcaggagctcttgtaaggcaggcctggtggtgacaaaatctctcagcatttgcttgtctataaagggttttatttctccttcacttatgaagcttagcttggctggatatgaaatgctgggttgaaaattctttaagaatgttgaatattgacctccactgttttctggcttacaagccagcagggtttctacagagagatctgctgttagtctgatgggcttccctttgtgggtaacccaacctttctctctggctacctttaacattttttccttcatttcaaccttggtgaatctgacgattatgtgtcttggggttgcttttctcgaggagtaactttgtgttctctgtatttcctgaatttgaatgttggcctgccttgctaggttggggaattcctcctggataatatcctgaagggtgttttccaacttggttccattctccctgtcactttcaggtacaccaatcaaacatagatttggtcttttcatgtagtgtcatatttcttggagacattgtttgttccttttcattcttttttctctaatcttgtctccaagctttatttcattaagttgagcttcaatctccgatatcctttcttctgcttgattgatttggctattgatactgtgtgtgcttcatgaagttctcctgctgtgtttttcagctccatcaggtcatttatgttcctctctaaactggttattctagttagcaattcctctgaccttttatcaaggctcttagcttccttgcattgggttagaacatgctcctttagctcagaggagtttgttattacccaccatctgaagcctacttctgtcaattcatcaaactcattcaccttccagttttgttcccttgcttttgaggaactgtggacctttggaggagaagaggcagtctggcttttggaattttcagactttttgcactggtttttcctcatctttgtggatttatctacctttggcctttggtgttggtgaccttcagatggagtttttgtgtggacatccttattgtccttgttgatgctattcctttctgattgttagttttccttctaacaggcccctctgctgcaggtcttctggagcttgctggaggtccactccagaccccgtttgcctgggtatcaccagaggaggctgcagaacagcaaagattgctgcctgttccttcctctggaaggttcgtcccagaggggcacccgccagatgccagccagagctctcctgtatgagatgtctgttgacccgtgctgggaggtgtctcccagttaggaggcacgggggtcagggacccgcttgaggaggcagtctgtctcttatcagagctcgagcactgtgctgggagatctgctgctctattcagagctggcaggcatgaacgtttaagtctgctgaagctgtgctcacagccaccccttcccccaggtgctctgtcccagggagatgggagttttatctataagcccctgactggggctgttgcctttctttcagagatgccctgctcagagaggagtaatctagagaggcagtctggccacagtgactttgccatgttgtggtgggctctgcccagtttgaacttccaggtgggtttgtttacactgtgaggggtaaaccgcctactcaagtctcaataatggcagacgcctctgccctgactaagctccagcatcccaggttgacttcagactgctgtgctggcagcaaatattcaagccagtggaccttagcttgctgggctccatggcggtgggatccactgagtgagctagaccacctggctccctggcttcagccccctttccaggggagtgaacggttctgtctcactggtgttccaggtgcctctagggtatgagaaaaaactcctgcagctaggttggtgtctgcccaaacggccacccagttttgtgcttgaaacccagggacctggtggtataggcacccgagggaatctcctggtctgcgggttgcaaagaccatgggaaaagtgtagtatctgggctgggtggcaccatccctcacagcacagtccctcacaacttcccttggctacaggagggagttcctcaaccccttacgcttcctaggtgagatgatgccccaccctgcttctgctcaccctttgttggctacactcgctatctcaccagtcccaatgagatgagccaggtacctcggttggaaatgcagaaatcacccgccttctgcgttgatctcgctgggagctgcagactggatctgttcctattcggccatcttgccatccacctcctttgtaatatttttactcttttaaagtcactgctcaaaatatcaatcataccatattcaactataggtagaagaatgtatttttaggccaaataccattttaaaaatcagcttttgcttgggagtttaaatatagttttgacaatttatatcaatatgagctttaaaaaatgttctcaggagtagttttgtacacagaaagaaattattcagaggttactttcagttttaataatacttattaaccttaacaaattcataaacccggttctttcttagaattctaaattcaacatacaaatcaaattaagtcgcttaaatggagggactgaaacaattaaatttcctatagtacaagcactcctcactttgcagattaccatggtaataattcatgtttatagaaaccatgtttatcactttgcacagttcagtggttgctgagatctattaatgtggtaccctataaaacaagcagtgcctgtattttaaacggaatttatatatttaatatgttttatttttatgctcatattttggcatactttctcaaatttttaaatatctcttaatttttagaagttcatatattatggttactcttaagttatcttaagtattctaatagtgtaggcaaattttcctttacttttcagcttaaaaagtcaggtggatcacgaggtcagaagtttgagaccagcctggccaacatggtgaaaccccgtctctactaaagatacaaaaaattagccgggcatggtggtgcgcgcctgtaatcccagctacttgggaggctgaggcaggagaatcacttgaaccccaggcggggaggggagtggaggttgctgtgagttgaaatcacacctttgtactccagcctgggtgacagggtgagacttcgtctccaacaacaacaacaagaaaaatcccattccaattggatattcacgtttacatagatttataaaagcctagtctgttaagtattcttacaataccacattttttaaggcttaagtatttaaatatcaactatacagagtctttctaaacttaacatgaaaatattaatattataggttcacatcataatttctgttactttaaatttttctgggttaaaaaatcacttaactagtaaggcaaccatttttttttcctagtttctgaggttattacatgttgacttgagaggccctggcctgatcccaagactgattctttactaacacactgataggaacactgatacagacattctatcacatagaaaaatggttgatctcagagttcttcctgggttgaaatcatagccatataacttaatattatgaacttaactattattacttctttctacttccagaagtctgcactaacatgacggccagcataatttaccatgttagttgtatttccatttcttctgctttcttgagatatttcattatcttcctcctggttccaaagacaacattaatgactttccatttgtattagtcagtgttctccagagagacagacctgacaggatatatgtatatatgaaggggagttagtttattagggagaattggctcacacaatcacaaggcaaagtcctacaataggccgtctgcaagctggggaagaaagaagccagtagtggctcagtccgagtccaaaagcctcaaaaacagggaagccaacagtgcagccttcagtctgtggtcaaaggccagagagttccctggcaaaccactggtgtaaatccaagagtccaaaggctgaagaacctggagtctgatgtttcagggcaggaggaaccaaaggaagcaatcagtatgggagaaagatgaaagccagaagactcagcaagcaaggttatttaaccttcttttgcctgctttgttctagccacgctggcagccagttggatggtgcccacccacattgagggcaggttttcctctcccagtccactgactcaaatgtcaatctcctctggcaacaccctcaaagacacacccagaaacaatactttaccagctatctaggcgtccttcactcaagttaacagctaatattaaccatcaccgtgttgaatacttttgttaatttattttgttctccttaaattttatcatttgatttaggtggatgaaatactttaaagaatggtgtgaaaagcctgtgtttgtagttagttctttttctatttcttcacttaaaaggaagttttgaatgagattttaactgttaacagtagatttatgtgggtgctgtaagtatggacagttcaaatttttgctttatacttttctgtattttccatattttctaaatgatcacttcttactacattagaaataatatattatttgttgttgatgtgggttctggaattagatttttgagatttgaatcaggactctaccattaagtgttagtggttaaccttttgctttagattactcttctgcaaatggttgatgataaaagtagttgccttatgggattactgcaaaggctcaaataaaataatatacttaaagcagtcggaacagtggtaatgccacaatactgtgtagagttgactcttgaacaacacaggtttgaactgtgtgggtcaacttatacacagattttttaagataaagattacactgagtgtacctgcctctcgtgcctcccattccacctcctccacttcttccacctctgccacccctgagacagcaaaaccaacccctcatcttccttagtctactcaatgtgaagacgaagataaagatatttatgatgaaccatttccactaaatgaagagtaaatatatgttctcttccttatgattttcttaataacatttcttctctagctcgttttattgtaagattgcagtatagaatacatataacaaaaaatgtgtactagtcgactgtttatgttatcggtaaggcttctggtcaacagcaggccattgtagttaggtttttagtgagtcaaaagttgtacgcagattttcaactgtgtggagagtcagcatcccaaccccactgttgttcaaagatcacctgtaccaagtaaatgctagctgttattataattaactttctataaatcacagagaaggaatcattaatgtaaactctttcagaattattatgacatgatatagaaggtagatggtcctttcttcagctcttaatttctctatattgacgttgagttcattatgtgttaagtgcatggtacatagtaaatgcacaataaatgactgtttttgctaacattgtcatcactggcatgtgagtgtccaagtgaggtttaatagaaatccagtccagaatgcagtcatatattgagtcaagtgctatttacatatcttaaacaccatactttaaagattcttaatagtacatgcagtgggtacctattggagagtgtacctaggctacattcataattgttcttcaaaggtaaatgatgtgattttacgttcagtttgtcttccctagctctgctggtacattcaatatttgtaatggtattttttagttattggtttgagttaaaccaagatatttctctctagaacatcttgctggtgataaaaaaataattttttggcttcagcatattagtatccttaaatttatgcctcctatttttgcactaaagacttttcgtatcttataacatgtcagtgtaacccttttttttttcatttattattgtagattcaaaacagcaggatctgtttctcctgaattttaacagaaatttctaaacccagaaaccaatttttttttttacttagaaactcaaaaaggggtctgccaaataagtggtattgtttaagggtaatttgtggtatttttattttatcttgtgtacatttttatttctccgtgtgtttggtattataatactagctaatgtatattgagtgttttcttttgtgagacattgttgtaagccctttatatttattcatttaatcactaaaacaactctatgatatagttaccattattatgcccagataagaaactgaggcttagtgttaaataacttgccctggatctcagagttagaggcaaggctagaatttaagtatacacatgctaaagtttgtgctcttgagtactaactacaaagctgtcatataatagatacctgttactctttgtggcctggatgtataggttactctttgtggcttggatgtaaagataaagaaaacacaagcatgttttataactagaatagcatgggaaaggaggactctttatatttggaggaggcatttttcgaaatctatttactttttatatttattttttgaatactaggtaattaaaatgcaggacaatttaaaatattattctttttgtaaattggaagtaatttttctcccaccagcttttgaattccttgaggacagagtttaggtctttggttttatatccctggcacctgagtagctactcagtagtagttagatacctgttatattgaaattggctttaaactttatatcattttaaagttgaagcacaagagggtgctgtttactatgatacttctaggtcttagctccttttatctttctacttgtgaaataataatgcaacagcaatttttttattgttgttatggttagaaccatcgagactctaatttttcccccttaatttcttcacttcagattgtcagttatttgttttttgttggccttgtgcatgtaacagatcatcagtgtgtgatggaccttagggctctagatttctgatgatattaaataatttttgctaaatcaaaagaaaattagaaagtcttttgaagaaggtttgttgattttttaaaactgaacagagtatctgagtgctttaaattttaagaatttttttcataaattaataacatgcagttataatgacattttgttgcagggtactttttttatagtattcacatttttttacatgtgatattgttctggattaaatgtggacagcatttttttcttcctaagttaacaaattacagtgtcttggtagttgtggcatgtagttatcttccttttatatcagtatttatcagcagaattataattttctatttctattttaattttataattatcatgtattttgaacagccagataaataattctggctgccatttattaaatgggtcttcggaactgtgctgggcactctatctaaattgtttaactcaatttttatgataatccagaaaagtaagtagttttatctctatcttatagttctgagatttaaaggagttaaatgatacttgaggccacagagcagggatttgaaggcatgtatgtcttcctggtttcaaagcatgtatcctcaacacagtactgtgctgcctctataggcaacccatgttttttaccactccatactttaccagaggcacacttaatgctatcacgaacttttttttcttttttgcccaatataatctgcacatttagtaggttctgctgatcttttataaatacatgtaagtgaaggggaactatttagacagcatttttaccaagatggtcttctcatggttaaaaaagtatgactgcaacatataggtaatcaatggaactagaaaaattaagaaagaaaaaataaaggcatactggaaattgtattctgattagtaaatctaataatgatttaaaatcaagtaagaccactccacgtcatacacagaaatcaatttcagataaatttggtccaaacatgaagagtaaaataataaagcttttgttttcttctgagtgaatctctttcctgaccttgctgtaagccaagattccttaaagtggacataaaacaatgttaactacaaagaagaaaactgaaaaattggattttattggaatggaaaaattctgttcttccaagggcactgttaggagaatgaaaaggcaagccacagaactggcaaaggtatttgtaatacatatgacaaaagactgtagctagactatataaagaattcctatacatcaataagaaaatacagacccttgtaatcccagctactcaggtgtctgaggtggaaggattgcttgagcccaggagtttgagaccagcctgggcaacatagtgaaaccatgtctttaaaaaaaaatgataaaaagaccaatagaaaatgagcagaaatcttgaacaggcattatgaaaatagatatctaaatgggtaatacaaatgaaaaggtacgcagtcttatatcagagaagtacaaattaataccatcatataccaccacacacccttgagtatggttaaagttaaaagatggataacataaggtggtgaaaaggctatggaactacagaaactctcatatactgctatttaaagtctaagtgcgtataatcgttttgaaagtctatttgacactgtatactaaagcttaacctacacgactctttgacctagcagttctactccaagtatacaatcagtagatatgtgtatacgtatatatatgttcactaaaagatgtgtaagaaatgttcttaacagtactaattgtaatggcaccatactggaaacaacacaaatttatgtcaccagtagaatggacacactgtgatattctaattcagtggcatactgtacaactaagaatgattagctgttgtattatgtaataacctgaataaatctcacaaaaaataacaatgaataaaagaagccactcacaaaagagcatgtatcctataatctcattttaatatggttcagacatagataaaatgtattcatagtgttaggaagttgggtattggttacctttgatggttgataagtgactgatggactctgagaaggcttctataatgctggtaatgttaaaacatgatttgagtgttgattatacagaaaaatttatgttatatgttatgatttttgtacttttctatgtgtatgttacacttaagtaaatacttaggtgggggtggaacttaagtggctttattttccataacttttaactatgattttctaaataagtattcaaatgatttctaagttaaagactattttaaaagtaaatattttcttctttctcaatggaaatgtcaccagtaacttgagttgtttccggagctctggtatcatcccaggctgtctagtttctttaagcagatgtgcccattaataggggtctaggaaaagacctttcccagctgtttcatcagggctgccctggtaacagtgaaaattttcctctcttcactcctattattactctctccaaaaagttaatatttgttaattgcttactctgtgttcaagcagcattaccccattcagtcctcataacaggagtctgttgtatcaaagaggaaaaatgtatctgaattagttagaaatagaatgagtaaagtcatttcaggcaccatgtcaccagggccttgaggagaaatagataaagttgggagtttgggtggatactaaatgatactaattttttacctaccaaaaaattaaactaaaatctcacttgtggctgacctgttgtaaagggaacatacaagattttttttgcctctacttccacagtcactcagtacaatacatctgacaccagatatttgggagtttgtcccccacacaccaagcagttctcctgctgggtgtcctgtaattcagtgctgacagtatctacgtggggatagtatcagatcccatgacacagtcccacaaggctgcccccacttcagatgccagttgcaagtagtaggttgtgacctgtacttttgattgagtgatggtaaattgggattcttgtgacccccctcctcagtttgattaatttctcagagcactttacagaactcaggggaacacatttacccacttattataaagaatattacaaaggatacagatgggtgggaccctcatggagaacctctactagggcagtgtggaagggaaatgtggggtcagagcccccacacagagtccgtactggggcactgcctcgtggagttatgagaagagggccatgatcctccagaccccagaatgatagatccactgacagcttgcactgtattcctggaaaagccacagacgctcaacaccagcctgtgaaagcagccaggagggaggctgtaccctgcaaagccacagggttggagctgcccaaggccgtgggagcccacctcttgcatcagagtgacctggatgtgagacatggagtcaaaggagatcattttggagctttaagatttgactcccccactggatttcagactttcatgcaccctaataatttaaccaaaaaatgggcaaaagatttgaatagacatttctcaaaagaagacatacaaatgccaaacaggcatatgaaaaggtgttcaacatcattgatcatcagggaaatgtaaatcaaaactgcagtgagatatcatctcattccagttaaaatggcttatttgcaaagtcaggcaataataaatgctggcaaggatgtggagaaaagggaacccttgtacacttggtgagaacataaattagcacagccaccatggggagcggtttggaggttcctcaaaaaactaaaaatagagctaccataggatccagctcactgctgggtatatattcaaaagaaaagaaatcagtgtgtcaaagagatatctgcactcccatatttgttgcagcactgtttagaatatccaagatttggaagcaacctaagtgttcatcagcagacgaataatggataaagaaaatgtggtacatatacacaatggagtacgagcaaaaagaatgatattgtcatttgcagcaacatggatggatagaactggagatctttatgttaagtgaaagaagccagacacagaaagacaaacatcatatgttctccttacttttaggatctaaaagtcaaaacagttgaactcatggacatagagagtagaaggatagttgctagagacttggaagggtagtggagggttggagaaaggtgaagatggttgtggagatggttaatggataaaaaaaatagaatgaataagacctactatttgatagctcaatagggtgattatagtcaataatcattgaattgcacattcaaaaataagtaaaaatgtataattggattgtttgtaacacaaaggataaatgcttgaggggatggataccccattttccttgaagtgattatcatgcattgcatgcctgtatcaaaacatctcatgtaccccacagatatatatacctattgtatacccacagaaattaaaataaattatagctagacaaaattaactgtatatattaactataataattttgttgtcacctccttgtggtgaggtcaagtgttttgagtatctgcttaaattgctatgtcctgctaataatttccccataagcaaaaagtaatcccttctggttcttgtgtatttttcatcatgtttactcaatatcgtaatccttgaataacaccacagtaactcccataccaagtgccactagcgatggtggaagtgcccccaagaagcagagagtgtcatgacattaccagcaaaagttgaatcacttgatatgtaccttagattgaaatctgcagctgtggttgctttccatttcaagataagtggatgtagcatatagaccattgtacaacaagaaaaggaaatttttaggaaatttcatgaagtcgtaccccagcaggcatgaaaacgttatttcacattttttgcgaaatatgaaatatgtgttaatcaactatgtcattggtaaggtttccatcgatagtaaactattagtagatttggggaagtcaaagttaggcatggattttcaactgcctggaaggctggagtccctaaccctacgttgttcaaggatgaactgtagttacatgtccacttagccatctaacattgatgccaggaagaaaccttagattgtggatttgtagaaacgtgccctacataggagcaactatagcaagaagcctcttgtttacattttacccctttccccataggatcacctgtgaatagtgggatgactattcatttcaataaactagggatagtcctggtttatagctgttgttccaggctgttattacattataataatgttgcatactattatataatttattattaatagctgttcctttttacttttaatactaccccatttaggataataaattacatggtccctttatcttaagttaccactgaaaagggtggtgagaatagaaatgggaatagaatagtcagtgacaactatgcaagttggaatttaagagattgatttttgaaggtttgcatcagagatcatcaggatcatctcaatgatttactgggatgcactggactcagaagttgctatatgcatgctatggtttattatagtgaaaggatacagagtaaaatcagcaaaggcacatgggatgaagtctggaagactccagttgcaagctgtcaggtgttcctttctactggagttacacaggacatgcttaatttcccccaaaatatgtcataatgtgtacagagtattcccaaccagggatgtttaccctgggggtcagtcacataggtatgtcatgcctgcatgactgaccttggctacttaagcttcagatcctcggagaaaaagcaggcattcactataaatcacattattaacatgaagtacctgctcaaattggtacagcatggcccaagacctccagcatacaaaaacactctaatcagacaactttctgaaaggttggagcttagttctcaggagctggccaagggctagtcctgaaaacagtccatttatgggaatgtgcagagtttgagcaacgcaagcctgctgaggtgactcttcccacgaggtcatacaagttattcagtttagagtttggacccaggtaagtctgattccaaagtctgtgctttttcgctaagtagtttttagtggtcttttatactgatttgataattaaaaattactggctgcattagatatagtagggacttggactgtgccttacctctcttgatggatatttcctaatgagctttcttccccctcacattaaaataaggaggcttagttgagtatttttaagtgcttttgtaagaaatggtgctaagactttctagttttagtccttttcaaaaaaagtttgttttctatacttatgtattgaaaagtaatttatctgtagttaaacttggtaggactctattctttttttactttttttgcattaatacaatttttagtttgaaaaagataaatgtataatacaaaattttagttcataattaagaattgccttccttatagataatagttttgaataaatttaaacagttcttaaaaccttttttctttttccataggtatttgtggaaacattagacaaatgttttgaaaatgtctgtgagctggatttgattttccatgtagacaaggtactatttgtattgtcacatctaagctttttaagaaaaacattaacttataattgtcatagcaaaaatggctttaatgaataattctatttttattcttttattattcaattcataattttttttttactatgagccaggctttgtgcttggtggagaagattcagatcctgccttagaggagttcacatcgaagggtggaaacaacggcattaacaaataataataatagtatgtgtagcatgttaatggggacacagctgaaccacttacctctgcctaggagactgtgaatggaggaaactacatttaaactggatttttaagggattagtagatatatcatacatagaaaaggagaggatggtcctactgacagagatataaaatataggcctttttgtgaggagggactgatactgatcaacaggcctagtttaaaacaaccattaatgccatgactttgaactttattgtgaggcaatttaatgtttttaaacaagtttttactgacgttattattgctttgtttgtatatttttttgatagagtgattttttcttgtattatggagattggattgataggctgggaaattaaacacatggaaatcaattaagagtttattgcagtagtccagaaggaaatgactaagacactacgatgaggtttgaaagaaggaaaaacgctaagattaggtttggaagaaggtagaattgatgggatttgatggcttattgaaagctgaaggtgagagaaagaatgacagatttctgccagtattagtagatatttgtgatacggaacttaggaggaagagattccactttcactatgtgcagatttttttctgtattaggtttgtataatctaagagattctttatgagtgattcaactactgagtaagagtctgaaaattttagcaaaaaaaatccagtgtgatttttaaaaattggctttattgaggcataatttacaggtgttaaaagtcaacagttttaagcttacaaaactaagtttcgactagtgtgtatagtacatgtaaccagcatcacaatcaaagtagtacaaagaatgcatttcattatttgtgaatgtcaaaaaaatacttttctctttggccagtattctagatcatatctctcatttaccaagtgatttgattttataaattaattcattttggacagtgtacttaagcatgatatttttatgagtctgtttttaatgttctactgtttttctctaattgctatgtctaatgctttttcacacttacaaagactcttgttatttttagtcattagggttcacaatattcaaaattatgtttgaagaccaggtgcaggtgctcatgtctgtaatcccagcagtttgggaggctgaggccggaggattgcttgagcccaggagtttgaggccatcctgggcaacatggcaaaacctggtctctacaaaaaatacaaaaattagccaggtgtggtgttatgcatctgtagtcctagctggttgggaggctgaggaaagaggatcacctgtgcctggggaggttgaggctgtagtgagccatgattgtgccactgaacttcagcctgggtgacagagtgagaccctgtatcaaaaaagaaaaaaatttatgttttggtacatgattaaaatttttagaaagctgtgttttaaaatgactgctgagaggtcatcattagcttatgtaaatacatttaccatcttttaagaaaattgaggactctcttgtgaaatgtgatggtaagagtaaggttcttatattttttttactagagaaagagaataaaagtttttaaggaaattaagctgtactcatctgcaacttccatacatgacacaaaatgtttttaaaacttctatttctcattagtatgcattcattttagaaaaatcagaaaatacagagagaaaaatatgtgaaaatcatccctatcccagagattgcctagtgttaacattttagaatatgtatagtacttgattttacatctttaaaacaaataatctttaaacaaatacatctttaaaacaataaagatgggatcatacaatatgtattttgtgttagcctgttcattttacacaacactatatcactattttagaacctgccaaaattagctgtctctcttttctctgggctaagatcttgttttattttttcaaggcaaggagacaaaagttttaggataccaaaagacagagatcaaataagtgtttcctttctattcaccaagacaatgctaactttgctttcagccctttgatgaaaattattttcaacttaaaaatatagatatatttttttaaatttcaacttttaagcagctctggaccttccagcagtagggatcttctgactggctcagctcacattttcttttttttttctgagatggagtctcgctctgtcacccaggctggagtgtagtggcgatctcggcttaatgcaagctccacctcccaggttcactccattctcctgcctcagcctcccgagtagctgggactacaggcacccgccaccacgcctggctaatttttttgtatttttttagtagagatggtatttcacggtgttagccaggatggtctcgatctcctgacctcgtgatctgcctgcctcggcctcccaaagtgctgggattgcaggtgtgagccaccacgcccggccacagctcacattttcttaaaggcaagacatagggaggtttgcacacaaccctcagactgcttctgggtcacaactgagtagatgaaaagagaaagttgtagagaatatcccttttgttatcagtcaggatgagctaatttatgctgcagtagcgaacatggaaatgttagccacttaaaacaaaaaagggttatttcccattcacgcagtatgtttatcatattccacatgctgtcattttgggatccatggtaacaaagctgccactatccagaacattgttagtttctatgtcagagagaaaaaaagttttcattgggtaaatttatctgcttttcagggtatcacagatgataattgtaccaagtattttgccactacaaacatggatcagtaactttccagcctccaatgtaacagtttctatgtggccagctgcccaacctgtaaaccactgtcacacattttcttttattgtggttgttactagtttctttttataaatctttacatgctaataactgtatcaatcacataggctagtgtagtcaccctgaagtagtgggacagacccacccctactcacaattggtttggatgtagagactaacaatgtcacaggtgccccaagaggataggaaaagatttattactcacataatgaggctttctggagaaaacagagaacaacacggggcttgggttttatggtggtttggtggtggggatggggtgtgaggatttctgcatgtgggccaggtcttaggtagtctgaactttccactagtgtaaaggaaggagcatccagaccttcttaacagcttgcccagatatggggcagaagaggaatggggactagtagaacttgaaggctgtgagcagacacacatcaaaaatggagtcagaccctttatcacatacagctaaggtatgctgtggttattacccctaaaatcctaaaatatgaatcattcagtttgtttcttacttacactatatgtttattgtggatttgctgggggagctgctgagttatctgcccatttcctgtatagtgtggctccaattgggtggccccgtgttgttgcccatattggaagaaagcatcaaaatccagggcaaaatgagagagctaaagattctgtgcagggcttggtttggaggatgtatgactttgagaatgacagctgttaatatactctattctcctctctgcattcccccacttgcctccacaagtgattagggtagagatctgatcggaggcctgtgtctttcatacccttgaggctgagagaataaagacttaagagcagagtgctttcttccaacctggtccctcttgaggatttggacagcctggtctttaaccacaggcacagaacgagagactccttttactttcaccaaataaaggagctactagccattaataacatcttggaagccagccctgagcacagtaagccaatagaaagaaagcactgccatctgaacaagagagattaacagattgaacaatcagaaattacgctccatggaaaagaactactggagaagatagagtaacacttgaaattttataattttaaaatttatttattttggtatggctggggtcttgctgtgttgcccaggctggtcttgaactcctgacctcaagtgatcctcctgccttggcctcccaaagcattgagattacaggtgtgagccaccacctggcctcacttgaaattttaaaatgattttaaaagtacttaagatttggaaaagtcttcttgggcttgaaaagagtttttcagactgaaaacttttaaagaaggtgatcacaattgaggcttgaattaaaggtagaagatcaagtgtaggaaataatcccaaagcataagactgaaagatagaaaacatgaagaagaagaaaagagactttgaaggatacatttaacatctattatacaagtacttggaggatcttatccaattgagagaaagaagaatgaggaataattaaagtattttagtaggaaaacaaggtctctcagtggtctagaaaacttgatatttgttttataaataataataaagtcatttaagagggagagatatatattaatgggaagtataagcacagtagagtttcatatttaaaaggaagagaatagtgtaataaaattagatcaaacttaaaatattgggagaaaagagaaagtataattaaaggtagaaataatattcaatacactaaaagtgcacagaatgaaataatttactgaagacaaagatgggcttaaataaaaggcacagtttatataggaaaggccagataaattctagagtatttttctttatagttaccaattttcataactggttgcttttctaatatccaccaaaaaagatcatttaagttttttagtatcctatggcataaaatttttaatatatttgatttgttttaatcagttgcagacattattttctattatgttcaagttgcccatctttggccagtgggaaccccttcagattatctttgctagttcatttgacctgacctaccccgtcataggctttggtagctgtcttgtgttgtggtccagctagatgttctaaactcattttattcatttcctgttccagacatgttgtcaaccattcttttctaggagccctgattcctttttgttggcgatggtatatagtaactacagtctagaggtgctcatgattatgaagttgctcattgttttatggccttttcaatgaacagagcatcttacgtattttctgctccagccctcaagtcagccatttctccaaggaaccctggcttccttcagtagagaatgatgtttagaaatgacgatttgggcactgtgtttgctcattgttactggggtgacatgactcctggttcttagtgaactgagctgggaaatagatgtatgtatacacgcacagctgtttctggatcttgatatgatattaaaaatcattgaccacttcttaatacctcagaatctagtacaatactacagaatttcttctggctttctcgttttccatatttgcagcttgcttctctgacagagatcagtgagagatctcattataaaaatatgtgtctaataattaatgttgattcactgttttaaatttttatatttttgtttgtttgctcttaccaacacagtttcatttatcactgtcatatgtatatcaggcaccagtctcttttatggttttcctaacttaatttctcattctttccttcctctaactttcaattctttattttcttgcagaactgcgaaaattaatgtatataatatgttctcatttgtgtaaattagatatgcatatacacacgtataacaagtatgtgcacagcaagttttctaggatacctaagatatagctagctgagtagctttggataaagggacctaaaaacggatgcagagtgtggtagagactattgttgttcatacataagtttctgtatgaacttttagtcatttgcctatattctttttttttttttttttttttaagttacggtagttttcaaaacactgtcatgtctggtttggtttggttggctaggaagattaatttatataaatttgtcttcagaatttgtgcatgaggtgtccatgcttccaaaatgaaaaatagtaaataatgatgactttttttttttttttaattgaggcagggtctcactctgttgcccatgctagagtgcagtagtgtgatttcagctcactgcaccctccacttcccgggctcaggcagtcctcctgggtcagcctcccgagtagctggaagtacagacgtgaggcactatgcctggctaattgtctgcattttttgtaaaggcagggttttgccatattgccagtgatctgtccacctcgtcctcccaaagtgttgggattacaggtgtgagccaccatacccagcctccagggatattttttaaattatgaataaatttgcgtgaaatcttacaaagaaatttaaattgagtaatacatatttaactcctaaaaagagtttgttgaaaaaaaaattaccgtataatacctagtggttctatgctaagcacttacataaattatttatttaattgttatggtaatcctatgaggtgcctatattatttctgtctctatttcgtaaataaggtaacagactcagagagctgaagtaactgctcaagggctacaagtaataagtggtagagtctgtattcatacttatctaattttggagtctccatttctaaccttaccacattattttaaaaaaattatagcagaatagattcttctgtgaaatgtaattcagttctgaattgttgattttttgatccaataataccttatgaaaagacagaagttatatttttactccccaatggaagacatcatttttagtcattgtaagatgtatttattagaagaaatctgaatattacatgtgtagaggatttgggggtaaaaacactattaaagtacccacaatttaaaaaattctacctttttccaatctagagcctgttagaagtactgtactacattgcttcattaagtaccatgagtgtaaaataataacctaattattgttggctaagaatctggcataaaaggctcttataaatcatattttagtattaaacttcacataataataataataatggtagttaatatttactagtcatttactttgttttgagtactgcattggattaccttgcttattcctttcaacagtcctatgaaggtagtactattgtttttgttttatagcccattaagctcagacttaaggaggttatataactgcctagggcttcacagtagtgatgaaagtggattatgagcccttactccaagttgtttttaccactcatacttttaacatagacaaagtggtatttgaaacaaaaagtgaatcatgaaacttctttttagtgaattttctttatgggtatatattcttttattccctttaggttcacaatattcttgcagaaatggtgatggggggaatggtattggagacaaatatgaatgagattgttacacaaattgatgcacaaaataagctggaaaaatctgaggtaagaatggaaaatgctgtagttaagaaggttctaagcatgatgacagattacgcatgatttgtagttttcactgtttgtccttcagtatcaccctttaggttcagccgttatgcttattcagtttttaaaaaatggaatatacacgtagtatgctaaaggttctgtgactgttctctacccaacagctttgtgtattcttcttttagccacagtcatagctgccttgggtaataagcacaattccaaatcttattgcctaaaagaattatctgaataatggaatctaatatttgctttgtaaaacttcagtcggtaattatcaaggaaatcttagaactaatattttaaagatatataaattttgtgttacaaaactacttctggaaagggaaaggacaggaaatggaattcttacagggaagtaagtaatgtttcaagttattaataaatgcaaaataaatattttgaatgtttgagttcacattcaaaaaagaaattcaataccttaatcttttaattctaaatctttccctaagatttcactgacaagttagttaagtcacatattttagacattagtacatatatatccatggtctttattgcattctataagatcggtttgttatacttagctaactttctgctgttagattcaaccttagatgggataaatgaggaacagccagcactttagcattgtataaaaccctacttcagaattgtagtgactcttccctcaagcactagtctgaatatcagtagcaggtgctgtagctgagccacctgggttcacattattttggttgtttattaccctagcagaggtttagaaagatcagtagttttatcatttgagttcaggagttcgagactagcctggccaacatggtgaaaccccatctctactaaaaaaataaaaataaaaaataaataaattagctgggcacgtagagcgcacctgtaatcccagctactcgggaggctgaggcacaagaatcacttgaaccccggaggtggaggttgcagtgagccgagatcacatcactgcactcctgggcaacagagtaaaacttcatctcaaaaaaaaaaagaaagatcaataattttgatatctcattcaccacccaacttgtttgaggatactcttacatttggtatttgcagtcataactcagattggaaaaaacagactttatttttataattattagtgttaagctcagatgtttcgttgatttaaagtaaatattactttgaaagcatcaaggttttaaaaatacactggcattaatttacaacaggtgagttctgaaaaattttaccttgttggcattttaaaggatcagtttaactcaattcaattctgtgtccattttaattgaagaaaacacagggtgaagaataaatctcaaatctagaaacagttgaagcttataaaacattttccagtgttctcttttaaatttaaaatagtcttgcatttttctttatctcaatttcccattcctgttggtttcccaaaggagaagtttatagtggtgatttagagctaagattatcttaactaactatatgttttgtttgtcctatagccaatttttaaaatattggcttttgaaagtggaaaacataaattaggttaatagagaaaattttgttttaggacaaggaaaaagactcataatttaatttagtataactgacttgcaatatattatttagtaaagaaaagattattataaaccctgagctattgcttttaaagtcttaaaagaacttaaaatgtgtgtcatttgttaaacattgctttgcaaaactgtatggttatagattttaaatgccaagggacaaacagtgatgcaatcctttaataactggtataaatgaatgagtatctagtaatttgtgaattctgcataatcatctgtaaaaaatattgaccagttgtctggaattttcacctttctaggtagttaactccttttcattggtggtggtccttctttttcttctgctacttaagacatttatgcctggtgttccattattggaatgctaagcttgtgggagttatttatatcctactgctcaaggtcatccccaaggtctgatttttcacaaaaaaaagtttgcaacctccggcataaatgggttaatgtgctatattgacaaaagttatgaaggacctataattattgcataatgggtatttgctttttgattgttgaataaaacttcgttaatgaggcaatttttcttatctataaagagcagtaaaatgcgtaatttacatttcaatggaaatagttataagaatactataacttaaaatctattcacagaaataatgctatttaaaatagtttagaatactggtgattacttctattattcattccctgatcatctcgcatcatacataattgttatctggtaccaaattagtttctcttcttttgtcttttacaagaaagtatgttttaagtctgattggggataaactacaaaattatatattttctatacatgtaacgtctgctaatattttagttatgaaatcggatttcaagtcaaagtgaggccatttagccctgatcatctttttaaaacagcactgaaaattatgatgactaatttttcgtagcttttgtatattttaagtatgtttgaaaggcttctagctttattccagctagaatgtcaaaagctttcatatgtttcatgtccatgttacttcaattggttaaatttaccagagatattactctgcagaataatccaaaattacttgaaacaaagtataaacttttcctaatcttcttactaaatttcagttaaaatgtattatataaggacaaacttaatgacttgtttggctgggcgcagtggctcacgcctgtaatcccagcactttgggatcactcaggtgatctgctcacctgaggtcaggagtttgagaccagcctggcaaatatggtgaaatcccgtctctactaaaaatacaaaaaaattatccaggcatggtggcacttgcctgtaatcctagttgctctggagcctgacgcgcaagaatcgcccgattccgggaggcggaggttgcagtgagctgatattgcaccactgcactccagcctgcgtgacagagtaagactccgtctcaaaaacaaacacacaaaaaaagacttgtttaaaatcgagaatgtcatgattgatgaaaagaactggttatcaatatttttaaaaattatttaagtaatatcttaggaacatcatttatatttaaaaatcagtctgggtataattgagacacagctttttaaacataacatgcatttatctaggggcctttgtcagaaatcagagcttttattatgttggtctaaagttagtacatttctggtaatggaaaaaagtgaaccagtttaattcccaatacctagacaggtggaagcaaagctctgccagatcctgaaagagagaagcaaagatatactctgaatgtatttccatctattctattttgatagaaaaatggtttactataacattggaatattgggagaggagggtttaagctgggaggttgatgggattcgggggaagtataagaggcactcaggaacctgcctaagaataaaaggactccctgggggtggaggtagaggggtggggttggggagatctgttagcttttatgtatttcatgttattcttaagatggataaatgggtctgaatttagtcactactttttgaaagtcagtcctcttttttttccgaacatcctgatctttctagctctttccattcttctctcttacagacctttatctttcagtctcccagacaggacaggtagacaaggtattgctgactttgagaaatatgtactataacaaagggaaagcaaaatgatgtcaaaggcaattaattatttaggccagactcaaaaattctttgtgttaataaacccatatagtccctgtagcctattttccattctagtttctccttgtagtttcttcatcttttattggacttagtgtattttactagtatatcattgatgtcatgtttgttctgttttgtctgcctgcattgtaaaaggaaagtttaaattttttttaaacacttgtcatctaactgacaaattgcatttgcagaagtgacaatttactttgtatataaaaacgtaaaatttattttgagcatcatatagcagaaccaatcttaatttaactctcacagatttgttttttttccatctctaaattaggattctaacataaaattgcctgctgggttttggaagctgtgaatttaaaaaccaaaagctgaaccttcagagttttgcatacaaaatgggaagcagtgaaggcttagaatagtgactgttaaatagtactttttcccctcaaatggttttcagttccaaagtcttaacagaattgcttttacagttttgacctgcaggtgcatattaacagtggccaacagaaaataagatcagaaatcttataaaacttgactgtatttcaaactagaatgctcgaaaaatggaattaccaaattaccaaatcaccaaaatacaatgggttttcattgtagcaaaccttctgacatccaaacatgtcataatcagaatcaataaaaatatattaatgttttagtattgaattaaaaaccctgaatatttttgcaaagcgtattggcaaatattggaaatatttttaatagacctctagttttacaaaactaatttttcttctgatatttcctgtacgttttttcacaccataaattaactgtgtgaattacttttttaaaagttccatgtacgtggtgatgagcaactattttgtgtgaaaccatgtaagcaaaagaaatgtttataaggtctctgattgaaaatttcaaaataaaagtaatttattgagtcctatggaggaaaaaatgtataaacttacgaagttagattatgcacttactaattagaaaaacatcactgagaattgatgattgtggtgatatcacaaagcattgccttttagccactaaatttttacttactctctcgatgtgtttgagaagaagtagcaacatacaggtggctttatagtatcttattttgagattgtgggctatgtcacaaaactggggtaccgtttttggtccctctatccatgttattttgtccctcatatagagaatacatagtagtctcattctcaccattggtcagaattattgccagtttctgtgttacagtatgtaatttattactgctattttccagcaaagaaccattaatcacttgggtctgttaactttattgctagaactgttaattggccttttttaaaaaaaatcaagtttctgttttcaaagaggagagaataagaaaagtggctctaaggtactgatggtggaaggtcagctcatgagctggttctgcctctctaccttgacatacacatttgtcttgtacttctacaaaattatggtgagaacccttgaggtcacttgtaatggtcaaaactagtaatgataaatccatgaaagtcattagtctgctctctttttttcatgcaggcaaatcctatgtttgaaattaaagctataattgaagataatccgtacaaaatgactaataatttggaaggttttttaaatttttgagcactctaattttgttaaaactgtgaaacaccatagttattgctgtctagagaattgtcatgagcttatctaaatgtttataattgcagtattaaagcactgccattaaaacaaagcctattatatatccccagattaaaagttattctacctcgtgttgagggattttttaaactattgacattttcttttttgctcaaaaacatgctttcaaaatctgccattattttgttaatgattttgagtctgaaaccatttaatattgtgtttattaatgttggtgttctttcactttgctgttaggtcaaaattatgaatgtgcatatagcaacttccagcaggaagggtgggtaaaggttttaatacgtacagtttgttccaactaccatcttattatgctgtattcaaacttgaaaaaaaaaaagatattttaagatggtaggatggtattttatgtcttagatgaaataaataacaagattactctattactttccttttcccttcaagaaagttgattgtttattgcatgaggaaaagggagctttcagggtcttcgaaatacattttagtaatgctgctttttcagttttgcttgcacatattttgtttatttttgggtctggcaatttaaaaacaaaatcaaaaacaaatcatatccatccattactatctttgtgattcaagtgcttgaaatttccaagagtatgtctgtataagtctttatctgtttggcctcattttggtatacttgcagacttcattttgttttctttctcttaattctgttaatttatttaatctcatgggagagaaaacatgatcattcttttatatactgtacttcattctttcatccagttcatattcttaactgctttggattcatatatttgtttttattggtgtagtcgctgcagttttacctgccatggtggtgctcaggtataacatagatggaaacaagttatttctccagtagaatttcattctttttatttctgctgtgtgtcaactatataatcttaaatctttaagaactatgttgtactgtcagaaatatcttacttttacgtttaaaaatgtatttacagtaatccccccttacctgtgttgggtacattccaaaacccccagtggatgcctgaaactgtgtatactactgaaccttatatatgctatgttttttcctatgcatatatacatatgataaaatttaatttataaaataggcacggtaagagattaacaactaataataaaagagaacagttataacagtataatgcaataaaagtcatgtgaggccaggtgcactggctcacgcctataataccaacactttgaggggccaaggcagaagactcacttgaggccaggagtttgagccagtctgggcaacacagtgagaccccatctctacaaatgtatattttttacattagctaggcgtggtgggacacacctgtagttctaactattcaggagacagatgggaagatcacttgagcccaggagttcaaggctgcagtgagccatgattgcatcactcactccactgtgggtgacagagtgagaccctgtctcttaaaaaaaaaaaaaaaaaaaaaagttatgtgattgaggcctttctctatcacaatattgtactgcacacacttattttcagaccacagttaaccacgggtaaatgaaaccatggaaagtgaaattgcgggtaaggggggactactgtactgctaacaagtcaggtaaacaatttctgtaagttttagcgttgaaaagttaagtgttagtaaaagttattttgttgctttgaatgtatcttactggaaaaaaaaaaaatcttaaccaagatgaaaattacttcatacctctgtgtcagcaaactgattgcctaatggaaagttactttacattttatgttttaataaaaatgtttcaggcatcactttcatgaatgtctgaaaatgaaatttgttttatagccattctggtgttgactgagtgacataaagtctttttttttagccctaaatttttatatataaacattgctagctggtttaaacatctgttgatcaattgtccttatcatattttctcaacattttatattttgcataatatgatttctttttaaaacgttagtttaattaaaacttaaagcacctattacaactttaaattttcctaccatttaaattcatggcatactacacaaaagtattgaacatgcttgagaaataatttgatcctcctaattcatttgcgtgttctgaatagttcctatcttttgcatgtctatggcttgctgcttatgtttagaagaattgtagtttgttgtacttagaaacttcttttggttttacatattaagcacaaatatgctatttaaatcaattgctatattgactttatgtattcttgttagcagccaacagtcgacaccatctttggtcacaatgatacaactcaatctaatgaaatttaacaggatgcatttttaaatttttttaatttattttttgctttagtttagctcttcatggtacaggatattatggaaaagagagcttcatgtacatttaatactgaaaacattatgtttactatttataagtgtaaaccatagtgtccaataaaatacacagataaacacacacacacacacgcacaatttctctcacaataataaaatcccttaataattcacacctttaaaatatttatactcaaatattttgtcaatacttttctatagtcagttcattatttgtcttctttatggaaattcctaagtaaaaatagtggcaaattggtcttttaactagaaaaattacaaaatcctcctatctaaaaaatgatactacctccaggacgtctgcaattttgtaaatttttcttccttagtagacaacatacttcctggtaaaagaaagccaaaagatggtaaacctctttgaattggattcttctttgatcccaacccactctaaattttggtagctagacctttaacttgaaacgatcaaattaaagaccctttcaaatattatacatgctgccttaattattatttagttgtatctccaacatctttgggggagcaggaaggaagggggggtaacaaaaacttcattgcttcaggtaggtataagtatagaggtcaatcacatttttagttgtacatcaaaaataactaacatccattaaattataaaacttctccagccctattcactatttaattgggtatggagttattcatttgtatcactcttatcattgcctgtgtagaatatacttattattaatactattctactaatttttctattatttccaattctgaattgataatccatggcttttatttcattgcttaacaatgtttgtatcctttatttagcaaatagtttacactggcctattttgtatcagtcaagatttttctcaggtaacagctttattattatttttattttaattaacaaaggtaggattacataagaaaagaaaactaaaattatgaaaagggaccttaaagctagtgtttctaattttatggacattgccatatataatctaatcaaagtggaagattcgtttttgttgtctatttttgtacaaaatgatgccactgaactcagatgtctttgttgactttgctttattatatagcctgaataaaaagtaatgaaatgtaattggtatataaattaaacctcaaatatgaaggctgttaacgtaggtgagaaaaatgatatgtatgcattttcttttatttgtaagcatattttcttttaaaattatttcacaaattacaaatgttcctactaataggaaagccaaatattatgcactagtggtacttactggaaattttagaattcatttatttatatttactacctcttgcatttatgcttttctttctctaaatttgtaaactgtaagctgaatatatgttgctgaatctatgctatatgacaaaacatttttaatcgttatatttttactaatgcatcaaagggttggaatgatcctcttcgtgtagtttcatctttaggcagaactatattctttggattgaggctttacttgaaagcctatttttttaatgttctagaactttattagaaaagtttaaaagagccctcacaatttaaaaaactaattttattgttttaaaatgttttaagggtttatccctaagaaattaaacaagcacaatctattacttgcaatttttatttcacagcacatattgctaataaatgccattttaaaagcaaaagaaaatctatcacaatcgttgcaagagatatttaataaggaaactaatgtaaatcatgcttcatgctatctgtcagttaaatcaagatataggtgaagatttaggttttatcatgtgaatattgtgtggtagtgcacattaatttgtatttaaatctttacattgttatcattgcatgtgttcactgtattttttaatgtgtcactgttttctctttatagattagtatttcaaagtaaccattccataccaattcaaactaccatctggtccctaagcttgttatatgaaaatcttttatcattgtcttccattgtaagtgttttatgatgagctacacctgagttgtacattttctttttcttttatttgcttctgtatacaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaagcagatgttaatgtcgatttattttttactcatatttttaatattcagaaactcagtaaattattcggaaactcaattatttcacaaatcaagagcagtgtatcttaggcatattgcgcaagatgagatctggagtgggggggcgacagtctttctaaaatgtatattgagaaaatgtaaaatcttttttatacaaatagctttaagccttgcctcttgttccttcttgcccagatggtaaaaaataatttcagccaatacctaattgattttgaatacaaaaacccttgggactctacttgtctgtttcatcctaaaacaaagttaaactaatgttttcttaagtcctaacactcacatattctagtttcttataattggcccacattttatttggtcttccatgaactgtgagtgaggttacttttccagttagactaaggttttccttacagttctagttctccttcctcaaatattctctttgaaatacttccatagacttgcagcatgtatgaattttactccaagaaccctaagatataagaaaagttactttatttttttctaaataaaattaatctgtctctaagctctccagcatgttagggtaacaggaaatttaatctgattattgggatttccatcagctcagagataagaaaaagtcctagagaaaggttatgcagagtagagcatttcaggaggtccctggtctttagtcatttgacagtgtttattaagtgtttactgtgcgctcccaagtccctgtcttttttttttttttttttttttttttttcccagaaggagtctcgctctgtcgcccaggctggagtgcagtgcgcgatctcggctcactgcaactgtgcctcccgggttcacaccattctcctgcctcagcctcccgagtagctgggactacaggcgcccgccaccacgcctggctaatttttagtagagacggggtttcaccgtgttagccaggatggtctggatctcctgacctcgtgatccgcctgcctcagcctcccaaagtgctgggattacaggcgtgagccaccgcacccggccgtccctgtctttatggagcgatatcagtaacacagagtgcctagcagtaccccctcccctcaccaccaccccacccttttccttttctcgttgtttttggggaaacaaattatgggaaggttaaatgttggtttggttaggatatgccaaaattagggaaacctctgggccagagcatactttaacttcaagaaacagtcaaaagtgttttatctcccattatattctatcaaatacaatgccccaacaaccaaccatccttcctccccttccattctctcatctcccctccctctctcttttctttcctgcagaaaatacttagcattagctatgtgccaggcattgttctgggtactaggatagagcagggaacaaactagattctgttggaacataaattcatgtggggtgaaacaataaatatatgatatgtcaggaggtgagaagtgctatggagaaaagtaaacctgggtaaaagatagggaatagtagggttgggggtaggagctgggctgttgctgtgatttatagaataggtaggaggaggcatctctgatgaagtaacatttgaacaaaaacctgaaggaggtaaggaaggcatcatgggaacttgtggagcaagagtaaatccacatagcaagtagcagatggcagggcccagaggcaggggcgtgcttgagatgtttgagaaacagcaaggagccaacagcaaaatgggcaagagggagagtgagctctttaatgttcctattgtccacctctcacaatgtttgttcatgggcaatacacaataagggatattagcttttaaactttttgatattttggaaagtaacaaggcataaacttctggttaaatgtacattattaaacacttactcacatttgtgctttttcaaaccacactaaactgacagtaaagaca

SEQ ID NO: 15977 - DNA, 18725 bp, Human
tccagctccctacaatcccccacgcaaatccacttcactcaaattatgctacctgattaacctctgtaggcatctgagttggcaacacctgccttaaaagaagcttatgattttgacagatgatgatgccaatgacaggattcaaggatatggaaataacatgagggtacagccaaaggcctgaggtctgacagtatggaacatggacagttacagtagggagtagttaccatggcagagagaagaacaatgggaaggcatgaagctagaaaggtagattaagacaacactatggagttcagaatatatgggcatataatataaacacattacacatttccaaaacacatagagaaaaaatccagatacaactactcactgacatacaaaccaacttagaagtagccattcattcactcgcaaacattttttgagtacctactacgtaccaagtagtaccacagtacctgtggagatagagaactaatgtaagccattcactccaagggcctatctaataggaaagacgagacagtttttgcacaaagttcaattaatgttttgtgtatatgaataaatgtttcctatcttttccttatgctctctccaggttgcaacgcatcattatcatcatcataaatatatacagtatactatatgtagaatatataatatacatattacataaattcatataattccatgaaagactggaaggacatactccaaaatatatttttaaagacagggtctcgctatgttggccaggttggtcttgaaccctaggcctggcctcaagcaatcttcccctgcctcagcctcccaaagtgctaaaattacaggcgtgagccaccatgccctgccaaaacagtccctttactaaaatattaaacactggttatctctattctttcatttgtgccagatatttgagctaagccagaagagaattttttatggtgatggttgtttatattatcattactatcgttattagaatgactgtaccatctctttcctcaactcattcataatctaggagaaaggttaaaaaaaaaaaaggaataaacaccaagtacgtggaactgcactatttagtgtttttgtaagtcttccaggcattgtgtagtaagcgtgtagaaataattgtagtttctcctccagttattttctcagttggaggagaaagattccaataactgtaaataaatacggctgagccatatttttaagaaataaaaacgcatacgcttacacacacacatatatattacgtatatatacactccacccgccccatttaccaaaatgaagagcagtacagcttagtagctaagagcacgggctctggagtttactttcttcctgtcctgcagcgattgtggggaagtcaggtcacctgtctgcctctccgtttcctcatctgtcaaatggagttctgggtccctataaagattcagtgacgcgatatgtgaggggcttggaacagtgaccggcacgtaaccgcccacaggttaacagctgctatcacttggtggggtgatggtttgtatcctatcgttattaatacggctgtctctagatgagcaaacatgcgctctcacttcttcccacattcaagaatggggtcccaaacgagagattcgacgtaaacgtccgctcccaactaagttctcaggcgctgacaacgacaagaattcctcacacaaacgtagcgcttcaatcactaaaccgctttcacagccctcgaccctgccgcgagatgtccgccgcccaccgtcaggtcaccgcctccctaacgacttcggctgcccgggccctgcccctgaacctcgcacccctcctgcctcgttcaggaagctccgcacctatccggccgccaccctcagcacagccacggcagccgactcggcgttcctactgccccggaagtgctccttcagcgcagaggcgtgccggtgtgtccgagaaaacttccgagttaagccgccgctgaggccggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagtaagtgctgtaaagaaatttagactggataatgtgatggaacgaagtgggagagtaataagccgtatgaaaatctggaatagagcattccaggcagagagaatagcgcgtgcaaaggccatatagtgggaacaaacttagcaaagtcaaggaaaagacaaaggccactggctagagcaaaaggagcaaggtgagaatggagagagatgaggccagggacttgagcccaaatcttgtaaggcttatgagcaaggataaagagtttgatttttgtttggaatccagtggaaaaccattgaaggtttctaagcagatgaatgacatgatctgatttatgactctaagattactcctgggacctcatcagaaagatgcaactcttctgttgccctcgagcagtgaaaatgcatgaaatccagactgacagagctagtaaaatattaaaatcaatcttattgtacagataagaaaaactgaatcccagagaggtgaagggacttagcctttaagaactcatgttttccaactccatttaatgccctcggaattatcatcttaattcccagataagagtaattgtcacttctaaaactcttcagatattttcctttgcttttgacagtggttctctaaatttaggttcatcaatatcacctggaagcttgttaaaattccaaaaaacaacaacaaaaaaacccctgcttaaatataaaatggatcatttcctctgattttctgttgtaatggaaaatgcatagaatttggggctaaagtatggaatcttgggaagccacttattttttaaatgctgctgataattatagcagcagttctcaaactttttgatcttagaatttctttatacttttaaaatgtattgagaacttcaaagggtttttgtttataatagctatcaatatttactattttagaaaacaactttcaacaaaggttattcattttaaaataaactcattatatgttaacatagatagcatttctgtaaaggatattttccaaaatgaaaaattattgagaatggcattgttttacattgttacaaatctctttaatgtctggctgaataaaagacagctagattttcgtaacttctaccttcattctcttacaatatcaatcatcatgtaacttttagaaaattgtgccatattgtgtgagaatgtgagtgaaaaagggatatgtcctaatattatgtaaattgttttgaaacagtgtcagggacacccaggagttcctgcaccacacttttgagaattacactgaattacggtgattgtcatgccagtaaaagaaatatgagtttgatttgtaaatcaataaacctatatgcacattaaaaatgcagatgcccaggcatcccctagagatcccaattcaataagtctgtggggtcaagaaatctgcatctttaacaagcaccacaaattaatttgatataaatggtctgaaaattacagagtgagaaaaccagtcaaatgattctctagagtgttctgcctactaaaactcaagataggtgtctttcttatcttcacctctctccatcaatagtttccagagcctgaagctctggaaagttaataagtttgtagcagacacctttcacactaccaagtcgatgagtgtctgaactcaaaattttgagcacttgccacaggcagtggccctgtgctaaggacagaaggtttttagactctatcattcataagcttacagtcttttgaacggataactaactgctaagaggaaaactgataagtcttataatggcgtactcttaatgtgctaggggactgacagagcaaaaaaaaaaaaaactcatctgacaagagggtgggcatgagagggtttcctgaataagatgaaattagagttgaatattatagagagggtacagtttcccccagaaagatattgacgggaaggggcagaaagatttttaagcaaaaggaacaactagtaaggtgaaaagttatttagagagaataaagtaaaacaagcgtagtttaggctttcagccatggcaggaaagctgggtagattataggatttaagcaaagaaacgaatgataatgataatcagcctctaggtgaggaaactaaaaccactggagcacatcatagctaatttgtgatagaggtaaaactaaagaccagacttaatgtttaaatccattcattcctcctgcaagcaattatcgtacatagaggcacctctgggcttctcatgactttctgttctgctgcctgaatctattcttggagaattacaatgccaaattggaattttaagcttatctcatgggcagtgagaaatcaccagtagattgtaaaattaccctgaattgctcagatttgtgtttaggaccaattctgagtgtcacagtgtttggatacatcatagaggtaaaaggagttaaggagatccattctgaaattaaggggatagtgtggtatacccaggtgagataaaaggatatgagttaggacagagacaacaggacttaattgaaaaatgtgtaggaggtggaataataacaatagcatatatttataatttacccacattagttcatcttatcctcaaaactaccctatgatgcagttactgttaatattattttatttaataaatgtgaaaactaaggccttgcaagcctatggcttcacccaggggtaggatcaggcaccttaactctagagcccattctcctaaccactgagccatgattgtcttacaattttgatactgcaaaactggaagaattgtctggctattatctaagctgttcataagctgaacaagtagatctgagggtaagaggagttctgttttaactagactgagtttcaaatagagatgtttcagactatagagggggaaaaatggcctgggaagatcataaatctaagcctgtttcattgatgtttttgtcatttgcatccagtagctattcagcaaatatacctatggcaaaaaggatataagttatgggtataactgaaataatcctgggtttaaagcaaagctctgataaatacagacgatgtttctccaggtgccagaagatatgttgaagtttgagctcagactgaccaaatgctagttatggggtatgtgatagctccaaggtagtaatataaaggctattttaattagaaacttttgagtaaatggccctcaggatagtgatttctgtttgaatgtcactaaccttttttagttacagatccctataataatgcttgagtctaggcagaacaactttgtgtttattctttgcaaagggtagggtagtgctaacaacctgctcttcatttgctttttctcccctttgccgattcagaatgctgctttgtcaatttgtgtgcctgctgtaggaactggtccgttttccaagtgtgacagtgcaggcagagaagggtggatgagctgtaaatgcagcctagaacacatttgattatagagaatgaagcactaatatcccaatataattggagtttaaaaaaaaaaaataccacctgggcatcaatgtgtttccctgctttgcattttcccagaactatttctgcaaacatcagtttcctcagccaacttaatattgagtcaccagaacggaaatcagccatattacttccttatttgtgttgaaaattggaacagaatggaaatatttcttccctcagaagttggcaggaacggcaacaagacaatctgttaggggtgacagctataggctcttctcttttttaaaaataatatagtcaatattcaacatggttttctggggtaaaatcatccacatttctgattctttatgatcctagcaaagcttacattctgtatacctgaaagatgaaaaaggagttggattaaacttgagtcttacacttatctattacatttttatttattaatgctgaagaaaggtaatataggctgggcgcggtggctcacgcctgtaatcccagcactttgggaggccgaggcagccagatcacctgaggttgggagttcaagatcagcctgtccaacatggagaaaccccgtctctactaaaaatacaaaaaattagccaggcgtggtggtgcatgcctgtaatcccagttacttgcgaggctgaggtgggagaatcgcttgaacctggggggtggaggttgcagtgagccgagatctcaccattgcgctccagcctgggcaacaagagcgaaactccgtcacacacacacacacacacaaaaaggaaaggtaataaaaaattttatcaagtaacttcatccacaaacatagtatagccctttttaactgataagaagaaggtgacactttggttttcctttttgaaatctgttcttgggtttcaaatgtcagctgctacattaaaaacagcaggcataatatatatatatatattttttttttccaaatacaaatgcacgtactcttgtgtctcccatggcatctaatatacctgccttaatgacctcagcccacttaactgatttggtgaacaattctgcatctgaggctgtatatgtgaggaaaaattaaaggattggaaatgaaagtaaaataactatagtataaaggatcatatgttcaaagcatgcaggcctaatattataggaagtcccaaacatataagtgaattgcattcctagaactgacacatttgtcttttctctgttgcattcacaatataattacatttcagtcacattgtcttagatacagttggctgtttctgggctgtctttcaagctggtttgtaaattcctgagggtctaggacagtgtcctaattctccttagcaactcttgcaccacctactgtacttcatcttccacgatggatccttgacctagctgagctgtagttttaaagtcattagtctagaatgagcagaatggtcatagtcaatgcagtttgtgctgcaagtagcagaaacccattcaagctgacttagcaaaaaggagacttagtgtgaggaaataatagtaccctgataccaaggatgatttgttcttccctcactatttttttctgctttgtcaccttcttggacacgtatctttgccagtgttttctctcacagctgctgaacagcctgttacctgcaaatgggttatatccgttagtctttcaaatcagaagtcctctgtgttcaggatgtacatggtatgagtgaagtgcccagtattaactggatgtgtaaggctattgtgcagcctctttctcttgtggctcaaaatcagtgtgccaggtttcttctgccatgtttggcctaagagcagtttaagggagtttatagtgttttcctaaatcctgtctggtaggtagaggcaaatggctatgtctgtacaacacaagaaccacaaatcttggccacatgggcagtttgcttgccacactccactgtgtaaggaagagactagagatctatgatgaagattgcctggcagccacagacacagttcaataactttttgtgaacttaatcttttttctcctgcctaaccatttccgcatttattacgtgtttgcacattcatcttcacttttgtggttttaattttgagtaaaatttaataaagttgtttctttttttaaaaaaaaaaaagggtcacaggagtgccaggaagtagaattctatcaggcaccaaagcaccatgtatgagtctctctttgtctttctcctgctcctcttcctgtcttcccactctctcccttccccatccctcttgtcctttcttacagcttctccttgtatgtggcccaaacctgactgcctcagcccccacatgcctccttttcctcaaatgaccctgacccacaagggtctcaattccaagttccaagaacaaagattctattagcttactttgccaataggttgtcttcctcctagacccaagaagatagggatagggctcaaagaggggagccgttgggtaagtagatcacgacaaatcttctctaccacaaactgaggacacatacaatgtcatatcatggttgggatccaagctcagtttacaatgcctatatgctccataatattgcaaaatatttgcaatgagaaaaagaaaaatgtgaaattttaaatttaagattaaaactgcataatggtgtccccttccccccaacccccaagatttttaaatggttgcatggtattctgagtgttttataatgatgtaactatcaaatgtaaattttagttcaatatctgaaagaaccatgaacaataataatagagcttattcagtgattaccattgccagactctgtgttttatgtatactacctcattcagactttgcaataatcctgtgagaatagattctgttattttgcccattttaaagatgaggggctgaggcagggagattaagtcatttataaaagttgcaaggctggttagagtcacagatcgtatttgaatcctatactctgaacctctctgctaccctgctcttattagagaccttcaattttgctgatctagagtaatctaaatctagaatggaatgtgagtgattatatctctcattggaaatattcaaatagcctgaagcaccattctgcaggtcagttgcagaggaaattgaggaactgtattagtggcccttagatgcagtacatgaatccaatgcctcagaaacacccagggagccaattaaaagtcataaattccaaggcgcaaacacagagtttcttactcgttctgggttgggacctgggaatccatatttttaaaaagctctcctgacagttgtgatattcaacctggtttggaaactgcacttggtgatcttttattcctaccattatcctctaggacaacatggtaaatgaaggtatcaggttgggagtcggaagaatgcatttaattaggtacttttaaggtcttccaagattgttagcattgactgtttttgtttcagagaatttataataggcaactgtatgtcagtttgaacaattataatccctgttgcataacattattcaatttataaagatctgtcacatactgaatcaaatttaaactaatctccatcaatatttattgagcatgtgctagttatgacgtacagcaataaaaaatataggccttgttcttaaggggtagttgagatgggatagactgcctagcagtacagagcagcatataccagcgccagatgagtacggtaggtggggagggctctggggtgaaggagaagccatcctttatacagctatactctgaatttatgtaggaggaatagctaaggccttgataggaggttcaggaagtttgcgggaaggcagaattccatgtgggagttatgctttgccaagccttgtgttggtgaggacactcattgccctgcagccctcgcctgtgacagctgttcattctgctgaagttcctgaatctcagagcaggaagaccgaatccatttcctttctttccagtttcttctacactagctactttgatcctggggggatgtgaccatacccccaggtgatctgcccacgtttgagcctctcagttgtttgacgtcttcatcatggacgaatatctccctcactcacttcagccactgcagcttccggagtctatctccagtttcaccattggcccagttagttctcctccagaatcaggaatcagacgcagcatttttggccactgcctgtctttaccacaattttttagctgttttttgtgaacaactcctgaccagtgacccctctcatttttccctgtctcctggccctctaccttgagtgctttcctcccaatttttattcctctttattcttcaggtcctgcacctgaagaataggtgctgcacacctctttttctcagaggctttccatgatgagattaactccccatgttgggtcctcctgtagcatctgtattttcccttgggtaacattgagtttattttgtatatatgtagttagtgtccatcatctgccagactgaacttcgtggaggccgagacaatgtctatggggcagtaggtaggcacatggtaggtgctcaatagatactgttcagtatatgaaaatgtatccctccgatctcaaactcagtggtggggaagagtagaaaggaaggagatggcaggttaagaaatgaggtggcattaaaataaactggagttgtggggggctttttgttttggttttggttttactacagagagagcaagcctccagctcaaagcctttcagcaggcagtagtatctctggaagctaataacacttctttgttttcattatgtttatgtgtacggttacatttgtccacagaactgatgtagagtttcctttttaaataaatgtgaaagtaaaaataaaatgagttgatttaaaagaaaagcagaaatgacgataatttggttcatggatatagtaaaaacaacaacaacaaaaaagacaggagaaggaatgaatgaagtttgggaagtgctgccctggatgaagctataggaactcctaatcaaagttctggagaaagcctggagcattttttcagcacactcatagcctgtcaccgttgagaaccactaatctagaataaagtacaaaattatgtcctccaattgctgtatatcttgcagtgaaaaagagcttggaaacttacatgtcaagcccctagcacagtgcttggctgatggcagtcattcaataaatgttatttccattgtttctacccatcaccccctcttaaaaaagagactgtattccaaactagattctcctactaacttgtagcatgtcgtaagaagcaaatcactgtgcactgaatcaattagattatattacttccaaaatcccctctctgcctaagtctttgtttcctttagtgtcctttttgtgcggttttaggaggaaatggaaataaacacgtttagtgtgtcatgtattgccaaagtctgaaggttttttattttactctgtataccccatccttaaattgtaaagatttagaaaagtatttgtcaccattcaaccatcctttcaagggttaattaatgaaaattaaatgacatttgcaccgtattgtaatttagactttgagatatttaatggcaaaatacagtgattcattgttttttatgttctgtgatcaagcagccttcatataaatataaaggagagtaaatgtcatttccaaaactaattatcttggtgctttataagacataaagctaggcatttcatcccatattttatagaaataaaagttgaattttttctttgagagttggtggcttaaagggggagtcaaattaccaggaaggtgatcataaatacatagacttttggactaggatgttattttgccttttattcaagatattttgctcttcttttaaatgtgtctaacaatctgtccctgtagttttatatttgcatttctactaactagacacttaagatgtcagttcctcccttagctagtttacagagtttgagctagaaatttggtatgcttacaaactattaaatacactgtactttgtctcttcgtattggagaaactattaaaagaaaattctgttgtctaatgttcttgcccatgaaggaggttccatagctttagaagtcaataactctatttatgtgtatgcagtaagtgcagctttctttccagtgttaaaacaacccacctcaggtgtccctgcattatttatatgtaacatatcttcatacttgaattactcaaattttgagctccatggttatgattatgatatgccagttgatttacattataacaacagatggtaatggtgcaggttgaaataaaagatcattaagataaatattttagccttcattggctccctgttgcataaaatttgtcagaatgaaatagaatcatggcatttcagaattggaagagtccttagagattatctcatccagtcccttatttgacagaggagaaaacagaaacccagagagaatgctgcttgccaaggtcgtacagctagttagtagcaaagctaggaccaaaatctaggtctgctatttaccaattcattgctttttctgctgtctctgtgtgagatttttaggtactgttccatctaattactccccaatgtcagcaccaattattctaattaacatctattcattctggaacatacacactttcaccccattatgaatctcagttggttaaactttgtatctggctttcttttaggttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtaattggtcagggtataattaatcaaggttactcatttcctgttctgtcttcttattttttaacacgttaaacaaaaagtctcaaagataaggtgccaaggtgaatagtttaaaacatttgaaaggtctggagtgttgtacctatcagaaaatgcaaagtaattataattgtttaaccagaagaagaaaaaaaagaatcattctaaatttaaaagatgttcacatgatgacaatgagctattttctctcctgatcagttggttttcttcttcattgaaggtagagtaaatcagggctgctgcatacagctgtacaggtggtatacaacacaactctgggagcacccttcacctagactactatgtcagtagtacagtgtggtggccctgtgtgaatacatccagaagggttttggctagacttaagaaaatttgttataaataaaaaagttttgctctgaaattagttactataaactttagaggaaatccaggacatttttgaaaatgagtatcaatctgtgcataaaactttgacgtcaggtctcagagaattagaagggcactatggaacttgtaagcccttccagctctttttttttttttttttttttgtattctataccttaatttactggaaatgagaaatttttttttgcattttttgtttatgtcttaaaaatcacataaacatagtgtgttcaaggtctactttttgacagatttttatttaattttcctattcatggatctgtgaatatatcttaatccagactactcctaaccagtgttctgttataaagatctttttgatgagtacttgagttataatggacctcaaaaagaaatcaccatggaaagccaaagggatgaagcttaaattctaagatcctcacaagctacactttcagaaatttttttgttaggaagatagtgtagccttctgaaatagaaaaggatattggttattcatattaggctggaaaacacaaaaggagacaggtgatacttccttcagacatatgcactattttaatctatagactgagtgactagtcaccaagggattgaagagtttgaattgttagggtatttttaatcagcatgtttaaaatacataactattgaattagagtgatacctggaatgtgtactttgaacatgatttggggttccatatttgaacccactgaaccagactcctatcttctctgggctctacgatatcctgaccaaacacctctgagatctgaattattcattcagtgtcatcactgtagactgactgcataaacaaagccttaggttaaaacaagaccagccaagtggaatggcagttttatttttctattttgcctttactttgaaaaccactaacatctatcattgatgctttcagcagcagctctggaaaattgtattaaattttatgaatctcaagtgagaggagtttaaagagcatgtcagtctagtataaggttcataaatcttgagctattatcagcaagtgagctagagagtttagattgtggttgtagtgcaatggttgatgaatggagtctttgtagttcatcataccttggattcaagtggtgtcgttttcatagctctaagttcatagaacagaagcttatggaaaatggctatattcataactacatgttttcctctttttgtattagtgaagtgatggcttttaaatatattaatacctataggattgagataagtttggatgatgatgaaaatggacaaaatccagagtgcttactaatttatgtgccactaaaataatccagaaccatagaatcttggggatgaaagagattttgaagattgggcactcaagtaatgcttaacaagcagtccgctaacctcctctgggacacctcctctagtcattggaatgcatccccacactgcaggttagcccatccttcccatctctgaatggctttcatagttaaagcacagagtgctttgggaatgtatcacaaaagtaggaattatgcagtcagagccaagttattgaaggatgtgaatcaagatgcgtagtcaatatgctttgcttttcttacacttgtatacttctatatacgtgttccctgaatgaaaataccttcacgtgtggaagagaggcagtatgttttaggttgaaaatggaagcataggcatcttaagggcaactttattctttttgccaagcttttcatttaccatgacttgtgagatgtattttttggcctgtgcttcagttactcttgccagaaaatcaacaaaagtttcttaacaacaacaacaaaaaattgatatgtgcaaggcataccagattaggcagttacttcaacaaatgcattaaattgctaggattttttaaaataatttcttcttgttatataatttcactatggaaagtgagcaaacacagttagaagaaaataaaaattactcataaaaatttaaaatactgttattttaaaccattgttttatatttctgagacataccctcatagtatatgaaaatgtattggttgcaatgtgatgtagacggacacatatgtataaactataagctttttttatgattagtcatttagcattttatagacatacctgtttcacagaaaggcttttgaagtctagcagtgaaaaggaagctatgttaattattagtgtcatgaaggaagatcttgatttccttttaagatccaagctaattaaattctgactctggacctcacagtctgccctttttttacatgatttaaacaaatggtagaatctaacaaatcagctaagttaaagtactttgataaagaggtggaatatggataaggcagcgggcatatttagtaatctttttgctataattttttttttcatttctgttcaattatcaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagccaaagcttgccttggctcatagactggtatttctttaaggaaaattgtttttatatatttgactataagagcaaaggctcttgaacatatcctagattatggaacactttttcccttcccttttctctggaaaaattaaattttttttctgtccactgagactggagtgcagtggcaagatcatagctcactgcagcctccaactcctggggtcaagcgatc

SEQ ID NO: 15978 - DNA, 7409 bp, Human; identical to SEQ ID NO: 12689

SEQ ID NO: 15979 - DNA, 21593 bp, Human
  misc_feature (1)...(21593): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgactgttgtgaataatgctgctgtgaacttgggtgcacacatatctctttgagccctttttaataatttttgtaacacagcaataacaatagctatagatacacttgtatagacatacctaccgcagctgccaactctgggggataagatgagtggagagttttactaattccgtggtttctaaatttttttattttaattttttttaccctttattatggaaaattaaaaacacaggaataggggaggccgaggcgggtggatcacttgaggccaggagttgaagaccagcctggccaacatggtgaaaccccgtctctactaaaaatacaaaagttagccaggtgtggtggtgtgcacctgtagtcccagctactcaggaagctgagatgggagaatcacttgaacctgggaggctgaggttgcagcgagctgagatcacgccattgcactccagcctgggtgacagagcgagactctctctcaaaaaaaaaaaaagaaaaaagaaaagtaacatgggaataggtataatgaactaccatatacctgtcacctaatctcagtaatatcacctcatgtccactcattcactccctgaccccaaggtattctttttaatcaaatcccagacatcatattattttacctgtcaaacatcacagaaataactaccataccataaacacacctagcaaattcaacaataattgctgaacaacgtcatgttgtcagtattccagtttccaatcactcctgtaatcccagcactttgggggagggacgaggcaggcagatcacaaggtcaggagtttgagaccagcctgaccaacatggtgaaaccccgtctctactaaaaatacaaaaattagtcaggagtggtggtgctcacctataatcccagctactcaggaggctgaggcaggagaatcacttgaacgcgggaggcagaggttgcagtgagccgagatcatgccactgcactccagctctggtgacagaccgagactgttctttgatccaggatccagatgaagcccacatgttgaaattggttgatgcgtctctaagtctcccttaaatttctcctccaccaatttcttttctgttcctgcattttcttctctgatcacgcgggcttttctcccataataggaagagacatggaggtgcccaagccggctctggataaaggcctgtcctcctctctccccacaggaccgggactttgtagccaagcagaaggaggacctggagctggccatgaagaggctcaccaccgacaacaggcgggagatctgtgacaaggagcgcgagtgcctcatgaagaagcaggagctccttcgaggtgggggtgtgcaagtggcagcgctgtcttggcccagagtcgctgtggacatcccagccctgggaagtggggtgggcaacaagaacctcccaggccttctccatccccaaaactaaacatcattcttcatggggaaacctggggaaaagccccacttgaagtaaggaacgaggtaaggacaccagttgtcaccaagactatttgagattattccagaagtcaagagaagaaaagaaagaaacaggcagagtatgttaataagtgagctggatttacgggaggtggagagagcttggcgtggactgagcaaccactctgccaggccatgtgccagtccatttttctacctttatctcatcaaatcctcacctaacactgtgaggcagggcctaggttatccccatttctgtagatgaggaaactgaggcttggagagttactattctttggccaagtatcttagttcattcaggctgctgtaacaaaataccactgactgggtggcttatcaacaacagacattcatttcccacacttctggaggctgggaaatccacagtcagggtgccagcacatttgtggtctggagaggacttactctctgcttcatagatggcaccttctcactgtatcctcacatagtggaagggagactagctctggggtctctgggtttttggggttttgtggttttttgggttttggggatttttgtttatttatttatttattgagacagggtctagctctgtagccaaggctggagtgcagtggcacagtcatggctcattgtgacctctgcctctgaggctcaagcagtcctctgacttcagcctcccaagtagctgggactacaggcacgtgctaccacgcttggctaatttttgtgttttttgtgtaaatggggtcttctgtgttgtccaggctggtctcaaagtcttgggctcaagtggtctgcctgtctcagcctcccaaagtgctgggattagaggcataagccaacgtgcccagcctggggtctcttttattaataaaaaggcactaattccattcacgagggctccaccctcatgacctaatcacctcccaaaaagccccatctcctaataccctcacctcaggggttaagattccaacatacacatttggggaggggacacaaacgtttagatcatagcactgaggttgcacagttaatgggtgatagagctgggccttggatgacaatatcaggaagccgggcctaccctggtgctgttgggagttcaagggatttctgggctgattgaggaaaaataaatgaccacaagatggcagtagcataccagcagctttgcttggggggcattttgacaagttgacacgctgagggggtcccttacagaatgaggctttctggagatgatggtgcgggccaccatccagcaggggaagagggcaaaggaactcttgggcaagaaggggactgagagggggctcacatgtctagatgatgtcgtccagcgtggggagctcagacggggcgtctctgggtcagagaactgcaaagggcaacggtggcttggggtctttatggagcccttgggtcttccatctctatggctggcagatgttaggtgcagtttcatggggtatgcaaagtaggcaggctccaaatggctaaatatctgcttggtttgagcttttttttttttttttttttttgagatggagagtctcgctgtctcactgtgtcatccaggctggagtgcagtggcacaatcttagctcactgcaacctccacctcccaggttcaagcagttcttctgccttagcctccttcatagctgggatgattacagctttgcgccaccatgtccagctaattttttatatttttaggagagatgggatttcaccatgttggccaggccggtcttgaactcctgaccttaagcaatccacctgccttggcctcccaaagtgctgggattacaggtgtgagccactgcgccattctcctgcctcagcctcctgagtagctgggactacaggcgcccgccaccatgcccagctaatttttttttttttgtatttttagtagagacggggtctcaccgtgttagccaggatggtctcaatctcctgaccttgtgatctgcctgcgtcggcctcccaaagtgctaggattacaggcatgagccaccgcgcctggccctgtttgagcttttttatgtaactatatacattttttttgtttttgttttttgagaccaagtcttactctgtcactcaggctggagtgcagtggcacgatattggctcactgcagcctctgcctcccctgttcaagcaattctcatgccttaggcccctgagcagctgtgattacaggtgcacaccaccacacccagctgatttttatatttttagtagagactgggtttcgccattttgcccaggctggtctcaggtttctaggctcaagcgatctgcccacctcagcctcccaaaatgctgggactacggtgtgagccactgtgcctggccgtacatattatgttttaaaaataacaagaggatgggtacaaatttgagtttggtgcctgtggacttttgacggtccaagcctgctgtgaggaagtaaacaacacgaggccaatatcccagggcaatttttggctcatttataaaacaggcctcatccaggcctttgatgaccagtgcagttaagcaagataaacctcttattatttgatgtggatcagcaaaacagggttcttgagttttcaatattctgaatagagcacagttgttttgagaaaagccctcacttccttttcctatcccatgatgttggtaagaaccgtcctatttacagaactgtggttctgattttggggtggaagccagaatcactattctgatataccaaaagcagataccattttgcacggaacaggaatgcagtgaaataaacaacattcgcactgagccaagcataatctcctgtctcgaagggcgtgagattctccctttgaccccaggtccccacccgggtgctgtgcacaggggtggattaatagacctccagtgttaagatgccagtatcttcattgtcttcataacgcatgcctgggacgtgcaggagacaaggaggatctcacccatttttcaaaggaggaaatagtgacaagaggccattctgtcttcttcatggggtctccatctgagctcttcccaggtgcccatcaggaaggtagagatgcagtgtggaaactttgcacttcaaagtttctcccaaggacgtcccctccctccatggtatagctgtgtccatctggcagacatggcagctgatgcctagagaacctctccattcctaatcccaccgatggagctgggttccagcctatagctgcagtttctgtggctcctgactttgaatacttcctgctataccatgctcctgggagctctcattccttaggcttaaaggaagtttctaggcctcagctcagatcagccaacgtggtctaatgaggtagaacatgtggcaattcctgagcccagcaggttggttatcatctccagcatgaggaggccaggcagaggtggggggcagggggcctgtcgagtctctggttgtcagcacctcaccagctcggtggcatgtcctctgcagaccgggaagcagccctgtgggagatggaagagcaccagctgcaggagaggcaccagctggtgaagcagcagctcaaagaccagtacttcctccagcggcacgagctgctgcgcaagcatgagaaggtgaggctgccggtggcacggggctcggatctgctgccgggccgacctgggagagccatgaggctgtatgtgatggggcacctcttgggtgcacactttggatgacaagtgcccccaagaggagccagggctggctgcagtgaggccccaggaggttctccaggggcgtcctgcttcagctcaaggggctaggaataggggaaacgatgcagggaagccaatggcccaagtggctccctcactgactgttacttgctgtgtatgtctctttcttttcttttttttccctttcttcttttctttctttctttctttctttctttctttctttctttctttctttctctttctttctttctttctttctttctttctttctttccttccttccttccttctttctttctttcttttctttccttccttccttctttctttctttctttctcttctttcttttctttctttctttctttcgagatggagtcgctctctcactcaggctggagtgcagtggcgccatctaggctcactgcaacctccacctcctgggttcaagtgattctcctgcctcagcctcccgagtagctgggattacaggtgcttgccaccatgcctggctaatttttgtatttttttttttagcagagttgggctttcaccctgttggccaggctggtctcaaacccctgacctcaagtgatctgcccgccttggcctcccaaagtgccaggattacaggcgtgagccactgtgcctgcccggtgtgtgtctttcttttgctcttttttctcttttccctctttttgtcctccctttccattttgtctttatttctctctttcttgtgcattccctcaatacttttaggtctccacttaaacaccacctctgctgggaagccttccctgaactccccagagctggtgagggcccctactctgtgtggccaaagcaccctctcctgcgggaattgtctgtctcagttcagcctccatagtgggacagtgacagacagaccaaggtctggatgcacagcagctgtgtataattccagtttcttatctaaatgcagtgatggaagtcagtatagggccatgggagttcagaataaggctacccaaccaagtgaagaaatcggggaaggcttcttggaggaggtgatgcccatgctgagctttgaaatacaaataggtgttaggggaaggaaaaaattcaaatctatcaggattttttaaaatataagttcatatctgccatcactaatggtaaaccatcccctttcgtgtacattttgctttgagatattagctaatgatggcatgccatcattgattagatgaaaaggcatttagaaggtaagaatccaagatattattaacaagaatttttaaagtgagaacaaataatgttattagtgtagaagcaaaataacaccagccttgatctgctgaacattgtgggctgcgttggtcctgggcccctgagtggagtgtggggacctttagcctgtgaccacgctctgagtccagagtgcagctgccctcagcccctctggatattcctctccaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcaggtgggggccgggcctgcggggtctgcaagtgtgctggggtgtaggcagggccaggtttggcgggacctgggccttatacagttttggagaatatgaaacaagatgcaggctggctcacgtctgtaatcccaacactttgagaggccgaggcgggcgggtcacttgagcccaggagtttgagaccagcctgggcaacacagcaaaaccccatctctacaaaaaaataattttttaaaaatattagccaggtgtggtggctatttggaaggccgaggtgggaggatcgcttgagcccgggaggcagaggttgcggtgagccaagattgaaccactgcactccagcctgggcaacagagcgagactccatcttaaaaaaacaaaaaagaaagatgcactccgacccacccgcctataaggtcttgggagggggtgtgcgagtcaccatgcgtgccctggaagcttcatcagcctcatggtgaattcacctctgtgtgtggacagaggtagagcttggtgctatgttgccaattctcctgcacccttcccttccgcactcccacacttttatttggccagcttccccacatcctgtgttgcccttgtggctcgggcacacgggcccttgtgattcctgcctgctacacacactttcctggcgtgtgtcacattgcagtgtcatgtccccaccagcctgggggctcctcgagggctggggctgggtctcagctcagggtgaggacttaacacgggcacagcctgaggtggtgctgggtactggggctgtgcacagaccagtccccctgaggggtctccctgggccagggctgagtggggctccctacccaaccagccaggccctggtcccctgaggcacccaccctctctctggtgcagttctcccagcaggaggagaagaggcagaagtcggagcggctgcagcaacagcagaaacacgagaaccagatgcgggacatgctggcgcagtgtgagagcaacatgagcgagctgcagcagctgcaggtaccgccctgcctgcccctgcccctgcccccaggctgcctcagtttccccaaggccatcagatctcagggggccagaaactccacagcagggaaggatcttcatcagacacgcccgggatggatggtttccagccctgccatgctgctctagggctctgtgaggttgggcaaatcatatcaccctcctaagccatagctctcacacccctaaaatgggcatggggatgaccattcctgctgtgcaggattggggcaaggacttgtgaatgaagtggcggagctggcagtgggctgctgcagggtttctgagtcatcactgtgttttgggcaaaggtggttggggtgtggccgagccccttgtgggctgcttttgctgtggtaattcctgacctcttcaagcttcctggcccctgggtttgccccatgcctgagggtcctggccccaggagctggtacttgaagcccccttgtggggacggggctgattcgaacctcaggaactgctcaggctgttggacccatcgggcaatttctggagaggtggggaggcatggaggaaacattccaggtgttgaggcctgcccggcagggctctgctgattgccactgtgtgacttttggccaagccattcaccttccgcatccgttttcctatccctgcctcgggtgatccctgcctcagtgtgagcactgagagagcccgtatgaagtgccgagcacagctcctggcaggccacaggcatgcagcgctgctgcgagtattacttctcactcagccaagttctaaactcccagaagcctctagcatgaaacccaaaatgaaaatctcccaaaggattctacttttccaacccagtagggtcgtggtatctggataaaggcacttccccctgctttataagctcctcatgacaagactgattccctgcaagaaatcaacagggacttgtcactgctgcctatgagagagatttacattttgtaaagcagataacttacctcagagaaagaacagcgaggttagaagagtctcacccatgtcagtgaccctcattccttgccacagatctccctgaggaaattatatgtgagacatacagagtatcttagctcgggctgccataacaaaccatgatgctttaattaacagaaacttctttctcacagttctgaaggctggaagtctgagatcagggtgccagcagggtggggttctggtgagggctcccttcctggcttgcggacagctgccttcttgctgtatcctcacagaaagttgcaaatttactatacctccccaccacagagttaataagaactattaacatattctggactattcctccaggcacttcttggtgcatgtgatttacgtatagagtttgaataaatgggatttatagtcaagaagaaataataaatgaacgatgctggtgccctcgtagccacagcgtgaggtgtgtctcagtcttcagggcctgcgtcttctgatttctcacctgttctgcctggaatctgttccagaatgaaaagtgccacctcctggtagagcacgaaacccagaaactgaaggccctggatgagagccataaccagaacctgaaggaatggcgggacaagcttcggccgcgcaagaaggtaactttatccgagctggtgggctcagtctcgggctctgctctgtgccatgcacaggcctctggccaggacatgttaggtctccttattttggtggactcttgctttgtggcaccatcaaatggatctccagcctgagagagagaggaactttctaaccctttgtggctgaacgccctgcagcttccacctctggaagggcagcctcttgtttagctccctctcatggaccgaaggactcctgccatgtgtccacagaggacgctgcagtgagtcaaaccagccacgctgctgggccagaagcccagcctgtggggattttctcttagaggaagttattctgaggagtcagaacgcagcacaagataaactgcttgccaatttagttttctgttgctgtgtgatgaactgccacacacttagcagcttaaaccaacgcccgtttactctctcctagtgatggagttcaagagtctgggtgggctctctgggttctctgctcagggtctcaccaggctgcaatcaacgttgtcagcgtggctgggctcttagctgaagtttctggggaagaatcacttccaaacccattcagctttcgacagaatccagttccttatggctgtaggtctgaggtccctgtttccttgctgacctcagacgggttattttctagaagccaccggcactccttatcacgtggcctcctccacctcaaatagccagcatgcattcagacctcctcgtgctttgaatgtctctgatatccctttctgccaccagctagagaaaacccttttgtgctcatgtgattaaatcagggtcacgggatagcctccctgcttgcaggaatgataccacattcagaggttccacccacacgcagaggagcggggagagttatatgagagagagtcacaggggtcatttttgaatggtgcctgccatactttcaccttcaaaccccatgccctcgctcagtcccacatctttctttactgccctgtctctctctttctctgcgaagccctgtcacaatttcttcctccacccactgagaaattcctttctcagcccactgcagccgctgctggcatggtcaataccaacatcctggtggctgactcgcatggatacggctggctggacttgacctcctggtggcagccagtgctgccagtcactctcttcctcgcctgccttgtcctcctaggcccaccttctgctgggtttcttctctgtcactagcccctttgcaacgtccctcgtgacccatctgttgatttctttattttattttttattttagagacagtttcactctttcgcccaaggctggagtgcggtggtgccatctcagctcactgcaacctctgcctcctgggttcaaatgattttcctgcctcaacctcctgaatagctgggattacaggcacatgccactatgcctggctagtttttctatttttagtagagacggggtttcaccatgttgtccaggctggtcttgaactcctgacctcaagtgatccgcccccctcggcctcccaaagtgctgggattacaggcgtgggaacgtggctctctgcaacctctgcctcctgggttcaagtgattctcctgccttagcttcccgactagctgggactacaggtgtgcaccactgtgcctggtggagatataattttttttaaatattgtataatgaaatgtgtcaacttttggaagatctgcataactcagtaaaccaatattttttaagtgaccaatgcatgatgttacaggatcatggctggagcaaagttacatccaagtgcgagaaagaccagcggatttttttttttttcctgagacggagtggcgctatctcggttcactgcaacctccacctcccaggttcaagcgattctcctgcctcaaccttcctgagcagctgggattacaggcacccgccaccactcctaaagtgctgggattataggtgtgaacccaggagttcgagaccagcctgggcaacacagtgaaacctcatctctacaaaaaatacaaaaattagccgggcacagtggcacatgcctgtagtcccagatactctggagcctgagatgggaggatcgcttgaggccaggaagtcaaggctgcagtgagccatgattgcactactgcactcccgcctgggtgacagattgagaccctcgcaaaaagaaaaaaaaaaaaaattgagaagctgtcaagttcaggctggtggacacaggttttccaaagttctcatttttgcttgaatgctcaaattttgtcattggcagtaaatatccttagtttgtttcccttgacgtgatcagctcagtttgttcattttcaagagagtgtttgctaaatacccatatttgtcagtaatttttttttgaaatggggtcttgctatgttgcccaggctcatttcgactacctgggctcaagcagttctcctgtctcagcctcccaagtagctggaactataacacatgccaccatgcccagttgtgagttgttttttaatcaaaatgatattctgcagaatcaagtggcgagttcagcccacaactcaagatgattgcacaagaacaataccaggcacaagaacaggatctctagacagccatcatgctttgaccggcagcaggcgggccttatgcatagttctcatttcctcacacaggacgttaaagggctgtgaccttgaaggtcaggatttaataaaatgaaccatttgtgttgcaccatcaaggtgatcttaagtgcaattggctttattgttttaattgaaaaactttctaaaatactatgagtgggcctggcatggtggctcacacctgtaatcccagcactttgggaggccaaggcgggtggatcacctgaggttaagagttcgagaccagcctggccaacatggcgaaacccagtctctactaaaaatacaaaaattagccagacatggtggtgcatgcctgtaatcccagatacttgggcggctgaggcaggagaatcacttgaacccggcgggcagagtttgcagtgagccaagatctcaccacttcactccagcctgggcgaaagagtgaaactccatctcaaaaaataaaaataaaaataaacacatgtgagtgcacggtggtgaagaatacccattcagttaggaggggccattgtcttaatcctccagaagctccagaagttttacccatcattgcttttgtaccattagcaccaatatcaaaacaatgaaaaagcaaactgtgtcttagcaggaaactagagcttgctgcccctcccccacccccagaaagcgttttgggccccctaggggttcgtggaccacacttcgagaactactgttcttgccttatctcccgtgagtctcatccccgacttgtgctctgagcagatttcagtacccaaatagatctccatgccatatgcgcttccctcgttccctgctgggcttttgcccagcctgttccccttgccaggaattctctacccaccagcctttgcttggccaacttctgtttgtctgcattattcaggcctcccccacggaggctgtatggtgtcttctgggctccccgtccttgcccctgtcatggtgtttatcacatgggattgcatttgtgtgtcatcgttagcttgatggttcattcgtttgtgtattaatgcaacacatatttcttgaacacctgctaagtgccccacgctgtttcagactctagagacactgcattgaacaaaagggacaagtccatgccctccggaagaaccgaccttctagtaaggggccaagaagcagggagggaaacagcatgggggggtcacaaagtgaggctgcttcagacggtgtggcaggaagatgtcgtctaagaagatgacatctgagccaagatctgaaggacctgagggagggaggcgtgcagccgtgggggttttcagggggacattcccagcacagggaagagcaactgcaaaggcccggacaccttgctcgtgaaacaaggagacccctgcggccggagagagtggtggtgacggtgggaggtgataggaggtaaagtcagaggggtggggggcctgcgtaaagtctggcttttactctgtgtgagatggaagccactggagggttctgagcagaggacaaggtggtctgactcatgttttgaaaaggatcccgctggctgccctcaggggtcaagagtggaggcagagagaccagtcaggaaaccattgtgatagccttggtgactaatgatggcagcttggactagggtggtatcagaggttgggggaatttgtccatttcctctctagctggcactctagacgttcttgctggtcaccagctttgggatcttgggcaagccatcttccccgctctgggccgtattagtctggattctctagagaaacagaaccaagatagagagaggatgtgtgtgtgtgtgtgtgtgtgtgtgtgtgtgtgtgtgtagggagagggagagggaaattgatttagttattttaaggaattggcttacacgattgtgggggctggtaagtctgaaatctgcaggacaggtcagcaggctggagacccagttgttgttgctgtctagaggcagaattccttctctcttgttttctctgaaggccttcaactgattgaggcccacccacatgatgaagggtaatttgcattactcagagtttactgattgaaatgctaatcacatctagaaaataccttcatagtgacatctagctggtgtttgaccaaacaggtggataccgtggccttgccaagctgacacataaaattaaccatcacagaaatcagtcgggcacagtggcgcatgcctgtaatcccagctacatggggggctgaggcaggagaatggcttgaacccgggaggcggaggttgcagtgagccaagatcgcatcactgcaccccagcctgggtgacagagcaagactccgtctcaaaaaaaaaaaaaaaaaaaaacccaaaaaacatgggacctcagtgtggttatttgtacagtgaagctatcaatactgcaaggttatgtcagaagttgccagcacatagtacaggccaaggacatactcattcccctaaactctctgaggagagaactgcccaagttactcttaatctcatgcccacgggtcctgaagtcctgaggtttgttctgccatcgtacatcagttctgcttactgtaactgtggtctggacaggaggcaactgcccatctcagctgtgtgatggccttgggagtccttgaattgaggcctccctccctgcgctcatggagctttctggctggaagctggccaagatcccagacttcctgttaggcccacgctcatcagtttctgtaaccatggtctgctgggactttccatacttgacagtcaagtcaataatgttcctgctgacataggttggttctgcaatcaggaaatgaacgtccacctggttctcttacctgggggttctatacccttggcctatcctgagagagtttgaaaatgaatgatcgcgtttcctctagctattgccttatgtctcagatcgcttcaaagaggggcctgggctcaggggaggcaccacgagtgtgcagttgggaagccagcattggactttgcctgtgggggctgcctctttgcagaattctttatagaattcttctgtcattagctgcttgggtttctgctggaacaatgacccggaggtgatgattttcattcgagaataaatggtcttttacattcttgcattacagtcagcagcctgtgaaccccctgccttgtatggaggcagggagatgattgtacattgtggagtatttttagaaaaattcagatgtatttcgagtaagtacggaatatctggtagagtcaatgaagtgttgcttgggtcagtgttcacacagaatgtggcctcaaacaagtcaaatcttccctcctgaaccctggcttttcgggctgtaaaatgtagataatatttatttccttaaagtaggtgttagcaaaccactgccaatgtcctaatctggcccaccacctatatttgtaaataaagttttattggaacacagccatgctcgttcatttacagattgtctgtggctgattttgtactacagtggcagttgagtagtcacaatagagaccaaatatgtcctgcaaagccaaaaatgtttactatctgtcacataacagaaaaaagatcgctgactctggcgtaagaaggttgtattgagaaatatatgtggtgggtagaacagaataatgcttaaacagcccaggctttggagtcacacaggtgggatgaagtcctaactcctccattactagttgtgaaaccttgggcaagttactaaaccattctgtgctcaaaaagtagtagctattattattaaattgttggtattcctagagcagaggtcccaaactgatagcctatgtgctggaattggcttacaggcatggtatgtttggccaacatagtgatgtaaaaaaaatttttttttttttttttgagacagagtcttgctctgtcacccaggctagagtgcagtggcacgatctcggctcactgcaacttccacctcgcctcaagtgattctcctgcctcagcctcccaagtagctgggattacaggcacacactaccagacctggctaatttttgtgtttttagtagagatggggtttcgccttgttggccaggctggtcttgaactcctgacctcaggtgatccgcccgccttggcctcccaaagtgctgggattacaaggctgagacaccgcacctggcctgtaaattgtttaaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctttgctgctcagtctctctccatcttctccctcgggtttttctccagtcatttggctgttttcctgccaggggatttgcatctgcttttttttcctccctgccccgtctagattgacatttcccccaactgtacccttcagtccacagggagcttctgagtggcggtggcaggaggtggtacttacctcctgtgggaggagctctagggtaggaaatagggaagccgtagtttctcaagcactgaggcctggaagggaatgttccagagaaggccatgtcagtgggggtcctgtgagtgggagacccacgtgtggcctgcagatctcaccaagtgccatccatcctctctcttccctaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccagtatgcgggtttacttacaaggaaaccttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaaattctttgagacagggtctctaatatgttgcccaagctgatctcaaactcgtggctcaactgattctcccgcttcaaccttgagtagctgggacgacagatacatgctactgcacccagctaggttaaggttctgtatactctgtctttctaaagcaattccctggaaattttctcaacattggttataactgaatgcttgggaagggaggggcagcccttcaacaggaaaaggggactgcccaaatcttaaatgcacagtcaagattctcttggagctagcaatggttctcaggttagtgagcatttagcttgcctgctgcagaatttgacccagatgggggtgttttttaggtctctcacaaatgagacaagcgaaacaattgtctccttttattctctttggtgcattggtgctggggaaacatgaactagcggcagtgtaactgcagaacatagacccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggttatttgccgttcaggttgttcttttggattggggtggaaagcagggcacacttaaccatactcacccggcaagaaagggcttatcttccaagtacgcaggtgcctcccaggtcatacggcagctcagacttcgggtttctctttggaaagacattatgcttggctgagagagagcatgtcatggggcatgttctctacagacatttaatatcattctcatttaacaacaaacattcattgaccccaaaaagttttcacctgttaatgtactgaatcctttcaacaatcggaggaagacaccatcattcccattttatgtatttattatttttttagagacagggtctccctatcacccaggctggagtgcagtggcatgatcatggttcaccgtaacctcaaactcttgggctcagatgatcctcccactttatcctcctgagtagctaggattataggcatg

SEQ ID NO: 15980 - DNA, 239527 bp, Human
  misc_feature (1)...(239527): n = A,T,C or G
ttgcagttgccccagtgccatctgtgtccacggcagccacggcagatgaagtcagtctttgtagacacattcagtgagttacggtgactggcagtgaattgctgactagattgcatccattcaagagttttgaaggaacctgaggatgaaattgcagaactcttggctcagatgttttgccttttataaatagccactgttttcaaagcttggtgggttgccagcacaaagcatggtgcattggaaaggaaaatggcctggtgctgtggaggccccagctcggtcaaatctacccataactggctgaatagttccacgcagccttcctaggacctcatggtcctcagccggatgtgtttgctgtgaagtctgtggtaattgtcagtgtcatagttaaatctcattaaactgggttcattatacacgtggacgtattctatggacaggagcgatttacattaagaaatcagatcacaccgctgatttattcattctttgtttctatgaatgataatgttgtagagactgaattctgctatattcctcccgaagatgttgattttgttgctgcttgtttgcctgctttagcaggcatgtaatttggcctgacccacactacacattctctgtgtttgcagtgggcagcaactcaaattttgatgtagatctttaatccttagcagggctgcttggaattcacctggtttttgttttgaaagctccacattgcttagatggggccctgccctcaggctaacagccctaatgatgggttgtgtacccagggtcatttccttttccaggtgtctctcccagcttttgtcattctctagtgcctggagagagtcgttttttataaatgttccctgtagcagggcttgcccgggagttgctgctcaggacaccaaaagtgaaatgttcactccttgacttcagtactttccttgccttctaattccaagtctacatcttgctgtggttgtattaccatgctagcatttgcgatgcttttcttgtactattttggcaaaaacaaacacaaatgggggtggggaagtggtgttttgttttttcctagagattgttctgctaacagtgttagttactagttttggtaggcatccctgaacctagatgacctctgttagagatcgccgagagaaatatccagttattatgatgagtatggacattttggaccccaaattcccacgtaggcattcaccctggtgagctgggctagatatttttgggctgcaagaattccttttgcttagatggattttggcctaaattgcctattgcatgctccttttctacaatattcccactgggccttctaagatattgggagcaggggcagagttggtttttagtgagaagagggaccttggccacctctgaagctggagtggcactgggccgtatgaccacattagccattgacattcctccagggggcatgacccagaaagcctggaaggagaaagccaggccccagctatttataatcccctctctccgccttgccactgtgtatttttaaccagaccctgaagtctgatggaatgaggcattgagctccccctagaggttttaggatgtcacaagcagcaatttttataaagcagtgttgctgttttctttgtaccagcaaagatttatgtacattaatctacataaaaattaagatttggtaaataatctggactgatttcatatcctgtctccttttgggaccaagttgttattgctagaaatgactcagagcgagccttttggggacatgagcctctgggtctgtgtgcaaatcattaaacattaaaatagaagacagttttgtgatcacagacatggaatttaaatgttgtgctatgatcatgtttcttaagttgatttaatggatgtggataaagctgctgtgttggcattggatagaatggttaaggaattaactgtcactctggcaacccagtaattttattttctccttctgtatttcagggtttcgaaaaaacgatgaaatgaaagctatggatgttttaccaattttgaaggaaaaagttgcatacctttcaggtaaagtttaactttcaactctgctctatccaactgctctgacacaatttcagagtctgacgtaataaatgaactcacctgccacaacatataaaaacattggcatttctatgaattttgaatggctttattcttgtagcactgtttctgagaaattagtgcccaaagcattttcttccagttaggaggcacatgataagttagttagtgttggtgatgaaaatacatttgtttctgccattcaacaaaaattcagctgttctgccccaatcagttaagtaaaaaaactgattttaaaaatccgatcatttcaacaaagatggtgggaatgtgatggtatgtagatgggtcctgaatttctcacttttgtttctcgtactctgtacctgcctctgttgccttgtcttttgggaggcaaggatgcctgcttctccttgagatctgctcctttgtggctctctggtcatggagtaactaggacccatgtcatggacgatgaagccctggtgattttaccagctgagtctgtttccctgtagacccagtctttgaggccctggcccgcccgcagacagactctgggccagtcccttgggcttgggggcacctaactgccctctcttctgcacatagtcagcgttaggccgttttggactgtcttcttggggcctccctcccacataaacagaacagcccttgggtattataccttttggaccccagttcacttgttaccaaacaaagatttgcaagatttttctgctctatcaggaagtacatctgtagattgtcgtcacatgcttttagatgaatttcccttgagaatttttatctttcttaaataggcattctgtgctgatctgtgtatcctcttgaacacatatcatttttaatatataacactgctagctgcttttataagtttttctgtcctttggacatgtgatactgctatatatttaagatgcagcttcctatggtgtttttgctaatcttgttttgcttcatgttcagtaatatttcttggcccctgttaatatggtttgattttgtgggagtaaatctaattcattatgtatttggaaggttcacagaagagtgtaaggagttcatgaaaagaaggtgctttaaattgttggaaatacatggtgaaaaacaaatactggcttacaatacactgagttttaaaagtagcatttatttgctcttctctaatcatttactgacaaactgcattgtaaggactcatgccagctttgcgaacccctgattttgtagtttacaaacagagtaattgaaagactctacttataaaaattagaggtatctgtaaggaaggcttaaagctgagttcatgtgtttatcagttttttatttttaaagtctgggtctgtgataacagcacctgctcccccaacccctcttgtgtttctgaacgttttgttccattttcttctttcattagtacgtggagatggacatgtgaagaaaggtggaaggttaagattggtgggttttatttgtattcatgcttttattaggcagttaatacagaatatattatcggctgacatttttatatagtttacagtcaacactaaaactgtttaccttttaatcaaagaaacaaaatcggcagtctttcagagtttgtcttaaatgtttaataaatacttaaattctgcagggttacataaagttggatatctttggtggggtgggaagttttgcttttaccacagattagtaggaactgtttaagatattagcgatggtagagcttccagcagtcttagcaaaatgacgttagtaggtgtcacctcacttttacagtattcctaatttatgaccagaactggcaaagctgattagcatgagctcattgctctttgttttaggcttatcgttatctcctttaggagggaaaaaaaccataaaattaagtagaaattgactacttgtgttgtattacattttttgaaaattacaaagaatgagtaaactttacaaaataaaatttatctctaactcatttttttgtttcttttttattgaaatctaattcacatactctaaaatccacctttttaaaacgtgtgattcagtggattttagtgtatcaccaggttgtgcaactgttaccactaattccagaaccttttcatcacctcccaggaaccccatatccacccccaagcccccagcactggcaatcactaatttactttctgctctgaccccattttaaaaaatattagggaatattatgatacctttgtaaaagctgtccatgtgaatggcttttaatagttaaatctaaataaaatggcaggagctttgtaaaagtaggccaaaagatgagtgattttaaaagatacttattaggtcaagatctctaaaaacccagtgataaaccccgtgataatttcttgaacttgaatatttccgatccttagcgcctaggtcttctaaaaagtaatgctgattgcacttaagtaagatagaatgtactacttccttcatttaggatgaactcagtgaggttaaatgtcttactgactttgtgtttgaagtcagaggacggtgctgtggtttgatggatcacctccaaaattcagatgttgccagtgtgatgctattaagaggtgggacctttaagaggcaattaggccatgagggctcctcccttgtgtgggattaaggcccttataaagaggctttacccttgcccttcagccatatgaggacgcagcattcctcttctgcccatggaggatgcagccctcacaagactaccaaacctcgtaaaaatgccctgtagtttatatttaatggagtttgcgcctaatggcatcttacatataatgtcaactattagtgtggttcctatgccactagggtttgagccttagaaaatctcacacgacaaccaccagaattaagaacgcattcttttttaactgtttattatggaacattttaacatcaaaaggaaagaaaatagtatagtgaatttgtacgaattcgttgcccacttcagcaacttgtttcatctatatttccacttagtcttccgttcactctggataattttgaagtaaattccagatattattttatttataaatatttagtatttatctcttaaatgtaaatgttataaaaaaccgctgcaataccaatgacagacctaaaaattgaaggtaattatttcatatccccccaaaaaacccgataggtattcaaatttttatgcttgtctcatatgcattgctgctggttgagatgtctggtaaggctcttttaacctgtaggttgtgtgttacctcctgatgttttaggaagcgaggaatccaggtgtcttcctgtggattttcctatagtgtagattttgctggttgtatcactgggtggtttaacatgtttcacttcccccatatttcttgcagactaggagttaggtcttgaggcttgattagaccaagctttgatctggcagggaaggtggcaaaaatacttaatgggtgtgattgtttagtttcatagggagttttattaggagagtcttgtcttatttttatggtgttcattgatgattattgcttagatctagtatttaagagttgcaagatggtgatattctacttatgtcctttctttttcatttattaacttggatatcccgtaaagagagatgtcccatcaccacttacttgattgtcctgagaaagagttcatacaggagaagtaggataagtgattggttcctgtccgtaaccagttttcaggctattgaaaaaggaccattgtttgtttgtttgttttttcccccaataaagacttatttcaaatgcatgattttaaatatatatgatgttttgattcattacacattttctctcttatgaagttaaaattgtcccatctttggccaatgggagcctcttcaaattggctcctaagttttgtttgctgatgtgacaagatgtttcaggaccatcttgtataattcctgcctcaggtctggaatcagccatttctctaaagagccctggttccttttagtaggaaacaatacaggttgctaggcatatccaccgggtgggttgtcgtttttgtgtctctttagtggacaaatctgggggaaaacacacacacgcattttaatgagaaatgatatcgtgactttatattaaaattcatagttcaaatttaggattatagatatttcattttactttttcaattatatatttgtggatatctgtttcatgaatctaaaaatgttagttcttatgtggacataattacttactttgtaatgctaatggtattagcacagtatatgactaccaaatgtaatttagtatttttcttcttgtcttggtcctgaggatgtatgctattagaaatctacagacctactactgtattttaaagtcacatgaaacagttcctctccatgtggatatgctatcagcttgaaacctggaatcatttgtttcattttgctttacatttgtaagacttaaaaaccccaacttgcttcaattttaagtaaaacttagcataattccacagtaataactaaaaaatagttaaaagttaaggtatggttaaaaaaaatctagtttttgtgtttgctttctccaccctgtgcctcccctataggaaaacttttttttttaagtttttggtttaatccttctgcttttaaaatatgagcaattctattgattttcccttctgttttcatcttcttctccccgagataaacaaaaatgtaataggcctcattttctatctttgcttgttttatttcaaagaatattctggagatcagtatatagcagcacataatagagttctcattgctttttacagttgtgtattactctgttttgtgtaacagagtaatacacaaatatatatataccagagtaaaacacaactctgtctctatgtgtgtatatatatatatatatgtttatatatatgtgtttatatatatgtctatatgtatgtttatatatatgtgtgtctatatatatacatatatatacatatatatacatacatatatatatatacacacacacatatgtgtatatatatagttaattcagtcagatgcccattgatggacatttgttttttttttttcttttagaatagctttttggggtgcagtgaacattcactcttatcaagttggggatattgacaggaatgtgggatttgatgccttaaggtttgctggtaccttagttcttcatggtctagttttgcagagtactgcatttccccggaagagaaggggaaccttccattcatcttgaatattcttgttagcatcctagcatagtgggagctggcagggactgactgagagtgcgggaactggcgggacttttcatgcaggctgccgagtcttctcagccttcagtagaaatactccatgagccaattcctggttctcaggaccaggcagcaagaggtgagcctagaaggtgcagggctggcgaggtgctcgccttggctgctgttagagcaggagccccgtgggcgtccttttaacagagttgtattattttatggcacacttaatagacgttagccatcatttctctttttcacaaactgtgtctttcagagatttccttggcaaaggctgctttttattgtcagtgtgagttagactgttccttgggagttgggagtgggaggttggacagcggctgaagaatcatttcaattgaaacaagcgctatggagagaaagatacagttggttcgttgaaatttacattttactcctcaaagcaagcgtggctttcttgcaagttctttctaaataagtgaaaggtgagcttctaattcatttaaagagaaagaggtgattgtgaatctagctgtttctgtggtcatcctgggccacattgctcaagagaccaagtctcctggagttttaagaagagggaaatgaggtctcagggtttaaggaaataagtgtcacacagacatgtatagctatagtgtaggaccctttcagccttctttctattattaaaataaacctcagttcccttagcatccacaggatatccatcaggcattgctgctaactgatacctgataggaggtatttttagttaatgttgtgtggaatatggaaaaataatccattcagcaaatgccagtctcactgggcatggagagcattgtgtattcttaaatcagcgaatgaaacaaagatgtttgccctcatggagcttatgttctagtggaggagacagatagacaaaaagaatatgtaaattgtaccatttcctagaaggtaagaagtgccttagagaaataagattggttataggagaggatgcaggtttatgtgaactgaaagtaaaacaccatcattataaacaaaaactggtttgtttttgtttttgttttttgctttttgactaaggcagcatttggataagcagataatcaatgagctgttgtttggttacagacatgaaaagcttccatacatagacatcctgtgatgctggcagcatttcctgtctttttcatttcattgtagaaactaaggcattgatttcctatctataaaatgaggctgacatctgtcccgcctgcctcaccatgtggcttacggttgataacacacacatatgagtgtatctaataggtgaagtttttatgaactgcagtgctgttatttttactagtttcggaacaggaacagaactttgcatttgtgacttttctgcgttatactcagatgctattttcatttgggtacttcctgtgatgttggaaaccaacctaaatcttggggaatagaattaaacagacacctgtgtagttgattttaagctccttgaggtttagcgaccatgttcctctgaactatacttcatcctttctaagattttttcttcatacctccctgaggaggagtcagcagaaagtgatcattaactgcgttatgccatctattggaaggtgcacccttagcagggagattagcatgtgaaaagattcttacttcacaaatgatttttgataaaattgtaaaaatatcccagtgaattttctgaagttcttttctaggaaaaggaaaagtgaaaatttttcctctatcttaaaattcagattcaggtgtctataagcttttcttaggacatgactcagcgcctaagcagatgaacttggtagcaagtcttaggatactgctcactagtgctaccagcctgggagaaatctttgtagttgaaagttggaaaagtgtagtaggggctgtcaaaacttctgcacagagctgcctttggttctcaggtctggggtgatcagaatggccgtgcgcattgtgcaaactactgacttccatgcaactttcttagattggcagattttggattctgcttctcacacccgtggtggagcatgccttgcttgacttgtgagctacggtgacccaggagggaggagagtgtcatgtgggtccctatggaatcaaacatcatgctgcatttcaaacacattttaaaaattcagaactgtggtcgagaaaaaatgttagatgctggctttctctttacccaaagtgaggggaatgttttaatttaaataataggtactgtatttttaataattcaagtttctgtaatatgtgttgatctatgataatttcagtcaaggagattgactcttttgaaaagcatgaaagctattgggaaacgaaaaatattgaaattgttaatctgtcttatcttggggatgagaggtattccaaaaaattagagccattgatgttaccctaaaaatcatatcagatgtttcagaagatcagttgataatgagcagtactgcttctcatgtttaatagtacttttcattcataaatgttagccccctctaaggaccaggaacccgttatttagttatctctgtgacatttttactactaaaaaagaagtaaagccagtagttcgaaagatcatgcaattttcttttgtctgggcgaagacctagcgatgacagtgttgcatagttccttcatctttatttaagcttttggagcctcagtatctttataagactggaatgataaaacctctcaacagagtcattgtaaaatcacatcagaaagtgtatgtagagcacgtgataccctacctggatctgttgttacctatgattgttgctcccatataatacctaaattattggatttagaaataatttaaggcttttctagattacatgactgaacagtacatgtggattgctttaagtattcccaatcaaaatgaagtttcattattatttagaatgagtacataattcctatgaagttatgaaaaccatattggtaaaatatgtttttaaaataccatcatcttctgctgtatgctttttggctgttctaaaaggaaagaatcttctgggtttttttttatttgtttgctttctttctaattttagatgatgatttttggtgcacagaaaataatgaagagttttgtattgtgacttgaattttgaggtctcccgaagagagatcattagagttctaaaactaaatgaaggatccacttgagaaggctaaattttcttcctctattttcctgacaaccccgatggaagtaataaaataaatgtgacaattttaccataagcgtttagtgataccaagctgacttcattaggattgtatatgttaacaagaaatcgttctgcctgcctgtctgtcaaagtcacatactctgagatttgtactcttagtgtgtgatagaaattttctaaaatccttaagctaattagctttaaaattctcatgtggttctctcacatgcatgtgtgtggttctgtgtgagagactggcaaagctggaccagtgagggtcaggtgccatccgtcgcagattataaagtcatcagcatagcttggagaatgttccttttgctttcctttcaagacttagacccatcttgttgataggaaagaaagaactttgaatgcagggcaatggggaaaaatgtgggggagactggcctagagagcagctgtgagggaggtggttgtctgaggtgagtgaaacacatggacgtgacaacttttttttctgtccaaaacataaaaactgaagaaaggagtttttcccaaaacattggaagaaaaagacaaggccatatgtagtaccttccatgtggcctgcagagctcagagattttctcccagatcccctgaagggatgacatgtcctcactgtgcctcagctgaaacaaggacttctgccctgtgcaaatttgtgtagttgctttaggaataattttgacagagtgaatggatgataacataggatttctgtcttatcttgtgtctaagtgtattcctaatgtttgttttttaggtgggagagataaacgtggaggtcccattttaacgtttccggcccgcagcaatcatgacagaatacgacaggaggatctcaggagactcatttcctatctagcctgtattcccaggtaagttctgtgtggcttgtgcttgtcactgatgtcacatttacaagagatgtggcgctatactcgttagaaatcagctaaattgtagcctgcattccaggcaaagtagtataaaatgaaagtcattatctttcaccttattaccattttgtgaccattattgtctagtgtaaagccctttggggagcagggacatgaaggtaggtaagagctttgtgtgttgacagtggatctgggatactcagctgggatttcaggatgtggcgcctgagttagaaagccattgttgatgattctaataccgtgacacagaggcctgggtgatcagaattgggtgctgcttttgacaatgcatttctgcctacttggcaaacgttagttctttaaaaatagtctgttgatatgtagcacgaagtttgtggggcattaaaaatccttattagctatatattgggcgtagatttgggaatctctatcaaaattgagactccattggtaatgggaatttttagcatagatgccaaagaacaccaagagcaagcaatgttgtgttttctggagagtccgcaagtggggagtcatgagttactaggagctggcctgtgtgtatacttgaggaatttagaatctgtttctgctctggaaatgtattactcgagtttaatttgtagatctagctgacaactggtggaggaaatttcctccctatattaatgtattagttctttctcacacttctattaagaaacgtttgggactgggtaatttataaagaaaagaggtttaattgatttaatggctagggagccctcaggaaacttatgatcatggcagaaggcaagggggaagcaggcacatcctcacatggttggagcaggaggaagagggtggaggtagggggtcaggtgccacacacttttaaacaaccagatctcatgagaactccatcaggggacagcactagggagatggtgctaagccgttagaaccccccccccgccccccgtgatccaattaccacccaccaggcctacctccaacattgggggttacagttcaacatgagatttgggtggggacacagagccagatcacaccaattaatatctccatttaattgttgcagttatattctggaaaatataataccatgctgatataatctaaggatacagtcatgcctggaataggagatttggtgtgtgttgcaggttggaggggtgcctatctatgaggaaagggtgagtcctcaggtgtctcttttattccagaaaggcacatactgaagggcatcagtggcagccatggtagagtgagaggaggtgtttcctaagagactaaatgaggatgtgtgagagaaaactcggccataatatgggctggctagatagtaaccttaaggaacatgttacaagagaatgatgtaagatggtaacagcataatgggtttcaggggttgtggtaaaggtaatagatctaccacagcacgtggttcacagcactcaacctgtgtaggttgacacaagcgggacaaggcagccatgcccctccctaacagggctggctgtggctgatggcaatcagcttttggtcttgatagtttgacttgctggggaggttcttgggttttctgtcagagtatcctttatgagaaaactatcactgtgtggcatcagtgactaagtgagccctacttatctggagtaagttttccctttcttcttctggtatttcttaggcagctgacctgttgaaatcttagagttggaaagtagtttagaagttatttatactcactatcatttataaataaaaatagagtgtaaactactacttactaagctttgactatgtgccaagtctgtgataatgatggaaaaagaaatacaaagggcagggttaaaaaaaaaataactgccaatcaaaatgatacttgtcatatagtttaataagaactaaagttgaatttgatattcactcttgtgaatttgaatactatatagtggtaactttgacaacttgctttttggtcttgaaacctatgttaatagtaaatattaaaaattattcatttaattgatatagaaattggttcaagcacattttggataatctggatgacccactttaaaaaaaaaaccttttttttgtgggaaattgtgagaatacacaaaagtggagagaataatatcatgaacacacatatacccttcacccagcttcagcgtttatcagattttgccaatcttgtttttctctaattattcacctggtgtattttataacaaatcccaaagatcacatcatgtcattcaaaaatacttgagtgtgtaggatgaccctccggccactgaacagtctcttcatgtcagtacctaggtttgcgtttgcattaactgcagtcccaagtgacaagaaatgccattttgcttgtcctcgattaatgagcaaataagagaggtggattaacatgtaaatgacgcatttgccgagtgataatggagaaagatttcagagtagtccaaattgaaagaagtggccacaaagtgagtcctctctgggccctctcccccagggtcctgcaggtgctacccctagtgagtgtatagcagcaggagcgctgtttggttttaaccaaacaaattatgtgatacagatttcaccaatctgtaaaaatcatcagcaaattactggtgtgtgaatttctttggacttgtgattttgcttatgtgtagtttgtaagtctgatggtttgttgtagtagagtggtatgaacacaaggcgtttctacccagctgtacatttgtgtgtatgtcttggggcctgtgagaccttttgctgtgtccagtgcttcctcgtgcttcccagatttgaaggcagcccttcggccattcctcagttagacagtcacagggctggtgtcatatgtgaagggagaacatgggcctcagaatcagactgactgtgacctgggacacatgacttcactttcattgctttcctgatctgaaaatgtgataatgacctgtacattttgggatcattgtgagtatcgagtaagattattcctgtaatcttgcatggtgcttgacatgcagtagcttgctgagatatagtgcaataattttctgatttcatattcacccttctattttccttcaattactttccttttgacatgatttctagaggcagatcacattgttttcttctgcatgctttctagattgtctgggtccggcacagttcaacaggaacgtgacctgagcagctgtgagtgatttgagtattattgctggggtcgcccctccctgcccttttttttttaaacaaacaaacaaacaaacaattgtagtaacaaggtgagttcataagattcatttgcaatgaaactttccactaaacgtgtgtaggagaaataagaagcagcagcagttcttgctgctgtcattgcaagtcctgcacagtgacattaatcttagaatgtctctcggtggctgttgcttttattacttgaactgtatttaatactaattatgttctagaacattctgccttctttagaatgatttttggttgctaaatattaacagataaaccactcttactccttgttgtccactaatgaaatgatacgaagatttttaattgattcattcataaatactcacataagaagatactttcttcctctaggaacgaaacaagtagagtttctcttttttagggacctgtgttgaaaggggaccttatttttatgtgaactttctttatctcacagataaacatgaggctctttggtaaaaatgctaaaataactggttaataagtcacatttcccaaagaacagtgtctcttaggtggtggaagggcttgggggcccttctccagtaggcagctgtttattaggtgctcataaataggacccaggtttggggatgtttacaagtcactgctgtcttaatgatgactggcttttaacttgataaaaatagatggattgaaatgctgtgcactcccagcccagtccatttgccattttcattacttaggaagccgctgggtgggagcagtttgatcacagaggaaggcgaatagttaatccttctgtaaactgtgcaagctcagcgtagcttttggttttgttgttctcccgcttattcctgttgttaagcctggagtcattcaggattccttttaagcttctttcaagtagaggggctttgtagttcgtgtgcatactgtgtaaggccatgttaggagaaagacaggcttcaagggaatttatcttgatatggtgaagactgatggttacagtgcggtctaccaaacagcaactagtaaaacaaataaaacatattgccaccgttttacaatctcctgtctttggtgtacggcagcagaatatgtgaatctggagtagaatgccttactgggcagcaggcttcctttgcagagctcttggcctccgggcacctgcctcttcctgcttaggctgccctcaccccagtgcctccagggccctggagtttctgtggaatggaatctcgagggattgcaaaccccattagagcccaaggaagtctagaatgcttaatttccatgacaggagactttaggagatgtttctgggagtcccatttgcctctaggtttcatgaaggaggtcagaaaacaggtgatgtttctgcccgtgatgttacccggattgtaacccacgacctaattgggatgtggaggagaagtgatggcatgaggagtatttgaaatcatttcaatttacatccctatgagatagttattagaagttcatcacatcgttcctaatcagttttcagcatttgggtgataaactaagctgctggatctgttttctcctcctggctttagacactgtgctcctctgactgtgagccgccttctgattgggtcctactgctgggctctaaccatacaggcatttttttggggtgttgatgtgatacaccctcttactgatgtagatgtcatatgtactttgcatttgtaaaacgtgggaagctagttagtctgatagtctgaatcaagatatagaagggaatggggtgtgtgagtgtgagttagttgggagggggaaggagggcagggttaggggagtgagcctatgtaagagcatgaaattggttttaattttgaattaattttatttgcattacttaatgatagcaattggttttccaggtttttaatttagactagttttttggggggataattatccaaagcagaaaaatgtcaaatgtcttttctaccctaaggtacatttatgtttggggaaaaccacatatgcgtattgagtaccataaggtcctaggtatatttccaaaaaagaccttgtaggcagtcgttacctggttactgtctggtgcaggcatcagcagcctgcatagactgtcagagacccctgtgtaacagtgagggttgcagttgttccttactgtagggccattcggaagcttctatcactgaagttgtaaccaagtgcgactaagtatttttttaacctgtgtttaaggacaccttaactcttgttgctcattctttattgcagatttgcattgtatgtgtttcccatgtagtcagtggttgagatttaatacaattagaagctggcactttttttttttaagtgcaataatgtggagaggaagaacatagtgactcccagcactgccttgacgtgtgtcagaggccagcagtgttaagccagcgttgctaccacataaaggcttagtacagttgtggaactagattaaaaccacagagcctgccagaagggtgccaagaactcccagggacgggtggatggtatggaaaaccactgagatagcttcagggccagggatagggtaaagggaataaaatggaacataagaaagttctcatcattgccagccatgctagtggggggtcattttcagcacctggggtgctgggagtcctggggtaactgccgtccacaggtctcagactgtccccagtctgggttttgttgcaggctgtcagggttttgtactcacccgatgctccctggagacctttgctcgcaggagtgactggaggagttcatgtaatcaattaatgcaccaaagtcaggagaaatgggcatggtgaccgttgttttcctgaaaagaagacgggatgcaaaaccattaatacaaaattgaaatcttaacaggttttgcaggttgaacatgaagcgtgtatagcctgggtctcttcctttatggtacaagggagggacgagaaggagctgagcacagtgtgctccttcccctgcctccgcacgtgtccagcaggggagggaagctgggtctgtggcacccagtgggactctgaccaggcagagtggcaagagatgtaacccgtcttcagccatgttttctttctctgcagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgaggtaacttcccccgtgtggctagacccactaaacaagttggtgtggtttactaaaagctattgaggctaatgagagattttttttttaaaccacatattaaacaggagctgcatatcttacgaacatgtgatacgtaaaattagttactgcatgaaataacagagctgcgttcatcatccgagtggattgttttacccacatgggcttaggtttcagttcccttgggttgggtgatgggctgttgagttgtgaggccttggcagagaagcttgctggctgccttatatttcacttgacaaacagctttaccaggcagcactgtggctttgcacagttacagattcattctccttgcctcagccctggagatgagggaatgttagggagaaatgcccaacttcagagtccctaagtttcatcctgtcatggataatggaaagaatgcatgtattaggcctctgatttctgaaaatggagatagtgtgttaaaaactgtgcagagtcctgaattcagttaggcatggaagattgccgtctttcagtggtaaaaacaagacaaaaccctcagcccactaattattttgcttcccactgtaacctcctctccttaagctaccaaggttctgacaaggccttcggtgcagttagtttaatgagatgattatgggaggaaagtcttcctgccagcatgaaacttgattcttgctccatttggaataagattttaatattttctaataagaaatactttttggttgaatagattgcttcctctggcaaatctgctcaaacgttaggtttcagtggatgtattcatgtattttaaggtaaacagcaataatattaaacatcagacagtgttaatccttaatcttcaggttataatgctatacttttcaaagtgtttgcacaggtgtattacttggatttttaaattctttccatagtactcatttttctatccaaaatatgaacttagttttaaatttgaaactactcaggtttactacactccatcagaaagatgaacccagtaagcctttatcttcatagagaataggaagtaattttggaggacagtttattgggtgttaattattttcttgatgcagaattgaaagtgcattgtatttaattataagtgttttaagtaaaaataatggtctggcaatacaattcatacaggtttttccagtccagttttgatctctccctcagggctcttaaaggcaccagtttttctatggaacttgttacattgttaccagcctctctctccccacccagtgattgcctctgtggagattattaaaagtccagcagggccgggtgtggtggctcacgcctgtaatcctagcactttgggaggccgaggcgggcggaccacgaggtcaggagattgagaccatcctggctaacacggtgaaaccccatctctactaaaatacaaaaaattagccgggcgtggtggcaggcacctgtagtcccagctacttgggaggctgaggcaggagaatggcgtgaacctgggaggcagagcttgcagtgagccgagattgtgccgctgcactccagcctgggcaacagagcgagattccgcctcaaaaaaaaaaaaagtccagcaaacgagagaggaatgggcctatggtaggattgtaggcataagtgctggatcaggagtcatccctcttctacctctgctgccttctgatgtttcttttgccaaccagcacgccggaccagcccttcttgttttctcttttggttctaggtcacaactctttctccttcacctttgtctttgcatttaatcttccccctccatgttttccttgaggcatattaatattaatctgcttcacatcatgataaggtgaggttaagatttcttgccgaggccaggcacagtggctcatgcctgtaatcccagcactttgagattctaagggaggaggactgcttgaggctgggagttcgagcccagcctgagaaacttagcaagagcctgtctctatattttgttttaaaaattagccaggtgtggccgggcgcggtggctcatgcctgtaatcccagcactttggaaggccgaggcgggcggatcacaaggtcaggagttcgagacaacctggccaacatggtgaaactccatctctactaaaaatacaaaaattagctgagcgtggtgtaagtcacctgtaatcccagctactcgggaggctgaggcaggagaatcacttgaaatcggaaggtgtaggttgcagtgagctgaggttgcaccactgcactgcagcatgggcaacaagagcaaaaccctgtctcaaaaaacaaacaaacaaaaatcaccaggtgtggtggcacacgtgtaattccagctactcaagaggcttaagatgggaggatggcttgagcccaggaatttaagcttacagcatgtaatcatcgccacactccagtctggaagacagagcatgaccctttttttccttttttaaaaaaaaaggtcgtgtgcgatgtcgcatgcctgtaatcccagcactttgggaggctgaagtgggtggatcatttgagatcaggaatttgaaaccagcgtgaccaacatggtgaaaccccgtctctactaaaaatacaaaagaattagcctggtgtggtggtgggcacctgtagtcccagctactcgggaggctgaggcaggagatcacttgaacctgggaggcagaggttgcagtaagctgagactgcgccactgcactccagcctgggtgacagagcaagactccatctcaaaaaaaaataataataataaatataaagatttcttgcttagactgtaattgactaaaactttgtcactgttaaattgcaatgtagtacagattatatacaactctaggactgttcagaatcacagcagattattgcaatgaataaaacattgcctctatccttagctctgtcaaatgagcctctgccagctttcttgccaactcttgaatattttctaaatttttataaattcattcatatcccatcatctgttatttgatgggcagtggggttaggcttaggcaagatgaatgatagggtggtctggttggagcggcattcatcgtttaataggcagcccacacgtaattgaatttagagtgatgttacacttaaaagggttttgatgcccttgagcaagacgtttgtgtaatagcaagtagtagaaaacctccacagagtttctggcatggatgaaaaagaatggggagaagaatgcattgatgtaagtgaaatttctgaattgtttgctctgaacttgcaatttaacctgtttcctagtttaatgtgtctgttatagtgggttaatctccatcttcttggaaagaaatctcatttctttagctctcatgaaatacacgattctacagttttgggtattccagctgacatatatgtgttgctataatggatttgtctttcattgtactgataatgcttctttcatctacatttatttttatggggccagaaccaggtatgttatgttttctataaatagattactttaactttgaaaacctgtgactgagcattgcaaattgcattatgttaaaactatataaaattggttcatcttctcatacgtgattttttttcccttaagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaaggtaaagacgggggaggctaatgcctcagtggacatgggggaagccagcgctggtgggttcgggtggaaggaaagagaaaaggtggagaatggtaaggctatactcaccgtgtgtgctctaaaccagcgagagtcatttcagaaatggcactgaaatctgttttccggttttactcgttgtgcaatacagtgctgttttagaaattttgagttcaaattacttattctttggtctaggatgcctgtaagataggaatgatattttcacttaaaagagtgaacatttcggccgtgctcacgcctgtaatcccagccctttgggaggccgaggtgggctgatcacctgaggtcaggagattgagaccagtctggccaacatagtgaaaccccgtctctactaaaaatacgaaaattagccgggtgtggtggcacgcgcctgtaatcccagctactcaggaggctgaggcaggagaatcgcttgaacccatgaggcagaggttgcagtgagccaagatcgtgccattgcatttcagcctgggcgacagagtgagactccgtcttaaaaaaaaaaaaaaaaaagtgaaaatttcacagggttatgttattgacaaaacaccattccaatctattgagtatgttttttaaaatcaagatgagtaatgtgttaaaagtaacagtttctgggtaatatagttggtaatcacctctagtctcatgttttattcttatgcaccaggcagaccaactggtcaaagtgaatccttatcaattactggctaattgaatcttagcaatgtggaaactgggcacttacccataggtatgtgttgcaagccatgaacatgggtgaattaatcattgagttttattggagctcattgaattttatattacatggacaggagaatattttgtaaagtaaaaaaccacattagaattcttggatgtaaaaggacttttcaaaaggtgataatccagtgtttttattactaaagcttttaatgtatctgtcagtgttcttttgttttaagtagcaccttgtctaagagactggaataccttcttttcaattactggaagaccaggttactgtcactgggattctggttcaagtcatggtagcaatgctaattgatgatagtcatctatattttcttaaatgttttcattgcaaatgtcttaattgacatccttgtccaagtaacatctatattgaaccttaagggagatgtcatagttagtttttcccaccttttttatagtaaattttatgtttttgcaatctgcacaggtgtctatgtacttcttgatcaaacagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactgggctgagagtcagaggatcagagtttttaatcagcctgggggattagagtaactctctttacttatctgcttcttaattccttctctgtaagaggaacacatcagataagattttctggtaggtcctgcaagttcagaactgctgacttgttcttcgaagtaaagactcttctgagagaatcagacagcgcttgaagttgtccagggaaggaagttgccctttcttggtactgccccatctgtgggcttgtgtcagtaatttctctttctggagtgattgcgggttgtctttttccttccggtagatgtttgactggatcacacacaacaaaggcctgtttctaaacagctacacagagattgggaccagccaccctcatgccatggagcttcagacgcagcacaatcactttgccatgaactgtatggtaagacactcggaacagctggaccctggcatgtgacagtgttttagcaaatgggaggcatttggcaaattgtatgctagggctttcaaggggccttcggagtggctgttgattgtagcagctgaccttcacatggagggtgttccctagggttccattgtctcactatcccacattttaagttttaaacaaaaatgaaaacaagcaaacagacgaaccagtgaaacttgaaccaatgacttggctagttcagcacagacacttgggatgctggctcctgtgctgcacttcataggagcccacgggggccccagcaaagctgctgggaggcacagtgagtcccccagacggagcgctgtcagtttgctggctgctgttcatgacagcgaaaggagcaagcctgctgctgacctcagggcactagctagttctcctgaggcatgagatttccttccaagctgagctggaggactgggatctggccctcagccttgcctgggatcccctggccctctttaaggttgttgcatctgctacccttggctgtcgtgactgtcaggatcttagaggccagatagggggtgactgtaggactacatcacagaaaccaaaaccaaaccaaaacactgaattttgagtagcacttctgttacagttttatagttaatgttactaaaactgtatgttctataggacatttgcttgcctctgtagtctgtgaagcttctagaaatttcctcttcagggacaaggagttttggtttggactttaagccagccttgtgaggattgtccactcttaaaccttgtaacgtttgttgtagagcattaaagcaatatgaaccggcctgggcaacacagcaagaccccatctctaaaaaaaaaaaaataattaaaaaattagccaagtgtggtggtgcacacctgtagtcccagctatttgggaggctgaggctggaggattgcttgagcccaggagttgcaggcaacagtgagttatgatcacgccactgcattccagcttgggtgacagagcaagaccttgtctcaaaaacaaaaatacaaataaagcaatatgaagacagggtttttgtttaagttaattcagaaagatgccatttaattaaaatacagtcaactaggtgctacaatttaggtagtttcaaagataagattttgcaatataatttttagtaataaatgccatcaaagttttacgtctgttctagaatttaaagtaagagaatttctggttcgaatcgtcaaacctgggcatagataaaaatttgtttgtaaaaaattactgtcagtttttttagaattttctgaaacttttggcaagagaccattcagtctgctatgccacatactttaaaaactagaaatactaaaatatgtgctagaaatgaacagaaaaatatattctctcttccccctttcttcagcattattagtggcagatttaggactcaagggaataggaaccatagtgtagaagacaggaaaatgggttgtggacgtagaggcttttaattctgactttcttatttgccatgtgaccttgggaaggctgtttaacctcttcgagcctcagtttcctaatctgtaaactgggggtaatacctgccttccatggtattacatgtatatgtaaaatgcaaaacatactgcttgacatatagtaagtactgtataaatgttaattcttaccagtgatgttatcaatataattaaagatgcagttaaagcaggtaagaaacttaaaagtatgagttacagctattttttttgggaggggggtcgaatatattttctaattttctacaatatacttctgttacttttctaagttaaacttgtaatacaatgcatgcgggtagctcggtgccatgaaggtgatgcctgctggggagctttctggaccaggcctgctccttgtgttgaatacctccacgaatcccttgtatctgtggcatttaataatgcagggcaagggtatttaaccttcagccccttctgctcgctatagtgttttgaacaatttctgacaaaataaggatactaaataccaatatgccaagttaacagcttttaaagaaagcatattaagggataccaacaattatgcatgttctactctaacagatatttataaaaactatgatgataagcctgtaggtgtaggtacttttaatttagggaattgcacattaccatattgatgtccaggctgtagatttaggctgtatgccaccatactcgtttatgtgtgctagaagtgatggagagatggaaaaagcatcatacatagactagtaaagtctgtttttatataaaagtgacacaggaagctgttacaatctaggaatgggcaggtatggtcagtggttgtcacaatagagccacccaaggagacatctcttctccagatcctaacagagtgcatcttgtgcttttcctaacagacctgtcggactggctttttctcttttaaggatatagagaaagcaaaattagcaaatctagtttcttgtcactttactaggagggaggaaaagagagaaagaatgcacttgggaatgggaggccttgcttttaatttaccagatgccagttagagcgttaatgccacacgagccagagaggtcaccttgctgagcatggcttgactgttgcagcctctttctgcgactccagacatgcgatgtctgttagctgattctagccttcagatgcagcccggagatgtaaccctgaggctggagtcctgtggctctaatcccagacagaggcaactccaccaagttctggtttgggtcagaaatagagggaaaggatgaatgaaagaagatacaaagaaataatgaacaagtgagttctttcagctgcttacttgggtggtctgcaggcagcaagagacaggaaggaggctgttgtggggtccttgttcgaggcagtgggagatttgctcagaggggttgtgtgggaagtgagagaagggggaaaaacgtagggaagtttggacagatcaggaaatcagattggggcaacgttgagaggagccaaagaggtatctacgattttgggggacccatgggaaggagtgatgtggtaacagtgaaaaaaataaaaaatacatgaacaacagcaacttcggatttgctgaaggtctgaatcccgcaccacaccacaccctgcgatactgagccttaaagaactttggaggtggaaagggaaactccatatgagagcttgttctgcaaaaagggtgggtttttaaaatccctatttttgcaataaactgatagacttgaagataggaattttgacagagtagaaaagctttatttaaaatttgagcatagcgttgttgtgtttttactgcaattcatattcctgggagaaggtggatctatttacagaatattttctgttggcacccaaaaatgacttgggcatatgtagaaaggagagcttgctttcacacaaatagcctttggttgctaggtacgtgtttttgggtttctgggttctggttaaaaaccagagcgctgggtccctcagttctctgtgactgcctggcagcaggcttgccatctggaccctgttcagtatttgaagccaagaagtgagtaatagtatatttgtgtgcacccacttgtgtatttgattgctttgtgctgaacaattatgcctttcagctagttgatttgtaattttacagttttaaaaatagaaatggaaaccaatacttcaagtttatggaaatctagagagcaaatatgtataatattatatatatcaggtgatgctcctgggagagatgtgatcactgttagaagcctgtgtttcagcaggtggcatctgggcttcttagaagggagcctcctatttgctctcccctaaggagccctcttttcctgcccactttccagaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaaggtcagtgccttgaacccccagcccacgaggtggtaaccagaatagttcttcctccatgaatattggtgtgtgtgcaaacactcttgtgtagcacatactgtgagctccgcatgtgagctctgaagtcacttggccctgagtttaaattccagctcttttagtccttgctgcgtaaccttaggcaagtgacttagcctctctgttttgttttttcatttgtaaagtagaaataaaagtacctgtttgagtggactgttgatgtaaatgtgatgctaggtgccctacacagtgcccggcacagtaagcactaagaagtggcagctgctcttctcttcccctcctctcctggctccttctttgctcttattccttgttgatagtgctttattactccaattgggatggtttggtagcaaggaacggaacgcccatccgtggtgcagatgtcaagggtttagttttctcacaaactgcgaagttctaaggcgaaggcacctctagctgcacggctatggaggggtggtgtctgctgccctcaggcttgctgggcctcccctcacagtcagggcagcacacctcagctccacgcaccagctcctcctcagccacagtgctcaccctccgcagggatggctgtagctgtctttgcctgccactttataagggaaacattatttccagaggccccgcccccagcacatttcccctcggctagtcttggggtgcacatccatgccttgctgcaaggggtgggggaaagggtggatctggtgtttagcctccttagggaggtgctgcccgcaagggtgagggaggaaaatggcttttttgggtacacagttgacagtgtctttcataattataaacttagctacatggcatctgactttggcttcatttgttgacagatgtgttgtgtcaaaatttctagtttaagaagtaatgggtaatatatgcccccaacactccccatacctccatttaagcaaacttgcttaaacaaacgctctgaaagtagcaaaatgaaagggatttgctcatgactcagagtttattatcggaaggtgagcagcacagtgagtaccttttcaggatgtagagaaagggcataggaacttttaaccaccaggaagacacatatatggggtagaggaaaatggttgcttaatttaaaaaggaaaaatatcagtatatcttcctcagggttaatttttgggggaaagactggattcaggcatttgcacggatgcttcttaaaaaggaaatagtatctctttcatctagaaacagtctctgttgaagagtgaagaagtcagtaaaggaagatagaggccccaacttgcctaggattttggcagggcagtcagaatgttgcacaagacactaattagcagtgatctcaactctagagacctttaaagtataaagcaagagaggaagctgagtgatttataaagagaaacaaaccttcatagcaccatgtaaaagctgagagtttcaatggtaaggatttttctactttctaactttttgcatttgactaattttgtgataaaagatagacaaaagcccacacacaaaaacaactttttaaagtaacaggaactgcttcagcgtaaataaaaccatcttcatgaccctgtagccatctccgatccttatcgttgtacaaagtagcaataccctcgatcatttggcagtaaggtgatatgaatgaatttgaagcaggataaactgcgtgggtgaatgtcaggctgaagcataacacacagagaacatctttcataaacatgatgagattcagaattgtaaataaacccagagattaattaccactgtgacctgcctgaaaataatctagaaacatgggtgtcatggggcattttccttccagtgttttattataaaaaattttaaacatacagcaaaattgaaagagcctggggtattctcatctggataaaatgaatgagtgtaatttatggatttgaaggaaatgaaactaggtgaacacattattgaacagaatttcatgggaccctgcatgaactgtaagggcgcctgaagtctcagtgcatgtacggtggccagagaagaagccaaataggagtgaagggacagtagcctaatgaagaaggagcccagcgtgtattccagaccttaacgaagcaacaaggcctgcacgtagacaactgaaatgcacagatgggagattaggacgtcttcagaaagacagtccttacttgcaagtaaaaatgtgttgtgtctcgtccccctcactgaagaaaagtaagatccttgaaattctgatgctcctcactaaagtagttttcttttcccaagagagcaatcccaagactaggtcaacgttgttccctcattttaaatgatttgccttctagttatgctcaacctgttttcataaactcagtctggaaaggaccagaagcttggacatcctaagttaagtttccatcatagtcacctctttgaatcacatccagagtgttcatgtggaatttaaatctgattagggggacataaggctcaaatatgtgactccatggttaatgagcttactaacggcagccgccttctctgtaaggattacagctcttagctgcaccgtccggccctgccctctctctccatgggtggtgttgtgctagcatttgctgtggctttataaacataactctgaagttaaagctagatgagaatgatgtttcatagatgctataacttccatagatgtgtcagccagtctgttttgtgtcatctccagtgaaggttgtgggatcacagtatccgtttgcaaatatgtggacacacaaccacagtgttaatgttgttactggtagatgttgcttaggggctccagccttcgcttgtcttggtcatgtggtatatccacaggacagaccctttatattaagacgctttcacagcagataccattagaattaacatttttataaaacaaagtgacttgattttgctacagcttaaaatatctttttactgtgacctcaagctgcactgcccattgtgatggcctgtcaccatgtgtggctattgaagctactcagagttaaatagcaagatgataaaatcattttaaaaaatagaattaaattaaaatgtagttgcttattcactgtatcgggagcaacatgtggccaatggctgctgtaattgacagcacagatacacatttctatccactcgggtagtgcttgcagaggcttacctgcagagtgaaccacacatccgatcaccttaatttatctatgactttaggccttctgtactttgataataaccaaaaataaagtaacagtgtttgtatagttctttaatatttagagaaccctttaacatgaaatctcatttcatccttaaatcagcctggtggagcagatgggactgtagtattattgtcctgataatctgtatggggagggatttggccatgtttcccaagctagaactttcgctgaggtctatggctaggtctttcagttcctgacataataacaaactgtttcacacttgcattaatattcttataaaagttcacttcccataaatatttttagaattaacatttattataaacatgacatagatgcaagttctaaatctaggaaatttccgtccctttgtctcctaagtccagcttagtgcctgtgctcagctgaggctccgtcaagaggtggcgggggtgagagatggatgggagtgcagttcactagcttcaaggatcccagctctggttggtgggacccagaataggcagaagaaatgagtggctcccagattggaggccccctctcagcagacagggagtagtagagtaaatgcttaggaaaagcaatctgttaattatttatccaagttctcctcttaaaagctatgtatatgaatcactgttcccctcctctgcttgcctctgttttgcaaactgggtgatccaggcttccttcatcatttattcagcaacactttcttaatacgaccattctgctcagcttcaggatccccagatctgaagcaggctcctgatctgaactgacagagcaacatttcattctttcgcactctcctgcctttatccccagtcccccagatgctttgtgttcacgtattttgatctagggagcacttaaagcatcagatactaagacagctgctctgatctcattagactgcagtagccaccttctgtcctcatctcctaagtgtcaggctctgtgctagacatgttcccccagcattgcagtcccaacctgggttactcaggatggtaacacatatgtgtgtgtatgtgtatcagagtgagggaagtaccagtcccccctcgtatgatatcattgtcatattagaagcttttctaagaggttctgttatgaaggtacctgttgaatttcgacaccaaacttgacctcaggatgctttttctttgtggagtatctgttgacaccctgttccctgttccatgcatctcggaacggggattgctgtgctggtgctgttggtttcacaccctctgggcgttcagccttttggaaaacaatcaggcctagagcttggtctgtggagtctagggttgtgtcttagaaataaagaacagaaaaatgatgctgtgcaaaaccctctgtaaaaccatggctaggattatttctatcatgggctgttattaacccagaaaaagggcagaatcctttgtccacaaggttttcatgtagcacaccatccttccctggctatatgttttcagagaagtataatcagtgccctctcaggatactttaagaaattataagttagttctaattacaggaatatgtaaaacttcttgaatgttttttctttattggttgttgcttcaaaaattggagtccaatatactttaatgattttgatatagtgatatgttaatctgatgcttctgttcattacattatgaagtattatataactgaaatgtgtttccaccatgttctgtcagaagcgttttgatcttaagaatacgttgcaactcctcttggttttgggtgttctgcagtggccattgtccaggagcgcttaattgctgacttagacctgatgatttattaatgatgatggttaacctcaatcaatttgtgtttgaaaaacaataatttaataattggtattaaatgcaatacaggaagatgatagagtgaaacagagctcaaaaatactgacaatcatctgacctgaccaaattgacatttatagaacatgacacccaagaaatactcagttgacacttaatgccgtatgaactggcttcaagccgtaaggtctgcatagatatttttctgcactcaacaataaaaggatttccataaacagttattatttgggtgacttgtctattttaatgtcctaaaaataaactgggagtttgttcttactatattttaagggaattatagcacatttctttctggtcagttgagtattgcatttcaaatagtcatcctctgcattccctgctaagttaaaagatgtgtgaggaacaggagtaaagaggttaaaaccgagggaaatgtgttgatgtctgtttggcttaattgaattagcttttttaattgggccttccgcacttgcctttcactcttaactgtgatggatttcgataggatctccctaggaaatttggcagtgatttctcagctgttgatgatcctggagatggagggtgtcagtggaggagattgagccagggttgggatggctgccgcaggaccgttgatgatcctggagatggggggtgtcagtggaggagattgagccgggattgggatggctgccgcaggaccgttgatgatcctggagatggggggtgtcagtggaggagattgagccagggttgggatggctgccgcaggactgttgatgatcctggagatggggggtgtcagtggaggagattgagccaggattgggatggctgccgcaggactgttgatgatcctggagatggagggtggcagtggaggagattgagccaggattgggatggctgccacaggactgttgatgatcctggagatggagggggcagtggaggagattgaaccaggattgggatggcagctgcaggaattgatgatcctggagatggagggtggcagtggaggagattgagccaggattgggatggctgctgcagaactgttgatgatcctggagatggagggtggcagtggaggagattgagccagggttgggatggcagcctcagggctgttcgcatggctcaggcttttctcatttgcctgcaaattgggaaggatgggaatgatgcccctgcctccttaagcctttcctaagattcacagagaagttcaggcccctttttcttggtctccttttaattctggtgtcaatttcctttgaaacagtagcggaatggactggctgctcttccttatttcacataaatgatttttagatacctggaactttttcattacatctcaatgaaaaaggaaaggagtaaggctgacgtgtagctgcaaggagaaggagcatcctgctattgagccctagttaaggggcacgtggaggagtcatctttctgtcctcccttgctaggagtgcagggcagttagaaacgtggattcaaaggtggactgggagaatttactagaatgcccaaaacagggctgcattgctctaggggcacacccagacctgggcagcagtcagttgaggcattcatctgaaatgtggattcctcggactcaccccagtcctgctggaactcactctgggattggagtccaggagtctcatgtgagttgaggatgccatttgagatggagagtcaaccatgttaaattcttaggatctccctcaagtcccctaattttcaaaaccatgttaaaaaatgtccacttctcaatataaattgtcattgatagaaataatctttttttaaccttccaagtatatgagcaacgtggattcatggtgtaaagcttgcggtgaggtagaccttccctcagagctgcaggacctagaagatgccattcatcaccaccagggaatatatgaacatatcactcttgcttattctgaggtaagtggccagttttacttacattgcaaagcagcatcatttttgcatcatagtacaccggaagctagaaaaaaaaaagttttgggtagcccagaaaaagtttatagatttcgagttagactgcagtttaattgtttagcatttgaacccctgtgtgtgtggggagtggggtggggcagtaggggaagcagaatggtgtgcaggcagtagcctttccgatagagcgcttatatgctcagctgctacagtcaaggaaaacctagtctttttttctacatgtatttaagaaatgtgtattttgtgtgctcttcagtctagtcaaactcaatttaatcttcccaaatgaaaccttttagagaagatgggctagattgcaaggcacacatgtgtctattttagaaatctaagtgtaacattttctttattactttagggtgtattacattatttacttagtgaatccctgttttattttctgccaccttctatgccagactgtattgtaaggactttatgtaatgactgacttaatgctcacgtactgtatctgttcctgctgttcctgctgaagaaaatgagtcacagagataaatgactgcgccaggtcagcagctagtggagcagggttagcccaggcaggcaggctgcatgttctcagtcaccaccctctgcggcctctgtgccataccacgtggtagctgcttgatgatgcaactttagatgggttgacgagtaccacccttgcccatgccttgttcctctggcccttgagaccagcctacctttgtgataatagttacgttcctggaggtgaaggcgaggggtgtagagaggaattctgtgtccttacttttctgcaaggttttctccctgagtaagaagcatctatatctacagtgttctatgttaatatgaaagattatcgcaaggcttctgtaagagtttcacagcacctggaagagtgctggacagtgtagatgtttaataaatgctttctgtgtttaaatctaaatcttgatccaaacacatccaaacttgtcaaagttgttgggaagaaagtggccatttgcatttcattctgatatttcctgttgtgcttcactgcccagctgtcactctcatatccttgggcctgcctgtcttgacatcctagtgtccctgagcgaattaaatggacatgtgatttgctgctacagttttgtgtctcataaagatgttttggtcagtgatggactgcaaataagacagtggtcctataagattataatattgtattttactgtactttttctatgtttagatacacaaatacttagcattgtggtacagttgcctacagtattcagtatagtaacatgctgtacaggtttgtagcctggagcagtgggctgctccctatagcctaggtgtgcagtaggctgcatcgtctagctttgtgaaagtctacattgtgatgttcacacaaggacgaaattgcctaatgattcatttctcaaaatgtgtccctgataccacgtgatgtctaactgtatatttgcttcagaatgtgggcagtccttctctttcccgtggcagttggtatttgtttgtttctttagccacctttgcctaataagatacagttttttcaagtaacatttcgtgttggctatggaattaagaaagtcaactctgtattgtttcttaattttgcaccaatgtttcttaactaatttggttgtctagtctgttagaaactatttaaataagtgatagccttttctatagtaaaactgaaaattgaacacatttataatttttttaatcacattggctcatgaggattatgtcacttctaaaaaccatcaagttctttcccgtgatgtgccatctctatgcattgtctaattttgacctataacacagaaagcaaatgaccctgttactcacacatgtaatgaggcctccactcatctgcttatatgaatctcttgctttggagctgttctttgaatgcagtggtgggcttgcagccagctgtctgcatgcccttgcccttgccaaaccaagatgggcttgaatagccttcatttacaaggtgattggcagaccctgggaatacagtctttgtgcataacttaaatcagaatcaccttgacccagccagtgtcatcctccagccaagctggctctttcagtctgcttgttgctctcggcagttttcattaaatacagaatctcctaattgttaccagtgcattctataaaaatggggcatcttgacacaggaacttatgtttacctgtggtatagttttatttgatttacattggtaccagtatctcaaaataatttgataggaagttaaacagcctctcaaactgaggtcttagatggaattttagcctaagaacatgtttgcaactgagctgtaaactcaaggagacagtaatttgaactggatgaactgaaaggattttcagtagaacagaatgaattattttgcctcttaaattatttacattttgaaatagtttcagggctacaggaaagtggtagaatagcacagagaactcccacattgcctcgacccagattttccaagttgtagaatttcactacgttgctccaccctctctccccactgcctctctctccagtcagcaaagcaccattgatacaacatgaccatcatctccacagccactgatcctatttccccaagtgttccaatgatgcccctttctcttctggtctggggcactgtccagcaatgtgcgctacatttaattgccatgtcttaccaatcagtctcctttaaaatggaacgttctttagtctttctctgcctttatgtctttgacatacttaaagagtacaggcctttctttctttagatggccctctacttctggttgcccccagttctcgtgggctgactcaggctgtgcctttttggcagtgcatgtccttctctgggtgtcatcacagtggacagaggatacatgacactcctacgcactactagaccacgccgtttcattctgtccatctcagtctcatgcacatgtcattcacccgagtccatccatccatccttccatccaaccatccatccctctatttatccaatccccatccattattccatccaaccaattacccagccacccatccgtccatccatccaccctcccaacctccatccatttatccatccatccacctaatcacccaaccacccattcatctgtccatttatccaatcattcattcattgatgcgttcattcatccattcatccaaccagtcacccaaccacccattcatcatccatccatccatccatccatccatccatccattcattctcctaatcacccaaccacccattcatttggtccatccatccatccatccatccatccatccatccatccaattacccatccattcatctatccaaccaaccacccatcctacagccatccacctacatttatcaatctacccatctacccatatccatccatctgccgtatcactaaattgcccatccattgactcagtcacccaaccacccatccacatttgtctagtccatctgtccatccacccagtcacccaaccacctatccatacacccagtcacccaactgtccatcgccacctcatcacccaaccatccatccacccacgcagtcacccagccactcagccactcattcatttatctatctacccaccacttacccacccacccacccatccacacatttatctacacatgcacatacacatccatataaaattactgctgtatctatctgtgtctatctgtattaaaaatacatgtgtttgtgcatttcgaatccaatacctcagggttctttccatcctttccctttctaagtttgttaatctattctcaggcagcaagaaacctggcttctattttccttaatgtattaacttacttgttcacttggtgtatttgctccatttcccaaccattctgtctgggttctccacctccaactcctaccacccactcccttaacctggcacagggacacctcttttggcacctccacccctcacttcctcattttcttcatgccaagagggaaggtgtcaggaagatgggaagggaaggactgcttttgttttgtaagtgatttttattttatattcctaaatcagtggtttgcagacttgagtgtcttggcttaaaatgcagcagtactctaccccagagatagtgaatctccattttcagaggccttccctagttctgcagtgactgatgccaatggtacacagatcacatgctgagcagcactcctgagcttgctctgaagagctgggggtctgctgaggaggtgtccatctcacagatacggagcccctgctaagtgctagacattgaactggatgccgggtcatgtggggttaggagtacttataagcagggcttgctttgcttttttttatttccttttccttgcctctctcttcctgtccttccttattccctttcttctctcctcctctcttcattttctctacaattttttttctttgaacagggtttatagtttctagtctctgatcatataaatttgctttgggaaactttcccagcatttttcttccaagacgcaagcacctgctctgctgtgctttaattagacctgcccgtgtcactcctgtttgtgctttagcaacaggaacgcacctgggcctcctgaacactcacttgcttcagcttgccagctctgagcttatcttgttggctacagttgatcacaagagagtgaagcagtgtaaacgtcggagataagttgtagtcatttttaacattttaagtaagccaactcagctaccagtttttcaacaaactgaatttataaaaatgattttcatctcagtgtgcctgtgttgcctcacaagcctcaatgccaggtgtttggattgcaaggtgagactgcatagtaagcagccacacatccaccaaagggccactgctgcagccacggagcacaagcaaggcgaagtgccatggggcgttggcctgctggatctcatgtgacttcagggcttagattctgcatccatttctcagtttaacaaatgtgccaacttagtgtgtgcctcaacagggcctcatgggaatgactgatttgctgcctgcaaagctggttgagctcctgtttaaaggcactgtatcagtgggtgatggcagggtcagtgctattagcctaagatgaaaacacacagcaaaatgagtcacctggataggaaacttcttaaaaccaaaaaaccacctctccgtgatgtgtgtggaagctcagttcccttgcggtagagtcacttcttttttggcagagtggagtcttcttctgttgcccaggctggaatgcagtggtgcgatttaggctcactgcaacctctgcctcctgggttcaagcgattcttgtgtcttagcctcctgagcagctgggattacaggtgtatgccaccaggcccggctaatttttatatttttagtagagacagggttttgccatgttggccaggctggtcttgaactcctgacttcaagtgatccgcccacctcggcctcccaaagtgctgagattacaggcgtgagccaccacgcccagctgtcacttccatcacagttgtataaagcctcattaaagatcgcagtgttgctgtagcgacatgcagtgctgtagtcagcatctgccatagtatcagagccaacagcccatatgacagctgtcttcttctcaccccaaactcagcttgaggccttgcaagcacttgaaatataagagcagcaaaagtagagcccaggtgcagcctatggaacacacatgtcaggcatatggaactgactcacgccaactgggctgctccagacgtttcctgttttggtcttattttggtttttcctttctgataatcccaggtttacaggtgtcagagagtcaaaccaaggtaaactgatctggttttgaataagaaactgaatagctgaaagaaatagaaatcatcatttggaggtccatccaataagaactttgcctggagaaggaaccagctttctctgtgttctccctgaagcatgggaaagtatctgtcgttgggaacacacatgacctttcaggaggtaattgacctgcactgttggtaggagcatcttatgtagccatctgaagacagattggaacctccttactcagaagggttcgattgtttggccaaggaatgtcaactgttgctgcagaataagctgggtggttacctgctgaccccttttcattcttttctgctttattagaaccttgatatgagaataagttcagcaagagttggagaggagagtgaaatcattcccaggcttcgtgtggaggtctgtgctttgcaggccatggcgagctaagcctgaaaaagaattaagacggtgttggctttgagtcagcagaaatagtgcaattcatttcataaaagttttgaaggaacactttttctttattacaggctaaatgtcttggtgtattttgcctgtttttgttgtatcttgggaatgccattttctagcactttttagatctaaaacactgcgtttggacctaattgatatgctgtcactcatctttatttggtctttgggcagttgttgcttttgcagtggtaagcaagaatgtctagatgctattgtctttccttaggtcagagccacgttcatcccttgtgcaggtgaagaatattcctgctggaaacgctcagccctcatctgattttacaggaaacgtagagatcccagtaccagaaacaagaataggcaaatctctgaagttttatggctctttttaagggtgacatgcagaaatccaagttacaagtctatgtgcagttctgatgaacagtaaatattcaagaagcagcccattgttctacattttaaatagttacactaccttttaaatattaggaacaaacatatctttgatatggtaaaattttaaacttacctttaattactttttctgctttagttagtacttgcatttttctgaactcatttggatatcagagcattttagtttctctttataaaatgttaatctttgtaatactggtaactttcgatttggccccctcgtccaaggaattcccccaggctggtggtagtttccaagaaaagaacacaagaagcacgaactggaaacaactgaagcttgatctgatcggttcaaaaattattataggaaagtcctgctatttaataaggttgattttctttttgcagctgttgtctctttgtggctcagagtttcagtgcctggaagctgaaaacagagttttaaacaaaatgtataactgaagtaaattcactcacctggttcagtagttaagaaactgtggaactacactacatgccataaacttacattacttgttttagcacttacattttatatgaatttttttgtctgctctatatagtctcttctttcattaattttctcctggttattctgtaccatttaaaaattattatctctatacaacagaacagcagtcctcataaaattgtagcatgttgtttccacataatattactgtaattacaaagactaagacattttgccaaaagtgaaaactatatatgccatcctttatgtgcttaaatcatactttttaattgccaaatctacaaaacttgtactgaaataatatagaatcatatttggaaaggtttattggcgaaatgctgtttttgaacatggatttggagttccatgctgtctggttttaaagtgggtccaagaggtgttatctcgcccagggtctttactgccgctgtcactatcagtaaatgacagtaccagtggtgggaccaacagacacattaatccctgcttatgaattctcagaaggtggagctttccttaatgagttgttttatgttaaggtatttgtgtattgactttctcagcagacatttcccactacccctccaccgccatgagcaagtgtgtccttcgaaatccagtcatgatctctggcatggagatctgttaaacagttgcagagacactcaaggaaagaaatattgcatggaatgttgttgcttagagtactccattctcagtagaagaatattaatggtgtcacagggatgagttttggaaacttgctgagggctgggaactcatcttgtccttttgcatttggtggtttaagttgcaaaacaatggcttaagatggaaattggctttctccctgtgtaaaagaaatccaaaggctgtcattccagggctagtgtggtagctctattagtaagaggatctgtggatccttctgtctttctgtgttgccttttttagcaggtaggctgctgttcttaagattgcctcagagtcatcaataactgctaaagctccagctatctcattcaagttcttggcggcaaggaggaggaagggacaaggggatgagcatacctgccagcttagcccctaaacagctttcctggaattcccattcaacattttttacttttgtatattggccactcatatatgtaagcaaggctgggaaatgtggcattacagctggagtgttgctgtttctgactgtaggggtttggctatcaaggagggcaagtggactttggggaagcagctgtcagtttctggcacatgttcaccaaatcataggctctggtgtacattttccaacagtaatgcaaggagtaaaatgtagaggaaatatttgtaaggaattctttttagggttaacaccatgtgaaatgtatgacttggagcagtagctctcagttctaagagatgcagcactccaatgatataacacaaattttatgacacctgctttatgatcctgaactaaaatgcatacgtagtttaatctacctttgcatataatttatatgtgtacataaaaattatatgctacattgtaagttggagacaaaggtgatttatgataaaatgtttttcagtctataaatgcctaaatacatctattgtaggtgaaaaaattagatattcagatgctggtcatatatataaaactattgtgaatatagcaactacaactgtagcctggtcatgtggcatcttggtgatgcgagtattgagaatggttttattgtggtcatgtgatattttgaaagggaaaacagctcttgtaaagttccaaagaaaaccaaacactgtctttgattaacatggttgttggatttgtgggaagatcagtatgttaaaactgggcaaaagagaaaaaccgtgtatttatgtgttaaaaacagccttgcctagatgatcacgaaaagcaggacatttcttcaccatgtgctaatatcctgctcatttcagagtaccctgcttctctgaatccaccacccaaatcaatcatggtgcctcctctcttcaaaatctttgcatcagcaatgtccacaccaatttcagtgacttctgggcacaaatgagaaccctgcttgagaagactgtttaaattttccatttttgttttaactgacactaattcagcagttaacttggttggtttttcctttattatctttggttatgtcagctgagctgatttcctcccaagttttgctgttaggctgtattaagtgaattttaaaccctgaagccttcgtaaggaataatcagcatttccaacgtctcaaattcaggtattgaaaagtaaacgtgttacaatctggcacaactgcagttagaagaggattaaaggaagcgattaggaaattctgcagggtcacttgccaccaggttttggtttaaaggctctcagtgttagcttttcccatttacctattccctgtgtgctcttttttattctaagggtttcttctaaactgggcttgtgtctgttaaaagtgcccctgaacttgctcctctttttttttttttttttgagatggagtctcactctgtcgcccaggctggagtgcagtggcacacgatctcggctcactgcaactttcatctcctggggtcaagccattctcctgcctcagcctcccgagtagctgggactacaggtgcccgccaccacgcccagctaatttttgtatttttagtagagacggggtttcaccatgttggccaggatggtctcgatctcttgaccttgtgatccgcctgcctcggcctcccaaagtgctgggattacaggcgagagacaccacacccggcctgcttactagaaactcaaagaggtttttagatttggaagtatctaagctgaaggatcatgtgaagaggccctacctacttaagacacctgcatcccacacctggttaccttatgcatctcacacacactttgtgttgtctgattgtcactttttttccccccaataacatctggcgtaattaattactcataagtcttatgaatcacttttaagtaggaaaaatacataatgtttttctttctaaattgcaccctcaccttttcttatttctttgattaacccgaatactttcatttaattgtagtttgagaataaattgccataatatagcacttgatggcattttaattaaaactaccttttaaagttaatgaaccaaatagaatggcattttaaattttcttttgtgaagttaaattgctctccagctatgtcagaaagtttaagtacatattctatgcctagtgctagattgatttttttgttttaactgaggctttaaggaacaattttgttccattgtgatgatctgctgtattctctttaacatgtctcgagataaaattattacttttaaattttaatttgcagatatcccaggaatgcagtttctgttagttgatttatggcatttaaggcaaatagtatgcctattcattgagtggtatctactacagtgttttgtagtaattaatgttcttttattttcacctagtgttttgcatcatttggctttgtgatgtcattggatagctgatggattgttttaaattttatcctatataaaactgcctctgagtaaaactgtggtgtgtgaatgaatgtctgggcatgtgtgtaatgtgtgtacatgtacgtgtgtgcctgtatgtgcacacacatgtatccaaggacagcatctgtggcacagcctaggccaaacctcagatcgtgaagaatcactcatttcttttgtgggcaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtcagtttcgcctcatgcccttctgcatgggaaatggcttgtgttgagtagagtttaaatacatcatcatattgggaagatctgtgcttaaggagtgatgactagaagataaggagaggagcttttttgttgaatgtaagtgaaaactgggcttaggaacgcgtgttcaggctgctgtcagccagtagctcctgtgcacagaacccaggagaggatgtggggcctacactgggaagttttcttctagaatcggatcattctcatttatatttatttgtgacaataatgctggtgtgctcacaccagtgtattgttataatttagttaacacttgtctgcttttccaactatgtaaacagtgaggtggtcatgcttcacttcccacgtggtaggtagtgcagtccatggtgcacagtaggtgcattataattagttatcttgttgatgaaaagtagacttttatgactattcatttctaagcagttgccatctcttttgttttaaagaaacaaaaataagagtaagtccagttccccattgttttgcttccttattatagaataagagttttaaggattaaagctatgggagtaaaatatgacatagctttagggataaataagatgatagccatgtccttgcccccaaatagagggaaagacaagggaatgaatgaggtgtcacctctggggaggaggaatcctggagtatgcagggtagcccatggcctcaggaagttggctgggaaccgccgtgataagcctgcagtagagccactctcaggatctcaggtttccatctccctgagtgtcatgtgaaggtgagtgagttttctgctgaatgggctgggaatttggagagtcgccctgtgttctgatgagactgagattctctgtatgtcattcaccatcattctcatcattcttcacttcatgtgaatctggtaaattcaaaagacgttgaatgggccaggtgcggtggctcacgcctgtaatcccagcactttgggaggctgaggtggcagatcgcttgacgccaggagtttgagaccagcctggccaacatggtgaaaccgtgtctctattaaaaatacaaaaatcaggccaggcgaggtagctcacgcctgtaatcccagcactttaggaggccaaggggggtggatcacctgaggtcaggaattcgagacgagcctgcccaacatggtgaaaccgtgtctctactcagaatacaaaaattagccaggtgtggtggcgcatgcctgtaatcccagctatttggaaggctgaggcaggagaattgcttgaacccaggaggcggaggttgcagtgggccgattattgcaccattgcactccagcctgggtgacagagcaagactccatctcaaagaaaaaaaaaaaaattagcctggcatgctggcacatgcttgtaatcccagctactcaggaggctgaggcaagagaatcacttgaacccaggaggcggaggttgcagtgggccgatatcgcaccattgcactccagcaagactctatctcaaaaaaaaaaaaaaaaaaaaaaaaaattagcctggcgtgctggcacatgcttgtaatcccagttactcaggaggctgaggcaggagaatcacttgaactggggaggcggaggttgcagtgaaccaagatcacacaactccacttcatcctgggtgacagagcaagactccatctcaaaaaaaaaaaaaaaaagactgaatggccctgtaatttttaattttcatataccgtgctttgattctaattttattttttgagttctctgaaggttacatatacagagtgcttcaggaatgatcattttgttattattcatgcttcttaacaatgttgttttagtccaagaagataattgccagagaaagaatacagtgcaggaaagaagaggctggagccagtggtgaagagggattgagaggacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccatttctcatggctcttctttctctcatctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttgatgaatgatctggaatggtctggacttgttgtgtgaacaggaaattgctctgtaggctttgacttgtgaggtaaagagtgaggctggtaagattaattaaagtaaatactgtgacaataggatgtcaaaaccaaaaacgtgtttctgaaactcaaggaattaatgacacatagggaagtttttgccatattaagcatagagtaggagaggcaagtcaagaataaatgaaagaaaaatagtagtactttagaaggacgttaccagcagaagataaatttgtaaagacagtagtaaccgaaatccataaaaacatagtaagccggttagagacacgacagtggttttcatttgattgttttgagtgatgcaaaagcacctgtaagtacattgagaaaaaggaagagcaagttactgaacaataggcgaggcatggaatgattacagttttatgaaagtaaccccagaggagtaaatgcttgtctgttgaaaaatatttgaaggagcaaatatgtctattagtgggccctgaggaactgaatggggaaggatgacagagggagtttggtttgtaaaacatggttaattttggtttcgaggttaattttttcccctcttaataagcgggggccaattcataacttctgtgtagaaggcattttggatggtagtcaggcgtggcgggaaaggtggttgaagctgctgtgtgtagcacacttaccgtgcttccaatttagagctgggcggggaattgggaagacctgctgaggactttcccagatgcacatgctggctgcctttgccattgttcacttaaaaagaaaatggaaattttttatcacatttcctaatgatcagataatatacatctctccattgccttatgtttattatcagagtaactctcagcgaaggtttggttgaatgaatgaataaatgaatagctgtgttactgctacacactgttttctagtttagagtatgctttagttttctctaggaaggtaactcatttttgctttacctgttcagatgggtagtagtagtccaaagaggatgccatcagacttgtttttctgcctcaactgttcggctggcgtggctcttcttggattgttgagattcagttactctagcatgtcaggagcagtgagtggccccatgtgtttgctttcctgaagcctactgagtcccctagaggaagcccctcagcagggatgccttctgcaaagcccccgtttcccccacagcccttcatgtgtgagcgccacccccttgcaagtgtctcttggcaggaccctccagggccatgttggaccattttttaattaatattctttaaaaaatgatcaggcaaacctagtccactctaaattcttcttgtccagtctttattctttttttctctttccaaaataccttaattgaatgtgcgatgctctgaaagtttcagggataaatatgttgacagggtccaagttccttttctcaaggaatttataatctgataagagcagattatttttagcagatagttttgtagtctactaaatttgactgtgccaggctcatctgcaacactcatgtctttggttattgtggagtataatttgctaaggcataaatttgaatcctccttgtcaaggtgctatcaggagtgaggggtggatgaaacttgcgacctcttctgtggtgtctgattgccttgcagcatacacattttgatggggcatatctacacttcagtgatttgtgcaaatttgagtgttcctgagagctttttctgaattcttctcaaacgtcaagggtctaatgcacaaggaaaaatgaaaggtcctatagtagaggggcaagtagcagctatcatattgagggctactaggaatatcttcgtggaagaggtagagtttgagcagctgtttgaaggatgaggagaaggtcagtagattgaggagtgggcaatgggaattccagcaagagtaggacagaagaggcaggacccatccaaggagcggcaagtgcctagtgtggatggagaggtatgaggtggggctggtgccagcaaggtaacatggggtcaggcacagaaaacgtggcccccacgatgagggttttgggcccctgttgaaggagctcatgcttacctgcgccgaatgccagtgcatggtgcaagggctgtgtgtgacttctgaacagcatcaagctcatcttggtgctttgtgggtgctcactgccatgtatgtgtctttcctctctgcatgctcacagctggcccattgaactttacccatttcacctcatagagttcaaagcccgaaggatctcctattctgtgccttttaacttgatgctgtaggcagtggagggtggatagcaggagtgaacctaaaggccaggaacctggttaggttcccatgtggacgcctgatatggtttggctgtgaccccacccaaatctcatcttgaattgtagttcccataattcccacttgtcatgggagggacccagtgagaggtaattgaatcgtgggggtgggtcttccctgtactgttctcgtgatagtgaataagtcttgtgaaatctgatggttttataaatgggagttcccctacacaagctctcttgcctgctgccatgtaagacatgcctttgcttctcctttgccttccaccatgattgttaggcctccctagccatgctgatctgtgactccattaaatgtttttcctttgtaaattacctagtcttggatacgtctttattagcagcatgagaacagactaatacaacgcccctgcaagtcatgggtgagtaagtcttggagagtaagaacgtgaggaccacagagacagccatcagtgtttcattcactggtgtttcccaagtgtctggaagagcagatgtcagtatttgttgaatgactgaatgagtagttgaaggaatttaaggaattccccaattttgctaattaaagattctttggggttaaaagttgcttcatttcttttaaaatgggggagggttggtcttatatctgggagatctgcctgaaggaatggaatctttgattgatgttggggaactaggggtgtccaaggaaggaagtgataatttcagtgcatgggaattttggaagtgtgagatctctcatgaggattttggtcatttgaatgcaaaatgagggtcttttatgctgaattccatctggaggagggaagttggcatatgcctaagaggcaaagcaacacatcccaggtctatagagaagtaatttcacagatttgcctcaggccccagcctatttcttcggcctgcaaaagccagctctgcaggaagcctgactcaggagctctaggtttagcatcacctacactagacctagcttttaagtgaagtttgagttcctgaactcccttgtcatctgttcattgagtcaggagggagttttctgattccagtcatcagaatcatatagccctagctgtttaacacttgcttctgtttacactccagcactcgcagttttgattgtgtctcttaattagaatggctacaggattgccatcttctctgagttctctattagaattagggagtgctgagtggaggcacaggcttggttttggattgggaactactgggcgcaggtagaggccacctgctgatcttcctggtgggtctagagccagctcctaattaaccttctgcagtagtgagcacagaggaggtgggactggaatccagccatcataggaaccacagccaggatggagctgcagatttaacagtgagaggacaaaggctggggaaagggctggctccctcccacacacccctcatctaaaacatcttcaatgtcagtccgtggtgaatgctagacctcaaaagttcccattcttcccctggtccccaaagcccacaaatgtgtgttgaattctgtgtctgttttatttcacttttaaaagtagtctcacacacaatagaatttgaagctggagccccctcattttccaggtaataaaagcaagccttggaaaagtcgaatggcttggcagaagcaccgagaacctcttggtgttttttctgtgtcaccgctctgggtctgaggaggatgcctaccttctaagctaagcaaagagtaaaatcaacgtgatactgaagaaagaatctttgagtggtgcttttagtcacagggaacaggctttcctagaagctgcaattgcccgtgaccatgaaggaaaacagccacttaagaacagagagagagataggagtttagtcctttaggagggaatcaatggaaagggaaaaggagctcccatgaccactctccagccccactcagctatctcaggcctcccttgcttcgccgcatggcgattagacagctgggggtgaataatgcggtctggggtctccctgagcttggcctccgtgggagagggaaaaataagaccagtgatttcatgagtaaagtacgccagagcactaggaaagaaagtgtgagctagactaacacaggatgagtatatgaattccagtaaactcagaaggattccttcatttgtgatttttactttgtaggtaaatttcattagtagcataatattgactatccttacagcactgccaaacaccagcctttaataaaaattaacattatctacgtgaaagtcttcctttatggccacctactttggtttaaccgatctgaaatgatgttgcttagtcaatgagtcatcttttgttgtatatccctaaaataccattgatttgatagtccagaaagctcagaatgtaatatgttcatttctctatcagtttccccagcgatttaaataaaagacagtgactgattaactaaaataaatggaaccaggttgttaattttggttttatagagaatgtgggctggcagggaggaaatctttattttgcaactggaaaaaaaatctgactttgtataaaaaagaacaaattcagagtattttagatttacctttgcttttcatttgtttcatgtattctttaaatggattatagaatcagaggagcttattttcatttttgtgtgcgtaagatgtgacttagaaggggttctcattgttttgacttaaaacacactaattcattatgtattgtatcttgagaacagtggctacagttgacagatgattatctattttctctgtgtgctctttggatgcagaattacctgtaaaaacaaactagcttagtatgttcttggttgctttatgtcagatgtattatgtagtttttcaagtagcaattctagagatgaaactctagttttagaaatattttaaagacagtatttacaaactgaagtggaatgtagtgagcttggagttgagaagacctccatttgaatctcttttcttgggcaggttacttatccgagcctcaatttcttgcttaatagaaataatgattaaagtctgctctctttttatttgtagcttttatttgtgattcagaattcagaatttctcaaagattagaaaagtaacacagtgtacaatactaacacttctagtggcatctggacagcccccccataatcaaatgcatggctatttctatagctgaatgttcaaggacttgcacttattaagtactcagtaaagactatgtaagtaccctcaggttaggttttattgacggatgaatttttagaaccaagttttgaaaaatatttggaatttcagagctttctgtggttgagatcatggaactgtattgccctcccaagcagagcatagaacagtcattcaataaatagagctgatggcaatgatgcgatgcatgaccatgatagaaaaccattctaggaagtatttgcaatcaacacctctgcatttcaaagggaaaatatcatttacattggttttcacatcgtatgttgttgtgaggtaggctttgaaatactctcctgtttgatgagggtttagtatgtgtttcttagtctgtgttgctataaaggaatacctgagtctgggtaatttctaaagaaaacaggtttatttggctcacggttctgcaggctgtacaagaagcatggcaccagcatgtgcttctggggaggcctcaggctgcttccactcagcatggaaggcaaaggggagccggagctgcgtgtacagaacacacggcgagagagaagcaagagaaaaaggagggaggtgctgggctcttttcaacaatgagctcttgcaggagctaagagttagactcactccctcccttgaggtggtatcaggccattgatgagggatctgcccccatgactggaacacctcccggtaggccccacttctgacactggatatcatattgcagtgtgggacttggcggggccaaacaaaccacagcagagagagaaagagagagagagaaatttttaaacaaatttttaaatagtaattactgagaaagaggaatccgtaaatactctacaagaccacaaatactgagtattaggtagtagggacctactacagaaaataattttacaaatagcttatacaggatgccagaactctgcagcgggactgaggaagcattacctgtggccagttcctgttgcatctaatcaagggttggtaactattcgcagatttaccctaactcagttttgctgagcgttgtgacagcgtcatttcctaagaggttacttacccaacagcctgaaccattctgaaacaaaagcagaggtctttcctttttcatctcacctgtatgtcagggcagaagcagtgtagacgggaggatgagccctgaggcaggcatcctggcttctagtgcacactcaggctttcccataaagtcacagagggccctgcctgtgtcttcatctgtaagaggatagggatcgccctacccctggctcactgtgaggatggatggctcactgcacacacagccttaggtcaggggctgcttccacagcaggtgctcagatggcgagatgattgctggtcaaatgaccgtaatcatgccaccatcacgttcagtcttgcaattaggaccttggtttccttttcattacaaacagggagttaagctaaacattctgaacagctttccgccttctgacatttgacttaggtgctgagcgatggtagctgtttcaagtgtgcacggtccactttggaacaaccgtgaccttgggactgttgttttgtccattagagggcactggtgtactgaggaatgagcccacaccacaccctctgaacagagaggaaggtggtggtggtctccagctttactcttctgcctctgtgcagagtagccgtgggaagggatcagcttttgtgtttttcatctggaagggaagcagcaagccccaggccagccttattgtctgtggagttgaggacacagagcaaatagataacaggactgtctgggaagggggcggaggtgcagctggctggactggatagataaaggcctgtaatttgcttatcttagtatgttttaaatgggaagatttcacaagcatgtctttaaaatgttacttagaccaggtatattgactcaggatcactgggtaatctgagtaatctacccatacttagaatcaacagcctcatggggagtttggttttgaatattagctggatttcatagctgtctgcaattatttattattattttaaaagtggaaattatcattggaatttgtacatattcctttgaattattttcatgtttattggaaatacgatttcacctggtatttacatttctgtctgaaggaatcactgttaaaagaaaaatgcccattataatcctgagtggttggtttatagcagcttttatttccaacttaaaacttcctaaaatacttggaaacaaatttcttttttatttttattttgttgttgttgttgttgagatggagttttgctgttgtagcccaggctggagtgcaatggcatgatctcagctcactgcaatctctgcctcccaggttcaagcgattctcctgcctcagcctcccaagtagctgggattacaggtgtacaccaccacgcccggctaattttgtatttttagtagagacagggtttcaccatgttgaccaggcgggtctcaaactcctgacctcaggtgatctgcccaccttggcctcccaaagtgctgggattataggtgtgagccaccgcgcctggccagaaacaaatttttattaatttaaaaatgttgtattttgcttcctctggccctttctaccaaataatgtttatcttttattttttgaaattgtgcccttatttcaagtctctatggactttccagtaatcatcaggtttgctgcttactggtgacttaatttttctctttacgtaagttaagtaatataccgaatatattatataatttaaaaaaaagtctccttagccctcctgtagatcttacaggcaggtgaactgtagcagaggtgttacttatgtacctctaaattcttttcaagctagaaatatttgatacttctcttttgcatggtttggcctcatgcccaggagcacattccattaaatgtatccattctcaaggccgagaggtccagaagttgtccttgagacatttctttagccgtggaatggacctgtgttttataatataaaagactgtgggacaaacaactcagcaacgctttgtctgcctcgaaatcaggtggtgaatgtagcaataccttataggactctctttttaatcccaagaaagaaaaataatgtactaaatacatgagttaaaataatatactcaatgcatgagttaaaataatgtgctcaatacactaatgtgctcaatacactagttaaaacaatgcgctcaatccaccagttaaagtgcacgcccaatacgctagttaaaacaaagcactcaatacaccagttaaaacaacgcgctcaatacatgagttaaagtaatgtgcactcaatacgttaaaacaatgtgcaagttaaaacaatgcactacttaaaacaatgagctcaatacgctagttaaaacaatgtgctcaatacactagttaaaacaatgcactgaatacgcttgttaaaacaatgcactcgttaaagtaatgtgcactcaatgcactagttaaaacaatgcgcccaatatgctatttaaaacaatgtgctcaatacactagttagtgtgctcaatacgtgagttaaaacaatgcgctcaatacacgagttaaaataatgcgctcaatacgccagttaaaacaatggactcaatactctagttaaaataatgtaccgaatacattagttaaaatggaatatgtacagcctgtgccgtcaggagcttgaaatgagatggaagcttgccatgagttctggttataggcggggatgccatttgccacactgacattaagatgcttgacatagaggtcatcgaatgctgacaactacctgtgactgtcaccactgggcaggtaaggaacctgaagctgagaaggaataaggaacttgcccaagagcacacagctaaattctatgtctctgtataggggggctggaaatggaggggtggaaatgagaccaggctcggcctccacccccaccccacacctcccacacgtctgatttcagtgcctgccagttctagaagggtctgtacagaggaccacaagaggtttgttaaggtctgcaatttacctgtaatactaactttgctagaccttgaccagaaaggaccctctgccaggccctcagatgtgaaggtcagtggtttggagcaatgaggaacatgtcaggctctgatactcaccagctgctgcttttttccccctatatctatgaacatggctgatctctctacagtacagttgatcaagggcaaggaaccacaagctaagccccttttattttgccattagcagagccatggctggttggcttcccagattgccccctagaccactgtctttgctgtgtgtgcccatttgttctttagtccaaggtgattttgatctgcatcgtctgaatgtttgtgtccccccaaattcatgttgaaatatactccagaagaggtggggcttccaggagggaattaggccatgagggcttcacccttgtgaatagcattagtgcccttataaaagaggcctgagagagcttgtttgccccttcctccatgtgaggacacatagaaggcaccttcaacgaggaacaagccttcaccagtcactgagtctcctggctccttgatctgggacttcatagtgtccagactatgaagccctacatttctgttgtttataaattactcagtctaaggtgttttgttagagcaggctgaatggacaaagagagcaccagagttacaacatgcaaagtatgagtgaaccttcaatactatagctgtgcattaacaaatatgtttaaatatttaaaatcttttaaagtttttagtttttagctaaagacatcactgacttagttttttgctggttatctcctatccatcaaagaggacaaagtgggcatttgatgtagtgtaaatgcagttgtccctcagtgtctgcatgatcgcccacatataccaaaacctatgggtgcctaagtcctgcatttggtcctctgtatatgtgggcttcacgttctgcaaatactgtagtttcagtccacatttggttgtggatgcggaacccttctgtacggagagccgactgtacttattttttaaaaccacataaaagtggacctgtgtatttcaaacccatattgttcgcaggtcaactctagtttgttagatattgtcagcgttttgtgatttaagtatgagacccaatgaactactcagttccaactacgaagtttaaaacataagattatactgctttgtttttactttttctttagtgtggtggatttcacctagcaagaacttttaagtaattaaattcatgaaatgcttagcttttgcagcatcttagtttaaagaataaattatccaagctcaagactgaggcatgtaagtgttaggttttacttcatgtgtttgagtcttctaaagaagagatggaaaaaaaatgactctgtagttaaacttgaattgccttagtagtgtagctttaagccttataaaattgctaagttaaattggccctgtgtgacttcctaatcactgtcttatacaatacccagtcagtttggtggcccagtggtgcatagataagttgagatttaatttaatcattattgcatgcaatgtttatacatagaaaggtttccacttttaatgtaagagatgattaaagtcctgctgggaaagctgatgtaattatcagcttgtaattatcgagtgtgttaaattagtatccaattacttcttcccatttttttttctcgtttgcttcttgtttcttacagagttttaacaacagaaggggtcttcattggataaccttaaacattgaacatggcaggacattgtttttatggcatatgtacctgtatttcattgtaggtgctagactggatcgagaaccacggagaagcatttctgagcaaacatacaggtgtggggaaatctcttcatcgggccagagcattgcagaaacgtcatgaagattttgaagaagtggcacaggtaaaacaatggcttctattattttatcccataaatacccgtgtggttgattttggattacagttttaaccacatttgagataagttagcattagctcgatgtgtttgacacctcagatgaggtaaaggctccgatttcagagtgaagttgtcattgcctaggcagaaacatgatttggtaagttgacgctttctaaaatacgatgttcttggaacagaaatgtgacttgggtgtttttgtcttgtttattataccagtgccttttgactactttgtgaaattccagtttataatcaggaaataacagttccttctgcgtttctatagtagtaggctaagccttacttgttctgtttgcatttctttaaatgtgtgggcttaggaaacaggagccgggagtccagtgtgttccgaatgtgggatttgtggggtttgagcactggccgcctgactttggacaagtcgcttaacctttctaaggttaactttctgatctgaaaaataagcccagtaatttatttaataagatttttcttatagtcaacttctttaaactagtgagttgtggcttgatgaagtaacacagcagagattcagaaaggaagtggtgaaatgttatggttgaattcatttaaaaatgtactaaatatagatttattatatagaacagttctggtgttctgagaaggaggaacccaaaattcgaacctcatgtttaggtggtggaagcgagtcatacagtgtaacttctgcagacacaagacctagctgcaggggccctgggtttcagaatttgttttagacacggctgcagtcacctcaggaagcacttggatccattttgcatgcagttttgcagagtcaagaacttcctcgtaactaatttgaaggtcctttccttaattttgtacagtgattgtgagtagctctatcctgttgaatgaatccatgctaattgatgtgtatgtgtggtgtgaatagccatcgtgcattttcatgggctagtgtaaaaaaagaaataaaaaatacttttcatgcgaagctttttgcaaataactgtcaggaagatactctttcatgttaatgttcctgttttagattttaaaagttatgattaaaacagccagtaaagcccagaaaactcaggttcaaggaagaatctggttttgagagcacagaaggtatctttactatcattagtaaatctttggcatagcatccttcctaagtacctgctctgtgaattcttaaaccaccctcgctcttttctgcctatccccctggattcaaattatctttcagagatgtaacctgtcacaaagttattatccaggaagccatttctgtcaacagcttttcgtatgtgccacgtaattatcttgtcttcctggataaaagagtttgtcatttaggaaagcaggagaccttgaattcattcttgatttttaaaagaaaagcagaccagtgactccctggtcatgacttaactcattcatcttttgcaaggaggataactgcctccataacacgtggacatacagaatgtccccacgtgtagcatgctctaaattctgatttgtgacagccgttagagcatgcatatgtacaaaataggctgttgctttgcagtaagtttggttcctaatataagatgtattgtttttaatcttttaaaataaattactagtggaaaattcaggtcaaattatttgctatcaagcattttctttagactggcacgtatttacagggtaccaaatcttctcatctgctaatttttccttattaaaaatacttccaaaatttaccaatatgactccactgctttctgattgcaagacagtggaaaacttcatctctcggagcctcggttttcctcgctgtaaaatgatacctaacacctaccttcaccgagtcgctgtgatgagaatacatgtagaaatgcctgacacccagcaggcgcttgtggtgctgtctttgcctagaacagtacgatcattcagattattcagatcttttggtgaatactagccttgtgtttacgttttgggacaagagccactagaagccaaatgcgcctgcgactttgcccttcctgcagtcttcagctgcaggaccagtttttactaaagacggccagaggctgtatttggaatccagtggaaaataatgagacttggctcttcctgcagtcctcagcagcactggaaagcagcaccagaggatgttggagttgtatcacccgcgggccacttcacctcgctaaaaccctcccactcccacactacacaacagtgtgtgtccggtcaaatggtgagagacatagatagttgtctgtgttttgctgtgtccagagaaatccacagcacttcttgggtccactgttagttagcgtttgtggtgctgcttactctatcctgtggacacatgttgcaggggcggtgagcttgtctcttgggatgccgtgttttcccttcacggatgaaaagacgatccctgggaatttgtgtgccttttaggtgataatttaagttacctggggcttttaatttgcactgtagatgtcctggcccatcattcttctgattacatttctgtattaataaaataccttggaggttttcaatatgcagactttgttgtcttttaaaccaagcaaatataatgaaagtatttaggcctcaaatgctcattttccttctttttcctatctgttctaagttcccaaaatcccttattttccattgaattctaagtacagcccctggtcatctttagtgagaaacagccctgcagccaaggattgcaggaagagcaaagtctcatgcacctttgccttctagtggctctttttgtctgcttgagtcctaccaagttctcaagaaaaagaggacaccagttaggcccccaccctggcctggccttaccttattccttttaatccccatggcagggatgacccacacaccacagatcagaaaacggctctagcatgagatgcctcgggaacaggatagtaggagttggacaggagaagcccagtctctcagactctcaaatgctccctgactctgatatcctccccactttagtccagtgtctcagtttcccctcgtgtgaggaactgtggcttaggtactggttgttttaacaatcccagctctgctgactgacttggtggacaagttactgcacccctctgtgcctcgatttcctcgcctgtgaaatgggaaatcaggtagtatccatgtcctgccgcttttgtgaggcacagtgttaagtgccaaaaaggtagcatttctgatgagtatggttgatactagcacaaagaaatctctgttctccagttgcagaaggacccagggaaggtctcgttcccgggaaaacctggccaggggtttcagaggcacgagtgctgacacaggccccaccagccctggcaccttttgtgctgtctcatgttcttcaagcacaagattaaaagggaaataaatgatggctgtttcacgtctcagatcattcagaaatgcacttgtttctttgggacattttaaaaaatatctttacttgttggaatagacgtgggaaggctttcagaaacgtaatacttggctgttgggaggctctgtcatctttagatccacttaccaaatatgagaagtccacaattccaaaactgtagtggtgatcataggaaaacaggattcagctctttagaaatgtgcgtctgtggcactctgggttctctgtacagcttgctacaccgttagcttcattcagcatggaggccccgttgtgcccatgatagagatgcagacacaggagttccgaggtgacgctcagctgggggtaagcagggacttccaagccttcttccctggaaggaagccacctgcaggtgcggcctctgatggctagagaacctttgtaggcaagagtgcaggcagaccctccacagcagagccgttggtgctcatggctgaccatggtcacaggagtgcccactcttgtgcccagaggcacaggtggcagccataggaggggagggcctggatgagagaagccctggaaagcagtcaggaattgttccataggtgaaagctgctttttagatctgtctcgtgtgtgtgtgtgtgtgtgtacacatgcgcattcacatctgtctgttaaaaaccatgtatgtattcatgcgaatagctccaattccagcccaatgccaagagttcactcaagttttctccttcgctatatttataactcccttttctcaaatagagaaacctggctcccattatccctcaggtattggcttacttgtgtaattccattctactaatgtaaccagtctcccaacttggaggccacccctccccacatgacgccctcacatcctgctcagaccctcaccgatgagacgccttccctgctcatcttacatctctgagaaggataaggattcaccttgtttctcaagggaaacccaaagctgacttcctgggccttcttagaaggcctgagctccgttcctttcctgtcctggcatcccccagcgtctcccggggctcccctcccacctgtggacccctccgcagcagcttcctgtaacagcatcagggctctcgcatgccttcctgttggaggaacccacttacagcctcagattattaggaattaaggtgatttttagagtattttagacacgtgtttacactttgagctctttaaaactctggctactttagagccattatagttattatttcctttttctcaaaaaatgtggccaggcaaagtggttcatgcctgtaatcctggtactttgggaggccaagacgagaggattatctgagcccaggagttcgagaccagcctgggcaacattgcaaacccccatctctcctaaaaatacaacatttagctgggcatggtagcgcatgtctgtggttccagctacttggaaggctaaggtgggaggattgcttgagcccaggagttcaaggctgcagtgagctgtgatcacaccactgcactccagcctgggccacagagtgagactgtcatgcaagctggaaaacaaaacagaaaaataaaaaatatatagccttaagtagaaagaagatgagcacagaattaccaacaagtagaaatgtgtgaaaagggatagcaacttatgtttgtttggaatttaacctttaacttgtacttcgagaattatcgtaaagcattgtatcatacggaaagacatagactggaactctctgcttggtgataaaactggaagaaaaagtgaagcaggcatttgttgctgggggccgtctcctgactccaccttggcaaaaatctgaaagctctgagtcacaagacagccagcaattgcctgcagatagtccatcactaccttcaatacaagggttttgatatggggttcaaagtttaacaatctaaaacaacagcgggaaaggaattctgcatagaattcccaaaatcatctctccccatcatatttttctgtttgattcatgtaagtgatcaaaaatatcacaaattgactgtgttgctatatattatggcgcccagcctggctggtctgcttttcacttaccttctgtttctctgggatgttctcttgtgcagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagaggtaaggtgccaggagaccaaaatatgatctgtgcttgaaagggtctttgaactcttttggaggaacctaaatttagtcataatgtgagaaagtggacaaaggtggcaagttgtaagatgtagcccattagtgctgagtgtgtctgcgtggacagggaaaagccgggcttgtgctggctttccttgttttgtgagcgcatggctgcctttgctggggctttccataaagagaggacccatgagggttgggagagacagagaacgtccatttctataagtaggggacctgcgcgttgttggtcagagctgttgggtctccttcctggctgtgaacctgtcacatggctgccaacatgattgcctctggattttacgagacttctctcagatgctagtaaacgtgagtgttacctaatattgagtttaaatgtgccagagccaacctggtacgaataatattaaagctaatgtcataggcatgcacctgttaatcagctcatctcatgacaagaaataatgttatttggtgtgtgaaaaataggtaggtactaattataccttgcatatatgttattcttggtagaaatcatataaagttacatgaaagaaactactatgtagcttttgaggaaaaaataatttaaaataaaagttcatattcagggtgactacaaattgagtagggatgtcaacttaccacaccttacttctgtgtaaaaaagaaaattccctgcgtcactgaggaccttcacagaggatcgtaacttattcagatgcagctcttgatgaactggaaatgaggggcccttctgggtaactggggactatgcacatggaagcttgtggtcataggatgggaaaaaggatctggaagagtaggactactggggaaagaggggagggcgaggcctgacttgcctcatttcaaggcatcagtgctcggagacccaccaattcctttaaaggaaaagaacggcactaccagctctgagatcttggacagttagtcctcagtcgggtcatttgttgctggaatgtttggactgcaggcttccctctgaaaccctgtgaggctgtgaaggagtggaggagagtacacagcaaaccactgggacccctggggtttgcactcagtcctgccccgggctggcagctggctctctcgatcctttctgccaaggggctggtgcttcttggtcccgagatggtcatcaggatagaaactggcacagctaacttcttttcctgctcctcagaatgccatcactgaaattgctcttgaaaattcttaacaaaagaggctatttttttgaggagacacattaaatggacattgttctgtggcagttcctagtcattgctgcacgtgcctctagactaagtttcccactcattgtgaaccgagcttgtctcttgctgccctccagcctctgctagctctttgtcccagcctccctgtggcaccgctaccagagtaatttttctgaaatagaaatttgactaggccgtacccctgcttttaaactaccagtggttcttcttgtatgtggggagcagcctgatacctccacatcctcacaacatagaccacgtttttccttgcagcctgtcttgtgctgtgtcctcctcttccaggacccctcccgctcaacacagtatcccctgatccagaactttctggcacctttgagacaaggatgggcgtggttagccgctctcccttgcaccttctagagctccctctacatgcacctgttaacggcagttgtcatgcgtgtgattgtgtgttactttacatgtttttacaccgtagctgagagagaaggagagggttaaggtgatctgtgtatgaaaacagattgtggcatagttcactaagctgtgacattgacagaacatgggccaggagcacagcagcctggacccttctgagggcagggacctgggcagggatgtccagtctgcaggttcctcattcggggcccagtgaccacagttgccctggatgctgtagatgccataagggagaggcaggaagagtgtcaggcagctgggagtggctgagaggccaaatcgagaggaaggggcagagggaagagggccttgcatctgtggcatgttccagagccaggtggttggagctggtgtttgtgtggcatgcctggccatattctatagcagcttagcagtctgaggtaagggtctagcttccttataggacagaagactcttcccaccaagcagtatttgtgatttaagtcaccttttcaactcggcagtggttttcagaaaccagacactaaaggataactggaaggaaagtgctttttcaaaagctgttacctacaaataattaaaaaaaaaattagccgggtgtggtggcacctgtagtcccatctacttgggaggctgaggcaggagggtcacttgagctcagaaggtgaaagttgcagtgagccgagatcacaccattgcactccagcctgggcaacagagcaagaccctgtctcaaacacagaaacaaagctcttgtccagaggcttcgtttgggctcattggcttttgtaacagcagtgtttttaaggaacaatcttctaataagagcatccacttataagaccatggagtctgtattgtcactaggtttggaaattatttaaaagtaaaaatacattttgttttcattgacttacacaataggaatttctagtatgtatgagtttgtagactaaggagaccttaaatcagttttaaggactaagtggttcacttttatgactgcaggatttttagtgcagtctatgaaaggccatcttagtagcagagaaactggcatgttttcctcgacctgcaccatcttacttgtgtgcacgtcacgtaacctgggaccaaggagggatcggggcccagttagggagggcatagcaggacacacgtgtgcccgtgtgattggcattcaaggacgctgcccgcaggctggaatgctgcccgtttcttcagtagatttgtctttccctgaccagcctgagaatttccctcagttctttttctgtgctgtacaaaagccctgaaactcccaggaatccttggtaggttccatgcgggaaagaatggtttcttcagtcatcgtattttgaagctggttattgaatgaaaactaagataagcttagaacaagtttaattagtttaaaatgaaaagctagatgggcctagaagaggaaatcatgctaatttgctaggtgtttgcataaagtcactaaatgtatttgcatatcagatgaacgaaaaattgctaaaagatacacattgtctgagtctgttcttcttaagcagatcatacaattaaaaattacatagaagaagatagaaaaagtagcttgtcttggctgggcgtggtgattcacgcctgtaatcccagcactttgggaggctgaggcagttggatcacgaggtcaggagatcgagaccatcctggctaacacacggtgaaaccccgtctctactaaaaatacaaaaaaattagccaggcgtggtggcgggcgcctgtagtcccagctacttgggaggctgaggcaggagaatggcatgaacctgggaggcagagcttgcagtgagccgagattgtgccactgcactccagcctgggcaacagagcaagactccgtctggaaaaaaaaaaaaaaaaaagaaaaagtagcttgtctttttcatttaggcaaattcatgaagcttttttagaagttgctaaaggctctcgtgacagaagttagtcttccttgctgccaggtgttccacagtggctctcgtcctcactttatctggagtatagttgtcactgtctctttttgcaataaattcctggccctctgatgaacaagtaatacaaacatgaggtcataacaactcactttaaaaaggtgcaaagtcaaggtgatgtttactgagcattagctcaggaatctctttaagaaacccctggaagaaggtggctgccggaagtcttgttgaagaccaggctcttagactccaaaaactgagacctctgtactctggttcttttaccccagaggacagaatagacacttgttcctgagaagagagaaaaggggatgcattttacctaggggacaaatattttctacctcgaggtagaatgcagcaggtggttgatagaaatttcagcccatttgcccctcaagcccagatttggaagtattccaagatgctgttttctctaaaaagaatcctgaggttcgtagcctcctttcagaatgcctgcagcctggtgctttgttctgtttttgttttgttttttaagtatttggaaggaatgttgattggcctgacataagtttgggtttgatttgggaggatctttctcctcctacacgttgtcatccactcttagtccccctgcagtatgcattccccttcagtcctgtgtatggcatttattcacatcagttctgttgataatgctcctgctatttgtccttttttgtttgtcctcctttccttttgaatgcatttttcactgtttatttgttcattcactcttttcactcattcattccaaagggtctctcaaggcaatggtaatgtgcaaggaggtgatacctaaatgaatgaccaaaagaacatgcttctgcttttgtgtgtctcctacattttagacatttgtttgtttctcttggtagcctttaaattccttgaagcccaggaccatgtctcacttacctttgtgtttccactaactagtctacctcctggaattggcagatactcagtgaaagcctgtgaaataagtgatgtctatttctagcatattattctgagatttaatgatagatttagtgattgaatgagatttccattttcaaatacagcaaaagcataactattttcattcattcatattcattcaacttcattctcaaaattaggtcctgagttaactaataattacctttgaaatgtgtgggttatttgaggcaatcaggtggtgacattgagctctcagccagagtttgtttctggaattgattcagttccattgcattgatttttgttctcagaagccaaggtttcccaggaaaaatcattcccacttgaattgggctgtgattcttgctgcgtttaagtaaaggaagcctcttggttctagttctgcaaacttacacactgaactgggacaagtttttgtttagagtaatggctgggaaaagaggaacctttcattttattcagaagtcaaaaacaaaggcctcccagccacctggagatgttttgttgcagacaccagcctggctctgtctttatgcctaacaattgagcatccagtcttctttgtgctgggaccattgctcagctctgcaaggggaaaagagggagaaagccagagctgccaggcttcttgcactggggctgggggagggttcctgggaagcaggtgctctctggcttcttggtacgtgaggctctcggagctgcctctcctctgaccctcaggtcctcaccgagtttgctccaggagtatattgaaaacatacccagtgctctctcaagcacccactgcttagagggcccagatttcttttccttctttcccttgcagagctggagactgcatcgggcatctggtgtttaaactaaacaggaaaactgactaaaggtccacagtgctcattgtgtagactagctgccctccgatgggtgctctgattatcagtggttccagtgcagggcctgtcactaagcaggcctcacttcctccttgggggctttcccatgggaggtgtggctttttactctacatggaaatgactctctgcagccacagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacatatacacacatgcttcttaacttaggggattacatgccaataaatctattgttgaaaatgcactaatactatcgcaaagatgaaaattcacaggctgaaccgttgtaagtccatatgctcctcaacttacatgtgtgatggagttatgcccaaataagtccatcgtcaagttgaaaaatcaaaatcaagccatcttaggttgaggaccatttgtttgtacctccaaagatgtcatatctttaaacatactccctagcttttctttttactttttattttgaagtaattatagaatcacagaaagttgcaaaaaaaaaaaaaaagagagagaaatggacaaggaggtcccatgcatcttcaccaagcctcccacagcggtagcatcttgcataacctcagcacacaatcaaaccaggacactgactttgctgcagccctcaaggcttattcactttccgcgaggtttagatgtgtatgtgtgcccatgtgtatgtgtgtgtttagtcctgtgcaattgtatcatgtatagatttgtgtaaccaccatcactttcaagatacagaaccatacagaattttcccatcatcaaagggttccctgcactggcttccttcagtgatatctaacccctgctccatctctaacccctggcaaccacttatctgttcttctctgcttctattattttgttatttctaaaatgttacataaatggagtcatgcagcatgtaactttttgagatggcttttttttaactcagcacaattcctttgacacacccactttgtcgcatgtgtctgtagtagttccttcctctttattgctgagtggtatttcatggtctggatatatcacagtttatttaactatttgtccactggggacattcgagttattttccgtttttggctattacagggaaatacacagaaattatgaacaatcctgtctaggtttttgcgtgaacatggttttcatttctttggaacaaatgcccaggagtgcgtttgctgggtcctttggtaagcacacgtttagtttttaaaagacactgccaaactgttttccagaatgagcgtaccatggtacattaccaccagaaatgtatgtgagtgatcttcagctcttcagcatcttacaagtccaggattgctttaagcttgtcagtgagaatggttaaaatccagtatgtaatattttagagtagaaagttcagtgtatatgatcgagcctcagtaatttttgtttaatatgaattatttagctgcgctctttagtgcattaaattctctctatatgcttttacacatttgatttctttatttttctgacatgggtacaaatgagtaattaaatatgtccaccagctggtgaaagcaagaggaaactaacagcctagaactgtcgactgcatcatcagcccctgtgtgactgagcattagatttgaccttggcatcacttggcacctgctggcgtagcattatgtctttacatagactgcggtatctagcgtggcatactgattttaaaaaacaggtggtcttcccattggtgggaatatccaaaaaaaatacatctagtcaattatgtctttctataaaaatataatctttattgaaataattgagaaaatatagtataacaaacacaccccctaaatttgctgagtgatctgggataagttactgtgtagtacctcaacttccttagctacaatataggataatacaatctctaaggaaagtgagacaaattaaattacacgtggaaagcacctcagaatgcttttcttagagtagctgctggccagtgttcttttttcctgtcctgaccccgattgtaacatcgatatagataaaataatacagactttaaagtaaggggcaaagatacaaatatctaggtataatgttgtctctacctcattaatctttgaacaacagtaactgcttaatcttcctgtcctcctccgagtaataacctcactctgatcctattcttaacatcaaaaccaaaagcctttcgtgggatatacacaactctgtccatctccagctgctggccctcagagcagagtagactgctgggaagaacccttacccatagttcccttcatattggcaaaaatcattttgtacacatcactaagtacaaagtatttagatcttagatcccagctaaagtttcaacagaaataagtgatttttttttcctccaaataaacatgtataaagcatttgtactggccagtgggaagagagtgatattataatattatctgaaaggaaagtccttttatcagaataacttaaaacgctacattttttttctgtaagatgatgtaaaattgtggtttaaatttatacaatttttatttgttaacatcggatcactattttcaagtagagaaaagttttatgccaacagagagcttagaagttattgtggaagatcatgcagtgctgatatacctgacacatcatagtcaccgagtagatgattatcggatgaaggaattaacaatatattatcttcatttgtaacgcagtttttcagtagggattgattgaaaatataagactgtccactgacttcagattttatagtttcttgctgagggtcatttgtaaatggagggttgtaaatgtctgctttaattagctgtttgtcagtaggacttgattaatgtaatgtaaaaggtgaggcacttcaacacaaggtcaagagatgaagtgttaaggccttaaaatgcccaattggaaataggcgtacatgaatagccctgttttttttgagacatagtctcactctgtcacccaggctggagtgcagtggtgtgatcttggctcactgcaacctctgtctctcaggttcaagcagttctcctgcctcagcctcccaagtagctgggattacaggcgtgtgccaccattttagtagagacaggtttcaccacgttggccaggctggcctcagactcctgacctcaagtgatccacccacctcagcttcccaaagtgctgggattatagacatgagccactgtgcccagccctgtttacttgttaaatttctgttttaaagggcattttatgattctctatttcttattttgttactcagcttcataaactaaatattttattatcaaagaaccacaagtctttggtgaggaaagaggtaaacttacctgtatgtattttcgtatgtatttctgacacatttgtactgatcttcgttgttcttattgaataggtagagagattggccaacaatgtattagctagagttttgccaggacagcttaaaagctccagataagccaggcttggagagactggtaaggctttttgggttttgttatcatttgtttgttttcccttccatttgttgaggtacaaaaatcagaaccagaagatcaaggaagggttgagctttctgcttgagagctgtgatgttgatgaacgacaagcagaaagtggaccccatcatctctcactttggttcttggtctcctcgaggggagcactctccagacataggccagaagaagcaaaagccccaaatggtgaaggctttgtaaggaaagacttatttaatctaagcacgttcaagcctctgttctaggacaaattagatccctgggtaccaaaagaacttgataattatatcaccatattgagcatatcagtccaagcaactgtgggaaagtgggctgatgccagaagctgaaaacgcacttgtgctttttaaagaaggtggatttcacgcattactcagagtgaggttaatcctaggcagagttctagagacaatttttaaaccgctggtcaggaaaagtgaatgaacaagttataatgtgttaactttattttgttctctactaggtttctggcttgaggaaggacatgtggtggaattagtgggcaggcatttgaccaggcctttcaacatttaatttgtagacaagaaaggaaagtatgggctatctcttagttactagaattagactgttgaatggctataataaaagaatcaaccaagggtgctagcacgagaccaaaactctcctcatcctcccacactgatctccaggtagaagatgtcaggaggcaagcttctgatagtaagacagtcctcataccccacaggtcagtaaggaagtcacgtccagtctggagccacagttagatcagacgtgctgactgacaaaggtagtggtggatgatgctggaccagtcatctcaggtggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggtggacctgaggtcctgcagaacagagatgatgctggaccagtcatctcaggcggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgctgtgttaagcgctatttttcttaaaaatgggcaaatttccagcgtatagcaaggacaggcttagtgccacagccgaaataattgttgctgcattaaaagctttgcaagtgagactgtcagtgcagaggttggtgagtggatgacgtcagcagtgctggagggagtttctagcgtcatgttgcaggtgtctgttctcatgcagaaagcctgtgagtggttgaattggtttggaaggtgtgtgtatcaaatctagacaagggcctgtcagatacgtcaggtgctagaattcagatcccaacagatctcagcaccaaatcaaccacagaaagtttcattaatcagttttaatatatgagtgttttgaatcagtacagagtaagaatcacataggtggcaacagcatgtgtttaatgaagaaatgagcttacatgtgttatttggttgagtccacaatgctgtcatgcccccaaataactccttccactgtggtgaccaagggaggccgtcgtcttgctttctggctgctgtttggatcacgtgggtattgtgtacagttgtccagtccctatgtcgttttgttttgcttaatgaatatcacatcaatttaatgtgtccacactgggcaaaactgacttgaggagtgtgagagtaataaaaacaggatatattccagaatgatcatctggtaagaacatgccctggaagctatagttataatatcctcgaacagattacactggttatttatacactctttagacttcttagtgctcaacaattgatgaaataccatttctggggagtcatgcttatgtttaattttcagtaaggactggccacagttctatttatttctactaaaaacatctccttggcaaggaaaatgccctttccattttcctgcttgtgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttttcctgcatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtatgcacatgagcatgtgtgtttttcctgtgtgtatatgtgtgtgcatgcacatgagcatgtttttcctgcgtgtttgtgggtgtgtatgcacgtgagcatgtgtgtttttcctgtgtgtatatgtgtgcacacacatgatcatgtgtgtttttcctgtgtgtttgtgtgtgcacacacgtgagcatgtgtttttcctgtgtgtatgtgtgtacgcacgtgagcatgtgtttttcctgtgtgtatatgtgtgtgcacgcacatgagcatgtgtttttcctgcatatgtgtgcacacatgtgagcatgtgtgtgttttaccctattattccatatctctttccttgctcttttttttaagtgttaaagacttttactttcagactattttagaggagtcatttcattaaaccttttggaatcccactgaagccgcagggcccaaggttaagctgtgctcttcccttaggaattgacagtcgtggcgactgctgtctttagtacattaccaggaagtttccaagtggcagttctacaagatgagcccttgaagaagccaatcctgttttctatcttttgctttcaacatacgaggtgaacttttacctttctccatttaatataaaccaaaatccgtcttttaaaaaaatgtttatttttaacttttattttagattcaggggtacatgtgcaggcttgttatatagataaactcatgtcacagggggttggtgtacagattatttcttcaccaaggtactaagcatagtacccaataggtattttttctgatccttttcctcctcccagcctccaccttcaagtaggtcctagtgtctgttgttcctctctttgtgtccatgtattcttactgtttagctcccacttgtaagtgagaacatgggtagttggttttctgttcatgcattagtttgctaaggataacggcctccagctctgtctatgttgttgcaaaggacacgatctttcttttttatgactgcatagtatactctgaaaggggagagtgttgggaggagagtgagcttgtgtcaaaggagctccaggtcatgctctgcccgcagagttcaagaaataaaatgtcaccctaaggaaaggcaggcaggctgtgagaacatgggcacgatctgcaggtatttgaagacttgccacggcaaagaggaattacactttggccaaccgcagtgagagactgtggctgctctccaaatgacctgagggtgggggagcagcatttcccaaacttgacacccctgggtaacaacttttgttgaagagagtgtcttaccttgcggggatgttgggcaatggaaagaaaataaaaaaaaccccaaagtcaaattcttcttttagacttgatactgtttggttagtttaagtccatggtgttccgtctgtgagctttggccccaggttagtcacgtccatcttctgtcctacttgggtgtcatcgccacatcccctgtgccttatctgtactcagtctcgcacctctgcagggcatctaccctctggtgctggagtgtccacgcactgtcccatcttaacgtgcatagctgccctgaatatgcccctgtgtttcttctgctttttcctcctttcttacatgtaatacatttgcatggataattacttcatgatgctaactttggtttgccctctgttcctccccacctccaccccatacatccttcataaattttctttgatcatattaaggcggcggtccccagggaccggttttgtggaagacgatttttccacagaccagcggtgttggtgggggcagggatggttttagggtgaaactgatctgcctcagatcatcaggcgttagttagattctcatcccgtaaggagtgcacaacctggattcctcgcatgcacaattcacagtagggttcacagtcctgtgagaatctaatgccgctgctgatctgacaggaggctgaactcaggtgttaatgaccacttgcctgctgctcacctcccactgtgcagcccagctcctaacaagccacagatcagtactggtccgcagcccacacattggtgacccctgtattaagggatcttttactccacctacccaagaatgaaaaggtgcttcccggactctactctttcttatcagggcagcaggcatgtggacccacagtacagttcgtcatttcagacagaggaacatgctgcacgtggatgaggcagttctgtttttatccctggtttttatacctgaaactgtgtcacattttatgtgcatagtggttgtcctctgagattccacctgcaagttgccattgaaactcctacttctgcttctgacttgcagcagctctgggaagctgtggctttcatacttcccctgctggccctatggctcgcccattcccacaagtacccagatgattgtctttgtcaaaaacaagagtagggaaacagataccaatggcaacagcttctgttcaccaagtgcttatagaagttgaatacttcacacgtggattctcactccggcttcccagttagagaagatgcatgtagtaaaatgctttcattacatacaggagaaaactgaagatagagtgctccaagaatttcccaaggccacacataggataaggaccccaggagatgtgttgggcccctccttccataccccacctccagacggacaccgattttagcctgggttcaaactgcatcagcttgtaccccactggggagcacagagaggttgcagctggaacaattcccagcttagggccctgatcctactttcgacttaactggaggcttggtcctttccgagggtccaccaccccagccaggtcctctaggcatcctctgtggcggggtctccctttccaggtagtgaggaggggccttttcatctcaaaagctagcttttcaaggggatttcttccagcagagctgtggggcccatagaggcttgtgggaggcttcccacatcttaatcactcgggttttcaccacagaactccatgtcccttcctagtcatccttctgtgtggatcctggtccatgagccgggccctgtacacacctgcagcccacttgtgggctgagttcaggtcctcttccacccagccctctggcctgcagatcccctgggcacctctcagcactagagatggccagcaatagctctgatggcctccagggggcagccttgcctaaccctgtggctgccagacctgcttctgtttctcagtagaatccagactgctgtgaacttccataggacacaactctcttgctgctgggcaaagatttatctttttattataaatttgcagcatgcccagaagtacaatttttcctcttaggagtttatggtaagaattttataggcatcctagaggttttttctcattgctttattcagggatattttaggcatcatgtacaccattttaaaaacttaaaaacagactttccttgagtgatgtttcattatgatgtgtgcccattcatccccagttgatattagaagtgacctttatctaagacttttttctccaaattgaatgagaatatttcctgtaggaccagacagaaaaattccgaaggggcaaatattttaaatggttaaaatgtagccttgctccttctgcctcatttagtttggtccttttttaatgtcatgatcccaggatcagttccttcacggtctcctcagtacccgcgctggtttcaccagccagcgggaggatgagcacatccagtgtgcggtaaaatatccaggatgttgcggggaatacgctagtttttgggttttttttttttaactaccaggtggaagggaaaacgtttgacccctaaagattcatggcgcttcccctagaattgagaggaagtgatttctatagactctaacagactaattctagcacgttttcctcatactgtactatttttaggagtaaaaagatttaaatgtgggatgatgttaagtttactagaccaagtgacatattttgaacaattggtaggaacccgaatgtgttttgaaaaatatctagagaaggaagattttaaaactgtgatctttcttattattagaagagtttttcttagaacaaaaacagtaacagtggctagcatttacttatttcttcactctgcattgtcttctcattgaaacttctaagcaactttttttttttttttttttttgagactgagtcgcccaggctggagtgcagtggcatgatctcagttcactgcaccctctgcctcccaattcaagcgattctcctgcctcagcctcccaagtagctgggactacatgtgtgtgccaccacgcccagctatttttttgtatttttagtagagacagggtttcactatattggccaggctggtctcaaactcctgacctcaggtgatctgcccgcctcgacctctgagtgctgggaaatacaggcgtgaaccaccacacccagccccaagcaactttttgaggcaggcattattaccatgcccattttatagatgagaaaacagagctggatccaggtaacttgtcaaagttacaccctaggaagtgttaagtcagtgcttgaacgcaagcagtctggctttgcaacctacactcttagtcattattgtctattacctcctatgagaagtgtttgatttgaatgatcgtttatggaagaagcactaatagtaactcttaggctgttgcagtggagttgcatagaagcacagctatgtatcgtgcatccggccagttctgagtcatttttcatcttctcttcaccggagtgtaaaaatgagacttggtaaaatcgttttgtatcttaagtgttatttttggtagtatttgctggagaagaggaattttgcagaggtccccacccaaatggccagcctgccccccttcctgtaccacgagttgggtccttgagtgaggcctcacagtgagtcaggggacaggctgctgatctcccagttcagggcccagacatccccgagcttcggctggcagggcttcagggagagggcccagcggtgctgggggcctgacccctactgtctgagcagggctgggagggtggttgggacacctgtatttcagggccctgttacgaggtgtgtcctgtccagggtatgtggattctcttctgctgtcttgattaattttgttctgttttgctgattttgctgtttttctagtaggctttttttaaaaaagcgtttttgttttctcaacagatttaaaagaagagatattaatttctattagtggcataagaacctagctaaaggggagtgcagctacagccagaggcctccattggctcctgccagcaggggacctggtttctcagtgcccagaagggcagcttgtcactgagtgacccggacgccctcctgctgcgctgcaggttcaatatttgggtcagagttggctcctttacctttattttcagctacatttcttccaatttgattggagtgagagaagagcaatgggctgcaggattgtagagtgtcagctgttttctgaggacctttttcagatgtacatttgcttaaatcattcacttctgctccaagtttgaacataaagtgcagaggcagcaccgttggtagcatcttggcagtgggacagagtaataagctaactatgcagagtcccctgttgattccttaagtgttctccattttttgtccattgattagtactatagttatcacaggcaggggacccgggaatactccatttcctaggtcccattggacagtgacaagggtgagggcagcttcagtgaagcaaatgtattcaggcagaagatacagttgagatttttgagagaaaggagtgaaataaatggtttattttctttgtgagcagaatcagtgcagttgcacagcaccgctttttcatcagcgtccaactgaggagaggaagttggaaggtgggaggctgcagtggctccgtgcgactcaaagggtttgctttgggagtgagtgggcaccctctgtgtgtggccagttgctcaccccaccccaccacctgcatgtggaaggcaggttaccatcttaagtagaaatgtccatggattggataatgtcatggatgtttttgattaaatattttgactctttcatgaaacattacagccttgttctggtaaatggttagttatagctcagcgcagccaagttggcacatacttggtttgttagagcaaatcttgcctgttcagttaatttaagtccatccttataaccagggtaataattttgtccagagcgttgctgttgacgtgaagccctctgctgtgtcctctttcatctgctcctcgtagtgacgcctttaggtggcattgatattcctaggatccctgttttagcaaactgagtctctgagaaatttaagtgatcttttaggtcacacagctaatgctttgtaaagcatttcctaaatccagatcgccttactctaaatcttataatactgttactactatgccatgtgacttggcaacttggaatgtttttcatgggaaatgttagtgcaaattggaagagtccttcatgctatgatctttcctatttataaatgcaactgccatgttcatgagaatttagaggaaaacaaaagaacaagaaagcatcttattgatgataaagcctttatagatggtgcagagcatcagttcagatttgatgaattggtgcgtggcattttcatgtggaattaaatactgatgccaactgtggctgagtattctttctgataccagcttttgggcatagtacttcatcacctggggcttctcttccttaatctataaaatgaaaattttgaactagcttatctctaaaactccattgattaaaattcttgaactgtatgaaatttgataacttagacacaaaaaataggtagataatatgagaaaagttaacaaatgttttatttactttaatattttcagtaaaattaattcttaggaccctgggtaacaggattgaaaaataacttctttgccagcacttttcttattttaaaattggcctgctatattttaaatgtgtactgacctgcaaataacaataaaagtatattttatgtatgtaaatattgctcagtgaacaaattgtagtatggaattgatactaagattttctgtgttaaaaatggaagtcagtttccctatgcatatttcagagaaacaaagtcatctggtaatagtgtgtttttgaagatatgtttgacagcaaaagaacacttaaaagcttagcttggatttgccatcattagtaattagggaattggaaattgaaaccatagtgagatataccactcatttagaatggcttaagttaaaaagactgaccacatcagttattggtgaggaagtggaggaattgaaactctcatacgctgctggtgggaaggtaaaaatgatacaccactttggaaaagcttggcagtttcttaagttaagcatacacctgccatatgatccagccattctacacctaggtatttatctaaaaggaaggaaatcataagttcatacagaggttgtgcccaaatgtttacagcagctttatttgtagtggctccaaactggaaataaccgagatgcccaccagcagatgaagggatcaattgtggtttcacacatgcagggactgctattcgacagtggaaaggaacgaacccttgatacacacagtagtatggataaatctcagggtaattatgctgaatgaaagaagctggacagaaaaaaaaaagagtacatactgtcccattccagttctagaaattattttagaaaatgcaaggtaatctccagtggctgagagcaggtgagtgccagggagggagcatgacagagggcatcagccagctttgaggtgagggagaggctcacggtgaagtgggtatagacaaatgtcagaactcacattggacactttacatttgtgcagcttatagtatgtcagttagtcctcagtaaagccgttttgtaaaaagcttggcttggaaacagaagaccacatgcacacacagtttctttctgcaagtgcagttttgacttatgagtcttgaggcagcaggcgttgcacagggtatcaagcgggaggtcccgacttgccccatctcaccagctgagccggctgtccccactagacatacagaagatgcgtgagctgactcttagtccctgaggaggctgaaagcattttctctacatacaagccaccagggcccatttaatgtaattaattgtctttttcagttccgtgaatagtaccccagagatctgcaggagttaatggactttcaggaagtaggctctgctccctggctcccacctggcccaaagtcattcttgccactctcattccagggtgtctttactcatctaggtctccagcagcctgttttatggtggtggcagtggaggtgtctgcgtcttttcagcatgcacactctttccgttgaaggcccgaactgttggcagcctgattgtggggcctgggctcgtgccgtcacctccctagctccacaccctggtccctggccaggctcggtggtgaattcctctcatcacattgtgcacttccttctgtgtgcttccgggggaaatcggtggtttaataatgaaaaattgaaatacaagtgtccacctgctaagtaagagcccgagacatatcagcagatgtttctgcgaactgagggtcttttcttatttccactgcagtctggattgagcctcgggagaatgggaaagagcagcttcccttccctttcctttttctcttttgtgacagtgctgcccgccgttcgcctgtttattttcctccctgcggcggtggcatgctgcttttgttgtgcatgtgttccgctggcagtgggactggatgcccctccctcccgtccttccttccttccctccgggagtggtctgtcaccagtcccctcccagggcaagtcacacaccgtctccactggggccccttggacaccgggcggcccacctggtggtgcagccaggccggccggcctcacccccctctccccttccccagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcaggtgggcctcacccctctcctggtccgaacagattctgaaaccctgcctgtgactccccttccccttttactcttgtgagtggtcagctctgcttctctgtccagctgagtgcagagctagtagtgtctgtgaaggcaaaggagagagaaacggctctcttctctcttttcctttcccctcccttctctccctccttacagtttaacttcataatagttttcattataacatcgactaataaaccacataatttaattttaatattttctcttaacatccaactagtaattattgacacttctttataaaccagattaatgtgagcttccaaggattgcgccctcaggctgatctagagcacagcagtattcacctcccaacgtccagattcagtcaggcctgcatggggcggacacccacccccaagtgctcttcaaagcaggatatggaggcagagccaggattggttttgtttcctctggaagcaaattttttttattgggtcagggggaccatttaaccccctactgtatcactcaggaaaatttatcaaatcgttgactgataactttacgtgacgttcactttgctgagagaggcaggcagcagttacttaataaaggcttaattgattgcattaaaggttaacctctcgtgtccaatatgactctgtcatttatactaaccaggtatcatccattttttacttaagaagaaaagtggctaaaaatacaactctaaagtaattttctataattattagccttcttaccaagtgatttcagaaaatgccagagaaattcttcaatgtatcctcagattcagcaggattgccccgaggaggaagcctaatattgttttgcaggagagcagcccgttccattttctgagacaagcagtgcagcttcctgccagctttcttcccctgaagatttgcgtggccggatctggtatctaacaatgtgtgactttctcatccaattcctgttcctctgtgtgctctcgcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacgtgagtgtcccgcggctggcgcctgcctgcctgtgggagcccttggcttcctccacagcaccggcgccctcttgtctctgccctgctgaggtcctgtgtcctcacccacaccccaaccctctgcaccaggagggggtgtgggagggagagagggtccctggaggctggaattggatcatccctgggaggctggggtatgctcagccctggaccctaatgttggaaactatagagcaggcagctcgcgtggcaggagcagagcacagcaagcgctgagcggaacagaaggaagccagcacagctttctctcggccttggggtgttaaaacctcgattgggttgcacacagcactcccttgtcctcagcttaggcacaggcatcagcttcaggcagcaagtcttcctctcttcctccctgtcgtcttctcatccttcccactctcctcctgtcctcaccctccccttttctctctctctccaccttctctctctcctaccttttctcttccttgcttcctccctttctctttccatctttctctctcttgcccttctctcttctagagtgggaataatcctgacttgtggtcgtagcattttaggtaacaaaaaacacaatttccccccacaaagaggtgttcttagattatccatgattcttacctaaacgtggacttttgcatcttatatgtgaacaggagaaagaatttacaggtgtcttttatctttcttcaacaaaaagagagtggttctgggttctgtgcttaggaggagctctcttttttgataccatgcgagcagaagtcagtccaatcacatgagcacgaatttacctgggaacgtgacgtaaggagcctaagctcccctcagtggtgagcctgctctcctggagtctagccgcttcttacagctggtggctgtgacagcccgaaggcctcctccacatacctctgggctgccctgtgggtcctctgtgatggacacctgtagagcacaccctctcaatatttatttcttgtctctggtttagaattcatcagcagtccttggcactcaggctggggatggcagggctgtgcgtagcctgccctcagtcacctcggtacaggagggaccttctgcccatagtgggccgtgtggcttcccctgggcctgtctataggcctgccctggggagtggttttggtttgtggtgcaagggccagaccagccctgcgcaggactctcctggatgcctttgcttggccacttgtctaagtctccggcactgttttcgttaacaacagaccttcttggctctgctcattctcatcattagtgaataacaagaaaggagtcaaaccctaaacatgtggcatggtgaaacctcttcagatgctctcaaagtcttgacatttagatccacatggagccatgtggagaagaggcacctgcacgccgacctctgccccgtgagggcctgccatgtcctccccaaggtagcagcacagaataaacgggaggccagccacgcctactttcctctctgacttcaaaggactcgcttttgtaaaacttagctgcatattgaatattttcaactagaaaacacaaaccaaccagaagcattagttgcagtttttcttccaggacattttgatacttgaaaaaaaaaatcgattcgtttatcttaatactataaagagaaaaaaatttttaatatttaaaaaattgtatttatcgtaagtatatgaaagtacttccgctttcattgaaccagattaggaaacaaaaacatacatttttcccccaacaaagccacgaaattacaagtgccctagttagagccagcgtgccacagcctgggggagctcatcctgagcagaggaagctgtacctgcagcccagtctcaggccagcttcagatatggttcagaagctgttagaagatcacagcctgagaacctctgttctctttaatcctgaaaaatgaaaatctgagcagttcaggctttggccaggtttcctctgttatccaggaagatgccacatctgacggcccataggagtatggagttatgtcgatggtagaattgatctgttacccggttaatttattttaagtccctcatatctcttgtgtttcaattggagtagcgtctccatctcagatgtggatggaggtccagtgtggacagtcctcctgtggagaaggtgcataggatccacggaaaatgtcactccactgaagtgggtggtgtcgtcatctctcgcaagaagcttttcctgctttttagattttataatctttttaaagtttattatggccagacgtggtggctcacgcctataatcctagcactttgggaggccaaggtgggcagatcacctgaggtcaggagttcgagaccagcctggtcaacatggtgaaaccccatctctactaaaaatacaaaaattaggcgtggtggcgtgcacctgtactcccagctacttgggagactgagacaggagaattgcttgaaccccagaggcagaggttgccatgaggggagattgcaccattgcactccagcctgggtgacaagagtggaactccatctctgaatgaatgaatgtcttcaaagctataccgaagcacagaggacagtacagtggaactaccgtgtgcctgtcccacagattcagcatgattttgccagactggttaagcttctttggttatggctgtgctatagtattttagagaaaatcattgccagtttattctttcactcctaatggtttttctaaaagatgaggccattttcttacatcccctcaatcaactaaacatctccccaatttgacagtcatttcttattgtcatcgactcccagcgtgttcggattgatgtgggtgcctcaattaggaggcatgtgaggttggctcttgtgtttaatggtcagtttcttaatctagaattgtctctcctttgtcctcctcctcttcttttcatgccatcatttgctgaaataactagattggttgtcaaaggaaccagatcccacattcagtgtttgttcacttgtattattttagattgtgtaacttttagtttccctggcgtttcctctaaacttagaagttagatgcaaagacctgattctggttctgtttttgtgcacgagtctttgcgaggtggtgcatcgtagttccccatgcgaaggctgggcctgtctaatcccacttccctcgggaccctgaggccggttcaggcaccattatgctgagccttctgtggttaagtcccctcagcctttttctcacgacagtttactatgcgctgatgatcattgcttatgagaatgtgaaaacaattttcaattttattattctttctgcatttaatagctagattcatctataaagaggaattcttcattatgaaatgttcttttatcttttaattaagcaccaatatttaggataatgattggttttctatctacttttttttttttttttttgagacagggtctcactcttgcccatgctggagtgtaatggtgccatctcagcttactgcaacctctgcctcccaggttcaagcgatcctcctacctcagcctcccaagtagctgggactacaggcacatgccaccacgcccagctaatttttgtattttttggtagagatggggttttgccatgttgaccaagctgttcttgaactcctgacctcaagtgatccgcccaccttggcctcccaaagtgctgggattataggcgtgagccaccacccccagccgatttactgtctacttctagtggagaccaaatactttttcttttctttctttttgacttttagcttctcttactatttttgaacaccattaggaatattactggatttttgtatatacggtatattttacacagttttggtaatttttctctttagatacacaaagagaaaaattatttatcttctctttcggtatctgtggccattgggaaccccttcatctggcttctgtgtccatttatttatttatgtttaatttgtttaaacagctttattgaggtgtgatttgtataccaccaaactcatgcatcttaagtgtttgacgtctctgtcctttggcagagagacatctcttccttccttacttggtacagagtgagaggtggctgcatgtatattttttttgtcttgatcttaaataccttctttcagattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtaagagggctcactccatctgtgtccgttgtgatttcttcatgtcgtcatggcaattcggcttatttcagtgggatgactgcaaattttgttagttcctatgataaaggtattatagatacctgttctttaaaagaacgtttgcatttttatgtaatacagtcacatttaacatggttagagtactcacccatgatattctcacatactattttaagtatcatgaactttaattctacacaatgatatgttgtatctctgtaaatgaactataaatcccaggaaaacattttcacattctttatttttttagtttatgttttaccagcagatgtcactataggttcagaaatgtattagaaacttagcaacaacctgcatactgcattattcattttacacaaattaaatgcttaccaaagaggaaactgcaagtaatgaggataacaacaaaaaaaaccctgaaattcgctcatttgtaaagaatgccacactttcctagttatcagtgtgggagtagaaatggatgggatgtggatgtggattgattgcctatacatcctttgacacactttgccctccttgaacttgcccttcagcataatggcttggcccccagctgggcagatcattcacaaaagcagattttgtgccatccaccctttgagaacagaaggttgaagtgctagctgaattctagggtctccctttaatgtccacaggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgagcaaacgactggatgcttggggaggctgcgctacagatgcttgatacctcatcgacttcccggaaattctgacctgtagcattgggaaggattgtgcctgctcagaacacagctttcctgatatgtaagataatgcgcacatacacacacccccgccccccgattacagccatccctaatgtgtgaaaagggagccagtggccaggacagctggctggctgttcacccagcacaggcagcacttgaaggtaacagcccttggcttctttcagtattgatagtctgtctcttgcttgaaaccctgagcatattgcttcttatatgactttttctgcccagtactgttaggatctggattgtttctcagactccagatgcctggggcatttcttttgttatcaggatactgtaataccacatcctgatggcatgacaaagtgaaaatgggacatggggaagggattgcttttggctcagtgccagtgggattctgtgcatggatatgacattttattaactggcttgatggagggagagaaaagcttatggtgccctgaaagatgcagagaaagcaaacagaaagtaagtttggttggaggggacttaagatgcctctggaccatgagcaggaggtggtgcagaagtaggtggcactcacatcagaacaggtagactcttcagtcagaactgttgaaaagagcacctttcagtctcccacatgccatctgcagtgtgggtatttttacatataaataagtgttgtgacctgctaacaaagccctccttcttgccaaaacacaaaacagtttatttaagaaataacggaataaataaatgtatcccttaggattcacctttgcctaaaacagagactaaaaaatagtggctttgaaaaggtgttttccgcatgtgacaagtcagaatgtagaagaagattgctggtctgcatttagtggtcccatgatacattaggctgagatcttggtgatggctggcctttcccttctggttgccaagtggctgttgtagctccagccatcacctccatatcccaaattatcaggaaggggaacgcataatgagaaagaggcagcccctctatcagaaaagaaatattttcacaaacttccccagagactcctgctttgctttcattggctagacttgtacattactgtagccaagctgtaataggagctgagaagtggttttattgtttaagccctcttccaaagttggggttttacttagaaaaccccagacacagagtggttttattgtttaagccctctctcaaagttggggttttacttagttggagtttttctaagtaaagccccaactttgggagagggcttagacaataaaagtacttctgtgctaagtaaacgagagggcaataggtattatataggttacttgaggtcactgccacacctaactatccagaagacctcccacaatctgtggtttccactgttagaatttacttcctctgagtgtgtgtgcagttgagaagctcatggtttgaacctgatcattgtagcacaatgttattcataccttggttattatgccattcaacactgcagttaagttggaaaaagagttcgtgaaataaattagttcccccttttcaagcatttgccaatttttcagtcctaaaaatgctggaaaggaatgaaaaatatttttcttgattatcagggaattcctggtgtcagtaggttttctaaaatatggcccataatctgttttgacttgtggactaattatcaacaatccactggaccctccaccttttcatttcccatttgctactaaaaataacagaactaattaaaaagatgcagcacttgcagtcaggtaccatggaagaacatcaggctgttgcctggattttaggatgacgaaggcatcagtgcctcgtacctgccaggagcaactggactatcttgcacgcttgtatctcacccctggtggtccacaggattctctgggaagtccactgcttggagttatcctgtgtaatgtttcaggtgctgggttggatccgcaacggagagtccatgttaaatgccggacttatcacagccagctcgttacaagaggcagagcagctccagcgagagcacgagcagttccagcatgccattgaggtaagggcgctgggcctgcctgtgtgttggctctttcattcctcaggacaaacatcctgaatcccccaacatggcactgaccatgggaaccacatggggctggcttggtaaagacgactcagaggacccaaattggcaacgcttctaagtctgcagctgattacaggaaagggaaacagtgtggtgccacggtgaggtgaggatctgcatcccagccaggcagcctcactgcaaggatcccaaaggtctcggaggccagggggttcctgttgttctcctgttgtaggagccctggcaagatgcactttctctcatctggaatggctcagaaccgaggagcccacgttgcagtctcagctgaggttttctaatcttgctggtctcttaagcacatttctgctatgttaccaacctcaaccaagcagagagctcagcaagaccaggtgtatatcatgaattcactatcagtcagtaaacgatgccgacagcaaaactcctcagattcctgcttaaaagcagccttgttcaccttgacaagggtcactgccatgccagaactgtcgcaaaatgactcaggccaattccaggcctgatccaattaactgtcagcatgtggactaattatttttattttttggtatgggtagggcacatgggtcatggttctgattggtagtggtgaggtaatgtcaaaggaaaaagaacatttgattacagaaatgttatctcctgctctgctcacatacatgttgtcagctagagaagaaagctacagaagttgccactaatttattccctggattaatttattgtcaactgtttggtgccattggacatgcattaacacctcttcctgaggtgcaaactctgggcatctgtatactgtgccaagggatttctagtaattaaattgcaggtaataaatcactgtgtctgggtaaaggattagaatatattgtatatagtgttttatgggatcatttgtacttcttcaggcgaaatgagaggttttgctattgtttaaaaaaaatctgtccttagagacctgtgctctccctgaccacaccctcccttggctctacggcctcactggagagaagcttacctctcagcccatcctggctcttctagtgaagacagctgagcaaaatcctactgcatttgccatgccatttgcatagatttatcagatggcatggacctccagagaacacagttgtttcattcttagctttttgatttttctttcctttttaaaatcaatagttcttgaaaacttttcactggagtccagagtttaagttgcaagtgaaaataaaaagcattcactctggccaccttttctctgcttgttcatttgcttccagcagctattatgagaaggatcaacaggaataataaacttggaacatttcaaccacttctttggctgttaagggtctttcctgctatttctcagactaagaaccctacaaccgagacccattctgggaggtcctgatcaatttcatccttcattagctaatttaaacatagatctagttgtttctcggcataaaaccttttttgctaaactgtctgctgtgcttttagaagcatcctagtgagtattaactgaaggtatttccacaaaatcatgaagaacagagtaactgtagccatcctggttcctttctagtcagtggggacactgacaaataagccttcccttttgttctctgtctctagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtcaggggagaggttcccttccttgaactccactgatactttattttgagcttaatttattggacagctcaatcattgttaacatgttcatcgttattgaaacaatcagttgccagtcaagcagggaaaaggcattctggagttaaaattattcctgtgtaccttagatgtcaaaggtaataagctagaaagtagctgagaagacacctctcttcttgtcatttaaacataggacctgaagcacattagagagagacaggatatttgctttggttttgttctcgctctgaaaagtctgcctgcttttgaccctgtagttgttctccagccaggtggagcccatggctccttcttatggtcttgatcctcctgacagcatcttcatccccagagcccgactgaaagggctttccagggataccagtcggcagtggcagatgccaagtctgagcctcaaacttttcctgctcacaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggtaggggcagcgctgcgggacagtgcacccatcagaggcttcctgcctgccaggtgcgcgtggcacagtcatcgcttcccaagggagcctgccccacacctcttgcctgctgtggaatgtaacggggcagtgtcgcatcagtgagaagtcagctgaagaaagaaaaccttaaaatccttttcatgtgcgattgccttgtctttctagttttcacagggaaatagctaaaaatctgtatgagtaaggattggttggaagtcacaataccaggtgatgctggagacagagtgattgagtgattgattaatttggtgaaaaacaatacctatagcttaaaataatcttcctttggagactcagcctcctcattcccttcatagggaatgaagattgcatctcagaagaggtgtaagcacggcatggagtagacacagtgcgagcgccacacggcttgtggtggcagttgctgatacctactcaggaaatgcttccgacaagagaaatgtgtcacatgcagaccaggctgggagttttctctctgagaagctttaatgaggaatttttcaagactgctttttcttttctttctttctttctttctttttttttttttaattcagcgaaggggtctcactctgtcacccaggctggagtgcagtagtgcagtcacaactctctgaagacttgaacttcctgggcttaagcggtcctcccgcttcagcctctctagtagctgggactacagtgctctgtcatatttttataaatgtcacatttagtcatacatagtcacagacgtgctttggaacagttaaatttttcaaagtagttgaaacatttagcaacatttggtgctgaatgttctgtgttgcattcttgggcccttacagaatttctgaggctctgcttgttatcaccacccagacccattaaaagtaggggtggtggtcacttttcctccttaccttctcattgcttcagcgttctcacctctctgaccactttcctgttacacttaacactttctgtgtttttttctgaagtccgtcatctgacagagttattgtttagtctgggaggataaattgtaactctttggaaattatatctggtaacttactttgtgctcccaccacagtgattttctttttaagcaagctcccggggtgaaaaaaccatcacagtttccacggtcattcgttataactacgtcaacagctttttaaagcccctgcccccaacatgtccctactgcttaagtttaccaaatgctgaccgctgttaggatttcgaggtggaatcattagaattttcccctttgtccaggatctgtttagtatgaaagaaaaatgaatgccacttagttcatataattaagatagctatttaggtaaaattacaaaacaaaaatacaggcggtcctcaagttacgatggtttgacttgtgatttttggacttgttggtgtcagtgcgctgtgcattgagtagaacctgtacatcaaatgctatacaaccattgattttcactttcagtgcagcattcaataaattacatgggattataaaataggttttgttttagatgattttgcccaactgcaggccagggtaactgtaggcttaaattgagcacttttaaggtaactaggctaagttaaactgtgatgttgagtagattaggtgcaataaactcatttttgacttacgatttttttgacttacaatgggtttatcaggataagtcaaggagcatctgtaatcacaagcctttttggatccctttgttcaactagaattttgtggtgtttgtgtataggatatttaagtacctttttattatgggaatttgaagatatgtacaaaaggagagagaatggattctcctcctattttactccttacccagcttttctgattatcaatgtatgggcatatatctaccttcagtggattatttaaaattctagatatatcattttatttgtgaatttaaacattaaattctccctttcagaaatacaaataaaataccattatcatatctttaaaattatagtaattctttaatattatctgaaatccagcattgttaaaatttttttgattgttctgtaaatgtcttttttttttttttgagacagggtcttgccttgtcaaccaagctggagtgcactggtgtgatcatagttcactgcagctttagactcctgggcttaagtgatcatcccacctccgcccccctaggagctaggactacaggcacttgccaccacacctggctaatttttgtatttttttgtagtaatggagtctccttatgttgcccagcctggtctcaaactcctgggctcaagtgatcctcccaccttggcctcccaaaatattgggattacaggtgtgagcctccacacctggcctataaatgtctttttatacatggttttaattaaaattcaaacagggtccacatattgatttggttgggtatgtcttttgaatcacttttaatctaaacaatactccctcctttcattactatttattaattgaagaaatacgttcctcggattgaggcatttcccccattccagattggtaattacatcctgtggggtcatttagcaccatccacaatttgtagatttttgttaggttgtgagccttgatcagagctggtttgaaaggcggagggggggcgatggtgggggaagaaagagaggcgggggtgtgagagagagagagagagagagagagtgcaggcgagcttggaaaaccttgccagtggtgcttgtacttcctatgggattactcaggagacacataatgtctagttctctcttttgtctctgtgattggtaagaagattgatcagtggttcaagtacggtcagtgcagttcatccctctgtacttcccatcagcctttcagctaatggtgttagtacccagtggtaataactgttttttaggaattgcaaaatggtaatactctaattctatcatttcctttggcctcgattagctagaattattccctctcagctatttggttattctaaagtagagtttgtccagaaaaggcagagtaaatgcttgcttgatcctttttatttgccattttcaggataatgaattgttgctatagcaacttctacatatgacttttttttagtatcatcatggatttaaatatatttggtgtgtttcaaagcagtcactgtcatttatcttttaacacgcagctcatcctatccataggagccctttcaaggcaggttgcttagctgtccttagccatcaccctcgtagtcttcagcgtcttccttgttgtttggtttgacagcgtattagtccattctcatgcgctgtgaagaaatacctgagaatgggtaatttataaaagaaagaggtttagttgactcacagttccataggacaggggaggcctcagaaaacttacagtcactgcagaaggggaagcaaacacgtccttcttcacatggcgcgggaagtagaagaatgagagaagtacagggtgaggcagggaaaagcccctcacaaaaccatcacatcttgtgagagctcagttgctgcacgagaacagcatgggggaccacccccatgattcagtcacctcccacgaggtttctacccctgacatgtggagattacaattcggattacaattcaagatgacatttgggtgggaacacagagccaggccatatcagacaactcgaaatttcacacgaatcagtagagactcatgatgtgtttttctcttaattgaaaaaaaggtagcctcgctccatctactgaaaaagtctggaaacagtgaccaaccccaaagccctgaccatcccgaatgactagactgtgggctctaaataccatttaacactagaaggagatagagctccttgaagaaaagattaattccagacccaagacaggaaatgcacaagatgtttccaattcacatataattaaagggttttttccttaccttctttgattttatatttgtattcttttatctaaaacccttattttaaaatatgtgaatgaaactggtttggtttatcctgctgcataaacataaacacatattgtcagttaccataataacatcacataacaaagtttcaaccagggttggcaagttctgaactgagggctaagttgggccacattgatacagtttacctgtcacctgtggctgctttcatctgttgtttgtttgagtagttgtgacggagaaacagactgtatgaccccccaaaactgaaagtgtttactgtctaccctacgtagaaatccaggcacagcccagctgagttctgcagctcaaggtcactccttaggctgtgatccagggtcaggccaggtgtgcaaacctctctagactggacggagacagggcttcccttcctccgtgaccgtaagccaggggctgccctctgtttcctgccccatgggcctctctatagggcagaatgtagcagcaggtgtcatcagagcgagggcttcaggagagagagatttttttttaattgaattagattttatcctatgcattttctaaaccagcaggtggccagataaatattttaggtaaagacatacgttagagtgcagtgatgtgtactccaaatacacgtttgtagaagtcaaattagcaacacattgctctccattgttttttaggcttgcacccttgctcggaggaatgcagacgtcttcctgaaatacctgcacaggaacagcgtgaacatgccaggaatggtgacgcacatcaaagctcctgaacagcaagtgaaaagtgagtagagctgggagtctccaggggtggcccagtgcatgcctggcaagagacaaaaggagcctgcacgttgtgttctgaactctcaacttcagtttcattttaaatgtccgtttcatgttaatgaagtccttactaatgatcttagtttaataataaaaagattaaacaaatttataggttgatattatattgaataggttgataatttattgaataagttgaagaatataaacagggagaaaatgcaaattcaggatgatatttactgacattggctattttgttaaagtaagtaaaaaataaatagggggaaagggaaaaccagagttatctataggcaaaggatttttaaaagctcaaatagagaaaatacatcccaattttatcactataaagtattattaattttgtatacctaaggcatagttaataaaaacaaattgaaaaataataatatataggttatatcatttgagtgtaaaaacctgtaaaaccgtgtttgtgtgtgtgtgtgtaagtgtttagaaaaaggtctgggaaaacgtatactaaattgtaataggattgatgtggaaggaaaatggataaagaaactaaggcacaaagcaagtaactttgaccagggatacacagcctaagtttagttttataggaaaaaaaattgtgataatcagttagcaaatgattcatctcacacttttcaaaacaatatgattggcaaaaactttgtacattacattctactgtctgctcatctgattcatctgttagttgtcacaaaataattttgttacaccactataattctctaagttctttcagtaaaacatatttattgatgggctttttcttctggaaaaatgtgcaactcacaaaagcaaccgtttttctgcatgaataagtcttctgggccagcaagttatttgcattgataattggtttatttggctcatttcctgtagaaataagttcacccatctctcaatattgctttcatttgttggttgtgtcctgtcttttctgattgaagatattgtggtcctttttaggttgcgctagtttgacacacgtttttgtgtgagagggagactgtgtttcgtttattccctcgttagatcttcattatgcctttgctgttgtatatcctaatgttggatgctgtgaagaattaaaatagaagtgttctgtttccctcagagcctacttgggggtgaaaggtttatttatgctcgagtcagtgcactaagttcctgtaagagtaatggtggcagaaaagacagtctaaccccaaggcacaggcaaggaggagtctcagaccacgtggtcagaggacccccaggagcttgaggaagccccgtatccaagagggcgcttagcactgtttgctgctcacttgcccgaaattagtactggctcaggcagagactgtggaaataggagactagaaaaaatgcgttatctcatattcattttcatgtgcaatattttcatgtaagtgatagcttaattttttagcagacttcagatttcaaagttttaatttatctcactgtgctagtttacctcttcagtggagtaaaaataacagcatgaccactggtccctgggggatagttggcagtgtctaaaggcattttttattgtcatcaaaaatgatgacaccatattgtcaccataagaatatggtggtatttagggtgataatggtagagatggagaaaagtcaataaatttggggttcattttggaggtagtattgagagagtctgttgttaggctggatgtaaatgctgctcttctgttcttacttatcacaaagtacagactgctaggaactcagtaagtatttgtggaaaacttcctatattaatggttttccagtgtaataaagttaccgggaaccctttatttgatttgcagtttcagtcttgggaatttttttcttaagttttttgtttgtttcataaacttctagagcaaaacagacttagtgtcaaaaactcaaaaagtgtacaaatacatatgttagctaattccttagctactggtaaccactgtcaaggcttttgtgcaacctgtctgtgcatgtaaatgtaaatatgtagagaaatacaaacatatatttcactcacccatcccactttttaatttgttacaaaaatgggactgtattaccttgcaacttgcatctttcacttaataatatatcttagtcatctttctgtgtcagaatttaaagatctgctgttctttttaatacccagtatagcatttttgaagttaatttgacctgtctctcaattgatgggtcatacattgctgcctattttccactgttctaaccagcgcttcagtgttccaacatctttgtaaaaacagttttgaatagttgtgtaagcactgttcatctgaaagttaaattcccagttcaaaggaatgcatgcaccttttcagtgtcattccctggggtcatcatactcagtttttctccctccataatagaggatcatgattacctgttcccttactctttccaacactggatcttacccgtctagcaggaaagcagtgaaagatggtctcattgtttgaggttaaatgtgttcctgtatatttagtgactgtattttttaaattgtgaacttcgtatttataggctttactcattcttctaaagaattgttcatcgtttttctgttgactattctatgtcatatgttcccaatgcttaaaaattttttgtctgtgcaccagtttttggtggttcttgtttggttatgacattttaaatgtttgtgtcatgaggtttgtttttttttttcttgcctttatagcttcatgcttctctgcttccccacttcatgtcctttcctctcctaaggggttatggttttgtatttttttttgtttttttttttagacggagtcttgccctgtcgcctaggctggagtgcaatgacatgatcttggctcactgcagcctctgcctcccaggttcaaggaagtctcctgcctcagcctcccaagtagctgggactacaggcacctgccaccatgccctgctaatttttgtatttttagtagagacagagtttcgctatgttggccaggctggtctcagactcctgacctcaggtgatccacccatccgcctcagcctcccaaagtactgggattacaggcgtgagccaccgcgcccagcttggtttttctttttttttaatccacccttgttgattattactccactattttgacacaacctttaatctgtataaaagtccatctacacaaggttttaatagtcttgaaaaaaatgctgattttttttcagccattgtcgaattgcatattataaaattgtgcattatgtcgaattcatattacaaaatacacatatcccacgaatccatccagccggaggtattacagactgacgttaaatttccagtggtgtctttatcgtaagatggtcaaatggaggtgagagtgagaagaggtctggtcgacatgctcactgagacaggaaagcagtgtgattctttatttatcgtgctgtcttgcaatggcatttgcataaaagtctaaataaaaatgaatggaatttcgcgggtgttttaattgattgcaagcaccaacatacatcattttcttttttctctcagatatcttgaatgaactcttccaacgggagaacagggtattgcattactggaccatgaggaagagacggctggaccagtgtcagcagtacgtggtctttgagaggagtgccaagcaggtcagtgcacacctggtgcccagcctccccctaaactcccgtgctcacacctgtctccacagagaggctgagcttgacatttccgccatcttgaaaaccactttctaatgacaaacagtatagccttctagttaagtttgttataaaaagaaaaccccacagcctggtaaaagcatgtcactcagtgattttgaccctcagcaagtgtgccttcccctactgtctttacctcatctctaagacagcaaagtacaagtaataatgacaaggattatttaaaaattattggggaatcttggttctgtacttaggtaaatatgatggatttttttttatattgatgtatttatattttcaagacaaagtttttatttttccgattaatcaagttaaaattaagtaggaaatgtgacagaatatctttctttttctgtttcttttttttttttgagacagagttttgctcttgttgtccaggctggagtgcaatggcacggtctcagcttactgcaacctctgtctcccaggttcaagtgattctcctgcctcagcctcccaagtagctgtgattacaggcgtccaccaccacgcctgggtaatttttatattttcagtggagatgaggtttcaccatgttggccagcctggtctcgaactcctgacctcaggtgatctgcctaccttgacctcccaaagtgctgggattacaggcatgagccaccgcacctggcccagaatttctaataatttagtatagtcaaaaagtgttgatgtatcaagggggtacatttggagtatccccttcttaagtcattttgggatgaagtgcttctgcctgtatcatcagtcatggacgaagatcattttattgtaaaaatctgaccccgtcttaaatattaagattcctgtcacttctgttttgccttaatggttgcttaagaatccgtaaactttcatccagaatttggggggtctggagggaagcacaggggagaaggtgattcccccagcgtctgtgtgtggcccagccctggtctgggcgccttaaagtcccccagggcaattctgtgatgacagttggtgttgacccacattctgaccatgacacggacccattttctgaatccagcttgcaacctcatatgcagctgatccagagcaggcattggatacatgctttttagctgaagaaaaattaactttcttagcagaggtttcccacttaaggaacagctcttgttccaatctgaaaaatgtaagtctagaaggacgcagcccatgctcagaactgctcagttcccagagttagatgaactgggttcctaggccagggatctggcgccccaccttggtccttctctcctcctggtgacgttccaggtgtagccagcatgttcccaacagccaggtggcatgcagtcacgtttagtaaattatactctcttaacatttattagacagtttaaccatattcaagatcatcggaggcctggttagatttctaattagagatggtttcaggttcttttctcacataactttattatctctcttgaaagacaatccctcagctatagaaaagcaaaattgtacataattttgttggcagagaaagataatggaatgtattgttgcattttcctaaagtccgcttattcaccgaaaataaaatcctgaagtgcgtgctgttgcaggtggtgccccatctgccttccagccgttctgcttctgttcactgtcacaatatgcagcacatacccagtgctttcgcagaccggcctccagggctcttgctgatcttgccttggcgcaggcccctcccgcctgctggccacccaccccaggcctcactgctctccttcctatctcccactctagtcattgcctttcttggcgctcatttttggcttgttctcatctctctttcctcttctgtcttttctgtgcgctgtctcccagcccaggcctccatttctggtctccggattcacaaatcccagttacatccttgacatcactccacagtgactttatgagaagcagaactgcactctcggttccctgtctccgtgtccctcttgtcttacttgttgttagaaacaactaggtgtggtgttctcagttccctcttcccggcgccccgcctcctccttcgcgccccgcctcctccttcgcgccccgcctcctccttcgcgccccgcctcctccttcgctcctcgctcctcgctcctccctcgctcctgcaccaggtccaggaggcgcagacctctgggtttctcagccccatcctgtcgtatcccgtcccgcttcccactgctgccctggccatgtccccttgcccctctgctccagggcgctccccagggcggctgactcccctctctctgcactctagtcccttcctgaaaaaggctcatagtagtggtttctttcattgtacttttattatgcctttaggttcatggttacaagaaactcaaactattttttgtttttttttgtgggagtgtaaattagttcattacgacagtatggcagttcctcaaagatctagaaccagaaataccatttgacctagcaatcccattattgggtatatacccaaagaattataaatcattctactataaactcatgcacacgtatgtttattgaaacactattcacaatagcaaagacttggaaccaacccaaatgcccatcagcaatagactggataaagaaaatgtggcacatatacaccatggaatactaagaaactcaaactttttattgttgcgacataagtgatactgttataaccatctagaatatcctttttaaaaattttgtaattgtggtcacacttcagttttatttaagaaacttgcctctctgggagggaatgcttctcgatgctgccagccttggtttgtgatttgacctttaaatgaggtgctcggggctttgggctcctctcaggaatgtgtagccctctgactccattcattccttccccttccaggctttggaatggatccatgacaatggcgagttctacctttccacacacacctccacgggctccagtatacagcacacccaggagctcctgaaagagcacgaggagttccagataactgcaaaggtgggttcagagtgtactttgtatagtggcctctaagtcgaaagcgagtcttcaaaaatatcataaagaaatacctcatgagattggagaaaaggatgacccagtgggctgttccacattaactggaggatgcttcctccttccgttcacgtgtgtccctccgtgtcctccacctcctcccttcatctgtgtcctttgtccctctgatgtctgtgaatacggccatctctctccttttcttccttgtccttcccattattcccttctacactttccccttcctgtttacttctctaagatgttttctgaggacttgctatttttatgaaacactatttggtgtccccaagttgacctttatgtattcttggggtgttttctttcctacacctgggggtgtttcaccgtctttagatggtgaaaactgttacagtcgtgttgctcacgctcagttcagcctgcagttgtctgtgttttatggttggcagagtctgtgtcatcgcctctgttagtgcttgttcagaggtgtctaaaacttgaggcattttcatttttctcctgaaaataaaaataaaattatgaaatcgaattatctttatggcatatgccatatgtgtgagtaaatatggctttttgaggaaaaatataagaatctgcatattgacctgaatgttgtcccaattaaggcttatacctgcagaggctgagtccttccaagaactcacaacagttttgaggctcttttcaagtcaccattacaacctgtggggttgttgtttttcagagtctgagtatacgtcctttgtagtattttctgaagtgcctctattgttgatgacagatttcgagtttttggaaaaatctgacaattatttcaaatgtataagagtgggaaataaatgataagtgggataatatttttggttaaaaagaagtgtttctataaagtagcaagattggttatctcctgtggcccctaccctggctttgaaaacataacaggaatttttcaatcatgtagagagaggacagctactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggctgggcgcaggaccaggggacagtagctgcccccagaggcacaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgtgtctgtgtgtgtgtgtgagacatgggatcttgctctgttacccaggctggaatacataatagttatgcacattatatgatccgtatttaggggtgtgtgtgtgtctgtgtgtgtgttagacatgggaacttgctctgttacccaggctggaatgcagtggcaccataatggctcagtgcatcctcaaacttctgagctcaagggatcctcttcaaactcctgagctcaagggaggctgaggtgggaggatcgcttgaggccaggagtttgagaccagcttgggcaagatgacaagatcctgtctctacaaaaagaattttttttaattagttgggcatggtggtgtgtgcgcctaaagtcccaagctatgtctgcttatttgaatattgtttgattataaaggtattaagaaaatgcctaacatcacataccacactcaaagctagatttaagatttgccatctttcacctctgctccactctgcaggccattgtgtatggccagacagcctgctcactgcccagctccaggggccatgcatgggggatgtgatgtgcacatgactatttggaattgagtaacatggtggcctgctccactaataaagtgtatatgaaagaatttttccattcctgaatactccttttcctcaagtttgatgtgtggttattgaaagattgggcaatgacaggcttatttttattcttgtattttataagaaatgtctaaaattgtgagtgatatatgacctttctgatcctcagatatgtagaactgtttcttttgttgggtttattgaattggttataccaggaggaactggtagattttgaaaagaacacccctcacctttccttttcttagcaatctttttctttggtttctgactgcctttcccttaatcagaaaacacctgctttggtgtttggagatgtcctttgatttttcatcatgagctgaggctccctcacttgccttctgtcacccgatcttagaatcttctaagaaaccattttgcttttactgtatagagaattcttagctctgaaaggaaagtctttcagtgcacttgttacaatgttataacatttttagtgttgatggaaatgaagctggaaggctaaacaagagtctcccatccccggctcgctgagactcggctcggtccctttgcagctctcagtgcagtcatttctccacaggtcttgcaggcaccacctgcatccaggttgtgggtgtttatttaagagagatttctgtcctcactccaaacctagtgacgtaggctctcttggagtgaggcctgcggatgagcatttgaacagctcaccacttgatttttgcacacactgaggtccggaagccattgccttactgacgccacagccttcttcccatagggcttcctgtggtcctgatcaccagcgtccgcaatgccaaatgccttactttgttagaaagtgtctaacaccattgaatttctgtctaagaacatgatgagcaaagctctcttgagcttgtggacttaagacttcaatttgcttttatttttctccagttcctcgattatgcctacagatgaagttgttcagttaaaatgtttatgtgctttttaagcactgtaacgatctctagagataacaaatagaataagaatgaaaatccttataatatctcactttaaaagatgtaagaattttttttaatgatgttttccaaggtaaatggctttggaaaaaaaattaagttggatttatatctcaccttgataccgagataaataccagaagaagatttaaatatcagcagtggtacctaatagtaccagaagaaataacaggatattttttatatcctcgtatggagaaatttgtctaaatgacacaaaatccaaaccatgaaagaaaaggttaataaattcacctacacaaaaaaatgtaaaactttacacaagacagtccaccataaggaacatctaaagttaaaaatgaaatagagaagatatataggcagctcatatcacaaaggactgatttgccagtaagaaagaacttttacaaatcaataaggaaaaaaaagaccaagaaaatggacaaaagatattaaacatgtgtcatagcaagggaataaatggccttcaccatgagatcatcaactttacttaatataagaaaagcgtacatcaaaaccacactgagttcatttcacccagtggattagccgagatcaaaaaggtggaccccatgctgcgtggacgaggctccgttgctgggggagtggagcagggcagcccctcagaggcctccggtggcatcttcctgccccctcgcactcctgcctgctcacactgcacttcctgtctgccccagcagttccaggtctcacaatgtgtgttacggcagcagcactcaggcacgtgtctaaccaccgttcatgcaactgatggatttcttgcattgttgccgtggtagacggaatttggaaacaacacggagacctattggtggagagacgttaacttacgtgcatccacacagttcacatccatatagtgaaatattacccagctctacctaaacacaggcgaggactttagttctgatcaggaaggacaactaggatgtgttcagtagaaaatgctaatacagagcagtgtgtgttgtatgcaagtacacgtgtaagaaatatgagagagaaaaatacttatatacatttgcgcacttgcttgtacatgcacataaaatgtctctgaagtgatagcaagaagctggtgattggaactggtgacagtggaaggtggggtgagaagagtttttactttgtatcttttttatctttggaattttgaatcctgtaaatgtattttaaaaataccaatgcaagtaaaaatatactgagatatttttaaagttcataggttagcagatttatggtacttagtttttatcacaccattcagttgctcaataattcttgtttaattttggcaagctgcattatctttttatcttcacttctgtgtccccatcacttaaaacactcaatagctttcttaaccccttaaagatagacatacaggtagtttacagtgccctccacagatggcccttgtggcaatgtaagagatgttagtgaaacaagcaaagatttctgggctgtgaaggtgacgttctcacaggagaaggacagacgacgattgtaaaaaatcacttgcaccctctgtcagaaggccatacatgctatgggaagcagcagagcagaagaataggcagggaggcaagctgcagtttaagggggtccagggagggcccgctaagagagtggcgtttatttgagtagagacatgaaggagccatagggatatctgggggagtggctttccaggcaggagcaccagtgcagaggccccaaggagggtgctggcctggaggggtgagttggtgagccacagctgggggacgggggtgctgttgggtggctaggggctggctggagtgttggggttatttgtgtagagtctggaggatcttgacggctgacttcacaggttacccagtgaattatggcttagaactttgattttacaagctaagatcatttatctgggttttgaactccgaccttctttcttttggggatttttaaagtcagtttcctgaatatgtgttaaaaagattttctagttaaagcttaacggagaatagcaggttccatagaagaggagtaactcacttatttgaaaacactataacaaaggaagcctaatagtaataaccatcgaaatggatgtgaagagagagagctgttgagaagtcagagttgagtgaggttgccaaatggtatatataacttgttgtatggttgtctgtgtatctctgtgaaaaataataaactatgcttaacttaatgaaagatcttttctgtgtacatacaaaatagaataattttagagagagctctcaaacagggaaacaaaatttacagtacctctatatagatgatttcctgactagtgaattttcctccacattttctgagagttaaagcaatcaacacgacacagaggagcttcatgaggaattttgttgagtgcctgctgtggggacagccgtggccacacatgcttcaggaaaaccaaaaagtcagatgactgcttgccccgaaagagctgtgggtccagttgggcacaaagagtaaacatgcatagagcgaggagctgtctttgctcagcggctttgaggagagtagcagcattgtgaagaccgcgttcttcgcatacattcctccatgcatccattctacacatttttactaagcacctcctagatgaagacgttgctgaaaaatagtctaagtttattctttgaggtcataaaaatgccattcgttgtagcagagctgaggagagatagctggtcaggaatccgggagatggagtgggtggacctggggctttggtctcagtttctaccatcagccggttttcctgttcagagctcagagttggagtcaagtcgccactgtgtttcaggtttctggcagtcggattcatttgcctcacaatactttcctgttgttttttgcagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcggtaaatggccttgtgcaaactgaataaattatggtcttcttcctaacgccctctctgctgatttaattaactgagttcattggctctgttattccacagagtaaaagtctccagctagatatcattccagccagtatccctggctcagaggtgaaacttcgagatgctgctcatgaacttaatgaagagaagcggaaatctgcccgcaggaaagagtaagccagtctttcagaatctaccaggattcactggaaaagtgaagagaatgtcatttggacagacatgcttctgtgtgtgctttgaagtcacatggcacccaggctttttgttgctctgggtggacttagttgtgtcagcacagacttcgctgggttcactgtcctcttatcacctggttcagaaacagcatctagtttttatccctgtgcctgtgtttcatatggagttgatgaattgtcattaatagatagtgacactaaggagaggaaattaatagtttttatcacgcctaaaacaaatttagttgtgtaaaagttgccagttagtaaactctatataaataaaaaagagtgctctaatccagtggttcttaattggcagttttgtccccaatgtgaggggacactttggttgtcacagtggggagggggagggagtgctgttggcctctagtgggaagctgctgagcactctccagtgcagagggcagccccacagcagagttacctggccccagatgtccacagtgccaggttgagaaaccctgatctgtcggtacctcagtaaagtgtgtgcagaaatctttttttcccctttgaattagcgggtggatactgttctatttgtgattcacctctccaaaatgatcaatctaagactaatacttttagacccactctgttatttcataaatccataaaagtagatagtgaagtaagctgcaccctgactgtactcctcactgtcttcctctctttaaggttcataatggctgagctcattcaaactgaaaaggcttatgtaagagacctccgggaatgtatggatgtaagtaagttttttttttttttttttgcttgtttatttagattgagcataagcttgctattttattcttacctgttggtagtccttagaataatcacaatttttttctgtcatttttttaaatgtaaagtatgcttcagcagccggtttcatgtttctgcacttctgtagagttctaggtttgtttttcactcattacagagatgatacagcattaatcctctcattctgtttatcacatgatggcctggctaacactctctttgtatagaattgtacagcagcttcagagaaatgtgcctactaattatgactggcaactaatactcagtggtatcaggaatattggttatacttgtggagtaggttaattccaaaatttgaagctgggaataattttagagttgaaaagtataggaactcctctcaagtattaacagcaactgagggccttttttagaagggttttttatgttttgtaaaagggtccagtccttagttatactttcacttatacattaactctgtgtgtttacagatgtcagaaacagctgtttcttgaaaatatggtgattatttttgtctaatccctgtttccctctcggctagacgtacctgtgggaaatgaccagtggcgtggaagagattccacctggcattgtaaacaaagaactcatcatcttcggaaacatgcaagaaatctacgaatttcataataagtgagtggctttttctttgggagcagttacgcttgaaatccatgtgctgaagtttcatcacaagaaatgaaccattcccattgaattaagcagatttcagtgattttgtttccatttgaatgaagcctatcagtctttctccaaaaagactgacattctagaaattcttttaatacagactcaactttatgtttgtacttatcttctacagaaataagatcaggaaaactatgaaaatatttttataggaagcttaatttctctgaagccgagccgtcaggtgccctgtgacttacttctgagggttgagagacagtggagcccccttgggactgcaggcctatgctgtttgctctcttatagtaagagaaaggaactgaagaagcaacagaagtgtattctgaccaaaataaaatgcattttcctttggccacaggaggtacatgattctcttttaatattgttaaagcagcggcagcagaagctcctttaggtggcctgtgatgagatgatgctggggtcagcaagagcgcagtcccctcacccctcagcagaaggcagaaaagaccaaatgggtcttcagccaaatatttacgtctccgaagtatatgctcagtgaacacactagcacttgcccagaaataaatttgttagaaagcatttgaaggcgaaactggctagctgtttgaaagtcacaataacttaccctagttaagagctacatgttttgttcattctttagggggcacagatttctcagtttctggcatatctcactagtaaaatgttttaaaacacctttgtaatatgataccatttttattctttgcagcatattcctaaaggagctggaaaaatatgaacagttgccagaggatgttggacattgttttgttacttgggtaatgaaacctcaaccatttgttctctcccagctattaggtgacgttgaaggaagttaggagggatggtcttcatttcctttaagtcaccatcttctgctcatatccatgcttgcggagaaatagactttacctcaaagaattgcatacttcaactaattgtttttgtggagtgagtttttttattggccctggtgatggtttgaaatagaatatttagtgtgccaggtctccgcttgaccctggggatttgctgataggtgagttcccagtccttctgggggatcgtctagtctagaggggaggcagacaggtgaacgtgcggtcatgctgtccaaagcccacagccagctctgcacgcgtgactgtggaaagagaggacaggtgctcagcccgatgtgtcggggtcggggaggctgctgcagctgcatgctgtcagaacgatgtgtttcttatttcagtagctttctttttaaaatagagtctcttcaactcgaggcttaaatttccgttatccatactgcttcttttctatatgaaagtttatcatgcgttgacttgttatgatttaaatgagatctttttttttttggcttacaggcagacaagtttcagatgtatgtcacatattgcaaaaataagcctgattctactcagctgatattggaacatgcagggtcctattttgacgtaagtaatagattcctaaagagaccataattttccaagttgtgtacataaaatgcggcattactcataactttcacctaattgatagtacaatgttttcatttttgtctatcatttttgtctatcattttgtctatcatgtctattgggctattcttctattgtcttctgtttttaaaagatcctacacaaatactggaagccttatatctgtaaggaactcagattgtaatatatagatgtatgtttgtgtgtgtgtatatgttattatttatattcagtcatttataatatcattactatttatattcaatacattttttcacctgtaatactgtatacagaaggcataaactattaagcttcttttccccctcagtaaaacaaaaataaatgtgaatctttttatttttcctattttaatttcatgatgttacgaattttcaaaaacaacctaccagtaaagttttacaaatagtgccataacaactaggataattagaaggttaactaattgtgttctcattggagtaaacgtagatacaggtcatctgtgttttgaaagctgttgcagcggcttattcagcacaaaagagatggagctttagaacgtgatacacagagtgctttctgggtttccagaacttggtcaaatatgtgccaatacattttgattgaaggataaggtgctattgaatagtgtgcatagtttggtgcataaggttgtgaggatgttggacttgttttctgtctttacacttgtgcatggactggtgggatcatcagctcttatgtgaaagtctggggaagtagaataaacttttcagtttctatctttgagatgaagccctacctgtagatgaccctgttttaattgtcattctcctgaccattacattacacattacacatcactgcctttgttaataggaagccttctcccaggccaaagtggccttttcttgttaatatttcacatgattctaggtctttgccatcagacaaaattcagcacctgtatatggagttagaaatattttagtattaagtatttcacttaaacagtgagggcacatagcacatttaatgtttggaatcaaagccattttagaaacccttatgccccagcaaaataaactatcatcagagtgaacaggcaaccaacagaatgggaggaaatttttgcagtctagccatctgacaaagggctaatatccagaatctacaatgaacttaaacaaatttacaagaaaaaaaaaaaacctatcaaaaagtgggcgaaggatatgaacagacacttttcaaaagaagacatttatgcagccaacaaacatatgaaaaactcatcatcactggtcattagagaatgcagatcaaccacaatgagatactatctcacaccagttagaatggcgatcattaaaaagtcaggaaacaacagatggtggtgaggctgtggagaaataggaatgcttttacactgttggtgggagtgtaaattagttcaaccattgtggaagacagtgtggcgattcctcaaggatctagaaccagaaatgccatttaacccagcagtcccattactgggtatacacccaaaggattataaatcattctactataaagacacatgcacacacgtttattgcggcactgttcacaatagcaaagagttggaaccaacccaaatgcccatcaatgatagactggataaagaaaatgtggcacatatacaccatggaatactatgcaatcataaaaaaggatgagtttgggccgggcacagcggctcacgcctgtaatcccagcactttgggaggccaaggcaggtggatcatgaggtcaggagatcgacaccatcctggctaacatggtgaaaccccgtcactactaaaaatacaaaaaaaattagccgagcgtggtggcgggcacctgtatcccagctacttgggaggctgaggcaggagaatggcataaacctgggaggcggagcttgcagtgaactgagatcacgccactgcattccagtctgggcgacagagcgagactccatctcaaaaagaaagaaaaaaaaaaaaaaaggatgggttcatgttctttgcagggacatagatgaagctggaaaccatcattctcagcaaactaactcaagaacagaaaaccaaacaccacatgttcttactcataagtgggagttgaataatgagaacacattacacagggaggggaacatcacacactggggcctgtcggggggtgggggtctaggagagggatagcattagaagaaatacctaatgtacacaacgggttgatgggtgcagcaaaccaccatggcacatgtacacctgtgtaagaaacctgcacattctgcacatgtatcccagaacttaaaaagaaacccttatgccctaaaacatgtcttcaagaataagagaaatcatgcctgagagatttcacaatttatatgctttcagtattccttgtacagttggtttatttttttagaggctttcttctacagcttcctctcttctccaggctatctgataacctttgattatgcttcttaccagtaacaagcattattgaacatctgtatggtgctcatttaactctaagctctgtcttaggtgctagtgtaaagtggtgagtagcacagacagggcctgtcttcacagcaaggaatacagcaaggaatacaaccagttgtaaaggaatacaacctttacatgcaatacagatcattgcatgtaaaggacataattacaaaatgcaaagtgcaaatcatggcattaaaagtgcaattgaacagtaaggtagatcctcctgctccaaagtaccccttcctctccagaagtaacattttagaagcaaagaagtttgtgttaataatttaaaagcctcttaggaaaaggaaactttattatttcagcatgattaaacagttgtcaggtacagtatttggaaaagtaatgtgttttatggccatgatttaatagtgtagccctatgataactcttgtttcttgtttggttttaatacaggagatacagcagcgacatggattagccaattccatttcttcctaccttattaaaccagttcagcgaataacgaagtatcagctccttttaaaagtatgtataatgcgtcttcagcctgtgaaattttatgaattatgtattattttgacatttactatatatttatataattaccctgaattttttgaaacacctagtcaattaattttactttttaattcattagtatttattgacctgcctaatttctcattgcaggagttaaatgagagtgtgtgtcatgattatgcgtctgaactgcactgactgaccctaaacataaaatgagaaatcatcagttcttgatattttagtacccttagttcccagctgtggcttgctgactgcgggccaggcatggtgcactttggtacgctctgcatatgttaacctcccaacaatgctagtctgcaggcatggaaactagcctcagactgtaaggagtgtgcccagaatcaccactcaaacacgttaacaggctcagctcagaacacagatctggctgatgcccagggcttccactgaagccacggagaacccatgcccaggaggcttcctctgtcttgttgcttgtccctgatgtcacacccctcgcggcacaccttgtccatacagaccgcaagtattggagtcaggctgacctctgctttttattagttgtgagtgactatagttaaaatcacatttaagaaaacaatagtgattagtcttgacaatagaaaggtaaacaaaacttagaatttgtgctaagagttgtcacaaaatgtattttatttttatattatatatcatcaatacacattttcttgactacctaaaaattgacagattttgtctggtaatgttcagcataccattttctcagctggtgaatgttattaagcattaaaatgtagaaacatgcattcatcccagtgatggtattctatgaatcctgccatgttccagggactgccctaggctcgacaacgggaagttattatgtaatttgtctagatataaaagaaatttagaagatggagttacaaatgctggaactcttctttaccctttttgttagcaagaaaaatctacagacagtaataagtagctacatcgttttgtgaaagtgatactattatgggatttttcaattggaaaagctctcctgtacttttatatcaaaatgccgttaagtgattatgtgaccattcccgcagaaatatatagttactatgaatgcaaaataagtcaggaggctaatttgttcatattcaaatttgtcctttgctttctaattctacaaaggcagtttacctttcagtgtcctcaagatgtaaggattttgttttcagcatgtagttctgctaaactggtgcttaaatttgtaaacctcgccttactctgccagaggttcttcaggagaacagtgataagctctcttgagctccccaacaaggaaggttttctgccagttgtcagttagtaggctcagtacactgcatttgtgagcagtgtttgccatgctgcttagaatcacaggtaaacaccatctggtgatgagggaaggtgcccatcaggcagctgagttcctctcaagtaaccactgggagaccagtgctggctgcagtgtcatacctctcttttgttgactaccaagacacaaaacactgctattgctattactgactggtagtaattattaatacaccaataagaaagtatcttggctgtaatcccagcactttgggaggccgaggcaggcggatcacgacatcaggagatggagaccatcctggctaacacggtgaaaccccgtctctactaaaaattcaaaaatactagccgggcatggtggcgggcgcctgtagtcccagctgctccggaggctgaggcaggagaatggcatgaacctgggaggcagagcttgcagtgagccgagatcacgccattgcactccagcctgggcgacagagcaagactccgcctaaaaaaaaaaaaaaaaaaaaaaaggatcttggagcccaccagaaggtgaacttactgttcctgttatcattcatttaataacggatgtttctctaaatggctttgcaatgtaatcacacacatagggctccccagagagatgtaattcaaccattagagcttttctaaacatcctacgcaaaaaggaaatgcatttgactgtaagtaactcatgcggtgttactgtttctgctgcgtggattggctggtccggtttagatgggacattgcattcatagctccaaggtgcagagtcacgctgggattgtgtggtaaacgcacagttggacctcacatggcagtcagctgtaaccagtagctgatggtgtgttacataataattaaatatttctatttatcttttttttttttttttttttttttttgagacagggtcttgctctgtcccccaggctggagtgcagtggcacaatcttggctcactgcagcctccacctcccaggttcatgtgattctcctccctcagtctcccaagtagctgggattacaggtgcatgccaccatgcccagctaattttttttttttaagtagagatggagttttaccatgttggccaggctggtctcgaactcctgacctcaagtgattcacccacctcagcctcccgaagtgctgggattacaggcatgagccaccacacccggcctctgtttatcatttttgaggcttgattgttaacaggtatactaatttcatcttaaactgtgaatacatctggcttactctgattagaacaggacaaaccctgccatccattgaataaagaggtagtagtttatttctatgagaacatatgcccagttgaccacattctgtttttatcttgaaagccatgggctttcataaactgtttctgccaaggtcttattggcagagcattctgcagtctttacctagtttctgttgtttatctttgcaggagctgctgacgtgctgtgaggaaggaaagggagagattaaagatggcctggaggtgatgctcagcgtgccgaagcgagccaatgacgccatgcacctcagcatgctggaaggtaaaggaccctccataccccagtgtgcatctatgcagtttctaatgacactgtttgtaaatggatttcctgaaccctaaaaatccccgctttatgtctctatgttagtggttaagaacatttcttaaagaatcagtgtcattgcttttcttgaggaccacataaaatgtttctatactcattgaaagccttttctggtcccttcactggaaaacagcctctccacactctggactccaatagcactttgtgtcgcttgctgcaggccacctgttctccctgttagatggatgggtaggtgggtgtatgggtggatcaaaccccaggactgtaaaatccttaaaagaatgtgttgcttccccacctctgtatccattgcatcacttgctagagcctggaacatagtaggcaccagatatttccttgtgtaacatggtaaagagaaaattagataaatatgtttcaaaattagagcaattataatttccataaatgcctctgtttaagaaagctcttcctgttgtgcaaagcttggttcttgccaggctacacagaataagttttaatcctgccccaaatgcttttgctagcctgtgtctttatgggtaacactgaacataggtgccactgtgggtaataagacccaaaactcagaggccaagcaaaacagatttttctttctctgatataaaatgctgatctggtatggccgcccttcatgatgtcatccaggacccaggctgtgttccagctagtttctctccattctagttgtttttctggctggctaggtccagggtgtttcaagaccatgccaacattccatttagcaggaagtggggaagaaggtcagggaggaaactccagatgggcagacactagcagtagtacccgctactttgctcacttgcccagagcgtaggtacctgagctgcttttaactgttcctggggctgggggatggagtgcttattttgagcagccctagtgggagcttctactatgagagtaaaaagagagtggaagtcaggaggtaatgggcagcctctgccctagggctggctttactaagccctggtggcttcataaccaggtgataaagcaggccacttccatgaagagaggagcagtagtgaagtccagagcacgaatgattcacatgcagactgtcacattcagaggagggagggtgcaccaagcatgggcagccagggacttctccaagaagcaagaccaggacaggtccttgaagaaagcctggacctgagcagagtgtctgggaaggatgctctgggctgaggaagcagagagaatcaagacggaggctgggaagtaggtgggggcttagaggagagtcggaactgtttcagaggaggagctttcggtggtgggatgctgcaggagagggctgaagagaagtagagggtggaaccagatctcaactgttgcagaggcccaccagagggatagaactcaaagaataaagccatgaggaatcgcaaaatgtttttgaacaaaggaaaatatatgtaaagtggtgtgttaggaagaattatcctctgtaggatgggtcagtggcgtcgagtcaggatcagatgggaaactcttatctagggttggccgatgggcatttttaaaatgttgaaaatactaataatgctttcttgtgcatcagtttttatttttcttttaaattgatttgcctcccttttttcatgttgtagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttgtaagtataggcgttcagaattgtaagtctaaaggtaacacaattgcagtctttttgtaggtagagaagaattgttcattgtcttcagtttaacctcccaatctgtcctgaaatgttcaagtctgaattgtggtagggttttcatcttcagtgaaattatttcccaccctcaagtccactagagggtgctctggagtttatagacttaggaaacttgctcttcttaaatcctgtatcatataactgcaggataagaaaacatttcataagtgaaatcatttatctccggtgtgcttaactagctttataaataaaataatcatatctatgactaagttcttattataattaatttttcaaccataaacattggagtatatggaaacagccttactgggtggctcacatttaaaaataaatgtatgaaatataagtgcatgagtaaatttatggttgtttataacagtgaaatgtcattattagagaaaatatacttaagccaaagtacagtctgaaagatccacagccccagctatgtggagacagctgcccctgagtgcttggcagatccggtgatgcattttaattcgtaacctgtcattgtacttcttggcaagagcaacatacctgctgccattttgtgaccactggctagccttaccagcctccccaagggcagcatcgtctctggatccagtgtacttccatctaacttagtgggccgtttctcagaggcttattcatgcagggtcgctgggcagggccaggcagaagggacgattgggttgcactaaggaggaatcatcatcaagaaaagaatagaaaatgccaagaaggtgggtttctttacagcagatctcttataaatactggtagatgtttgcaatttggacaacttacacatcatactttttgtgatgtccatatataatgaaattcttcaagtaataaaatgtccccgagtatggaaatcatctgagtaataatctggaattcacaggttccaaatgatggttttcataccattttgtttggcttgtgttctgtttgagatcgtcttttggatcacagcttgcctgacatcattttaggtcgcattctgactggaaagaaaaaaatgcaacattgctggctagtaatttcattagctggctttaatctctctttagagaccaagctcatctgttttagcagccaatacatcttcacttaatttatcttttagaagttaagattccctcagaggctacctctggagctctggatgatgaatcacttcctttgctggggtggagaatgcatcagggggaccttgactgtgggggaggggctgaagctattgacctttctctgcatgcttccatgttctgcatatattacagagggattttgcctcttagccgttaaaattattgatgaaatactaaaagctaatgctattgataaagaaattggagaataagctgttaaaacatcatttgccctctgggaagctgtgtcattaatactgaagagaacatggtggcagcccttttgcaaccaggaaagactcattttgcagtttgttgcttgtaagattgcaaatagtcgaatcttgattgtcagatagtaggattttcacatgttggtttccttcccctgaattttttgctcgttgacctgcactggggtctccagtaagagacgctcacaggaagcgaaggatgaaaccagtcacctgtagcctaagaacacaatgtcctcattataactcacatgacagctgagatcactagtgacgttcttataacctaacatggccacaagtaaccaaaacctgtttccttggtctctgttctgcatccttctagaattttactgtcacctaattatataattgtctttttatccagacctcagagttgggtgtcacagaacatgttgaaggagacccttgcaaatttgcactgtgggtggggagaacaccaacttcagataataaaattgtccttaaggtacgttcatttgaagctgggaatgtgctgtttgaaacatttactgtggccatccatgcttgcttttccgttgttttcatattattattatttgttgttgttgtttgtgtgtgtgtgttctattcagattggtgactaccacaaaaagaatagtggaataaattcagtttggtgttctggtgatgaaacaatttgagttaaactttcacttgactcctgaaagggcaaatgaagcaaggtctttttatatttttcccattcttccagtctttgaattcattgactctataagagatgcaggaagtcagggtacaggaggaatgagatactgaccaaaaactctgattgcgcacttgacctgtttcgaaaggaaaaagtcacctggtgcgtgtttgaggacctgcgacaggaagtcgaggccaaccgtacccacagtccttacagagtcctcagctctgtggcttaatagtttggagacggagggaaagaggaatgattattagtgacagggtttgatactgttatgatttaaaattcaaaaccactagggatgctttagggtatatagtctttgggggaggaaaatatcttggaatatttgatttgaactctgttttgattatactaacctctcctgggaatggtcaagagctctaaggttgtcttatgtattttcctcctctgtgtttgagaaaatacagatggaacttttggagccatctggaaatgccatcagcggctttgggatgtttgggggacggtggagctaaggcttatcgaatattgggagatgagccagagtgtaatgggactctggtgtatgaacctgcatgtcaccccttgtgtctcttgcatgctttttcatctctttggtattttcagtgactgtgagttactcccctgtatgtcagccttctagagcctgttcttcagtggaagccattgtgttcataagatttttgttcatatgtgatagtgggttgttttgcagtgaatatgtgattatcagcccaatgtgctctggctagtactggcataaagccctatatgatatcagttgcaccgatagctaaatttaaataactgtattttcttcctaaggtctaacattttaaggtatactcaaaacctggaaacttgcaacttatataaaccgcttatccagactagctacagtagtagatgccaaaaggtgcttccaaaaaatagtgacagatactttagccagatctggactttcatttaggatgtcgtaaatgctcatggtacagttgacaaataagactcttcttatttgtcaggcttcgccaggtacaagttttctagggaattttgggtaatacctttctgacttccaaggagaaagtaaaggaaacgatgttctcattaatttcagggattgctgcatggtgttggtgtagagaggcaggcgatggtgatggtgggaatggtagtgtaatgatgatgtaggtggaggtggtggagacgctgtggtggtggtgatggccggtgaaagtttagatggcagtgagggtggagatgtggtggtatggattttggtnnnnnnnnnnnnnnnnnnnntggtgagggtgcaggttgtggtgagggtgtaggttgtggtgagggtgtaggttgtggtggtgagggtgtagttgtggtgagggtgcagcttgtgagggtgcaggttgtggtggtgagggtgtaggcagtggtagaagtagaggtatcgtgctgctggtgtgtgtgcttatggtggtagagaacgtgatgggaatggtggtagtggcgatgatgatgtcctcatagttgtaaaacaaaattttggttattttcacttctcctagtctggaaaagagaattttatttttaagtcttaagcagattgcgactacccagattatgaaatgaactatcccctctcttagccaggtaggaccttggtatttagtactttacctcagttacctttctcttactatttctgaaaaactgacatcttttttcctcgtttaatttctttaaggttaggagaattactctctaagtgtaacgatcaattcatatgagaattttctttatttctgaaccatattaacagttttcctcagttgtttccaaactctgccagttgttcttttgcaggtacttctctttagttgaccttccaaatacttttatcaggcatttaaattccaaccaatttgtagtttttagaaaagtttcttctcccgagtcccttactttccccccgctttccccggtcaccctgcctccttcctgccccctcgccagaagacattggttttcctgctgtcctatgtcactccggagaagagggagcaagaggctgcctttacccatcatttcttttccctgtcactacctgttagtaatgttaaagacaggtcctctggttaaaacggtttctgtagaaagaggatgatcaattttaatttcctttcccaacatgggctttgattttctgttttcaaaaacaggatacacagtgagaaatgctgggcgctccccactttgtgacctcatctacgatgagttatgacgggttaattataactgcagggaattatgcttatatcataggagattgatattttctgtgaggaaattagaaagctgttaggaaggcccagaacatgcagaaagaaaaaaaaaacctcctttgaggcagagttaaaaaaaaaaaaaaagtctggatcaagtgatgtcgtgcgtgctcagtctgcaggtgcttgctgacaatctagtctgtgtggttctcagaggacatttcttgagagttgtaatggagtcaaggtgaatctgccatcggggattggcagttggtgagcttggaacattgggcacatttcttctgtccacacctcagttgctcatttataagacggggctgcaggagtctcccacccgcagagtccttatgggagtggatgacagcatgcgagaagccctcggctaggcacagggggctggaggtggtggcagctgcgccgctgttccctgagtccagcaaaggaggccgcaaggctgtggggatttgttcagtttcctgctggcagtatgccccctactgaccagtgcgcagtgtttgcctcaatagcctcagaggcgttttggtggcagtgagggtggctgtgttggtttatttgcccagggctgcttaaaaggtcttggggctggagaatgatggattattgcaatagtcagagatctggagtaatatacgtgctataaaacataaaaggttttgatgaaaacgtatttttaaatagtcatttatttggtagcatattaaacgtcggatgtggttgcttttctgctaaaaagtcattttgaaaatagaaactcaaggaatgcaggaaacctgggtgtagttagggcaaggtctggaaagggccgttccgtatcctaagcaacgctaacaccttgttaaggcttccagcatagagaacaagcaggactggataaagcatatccgcgaagtcatccaggagcggacgatccacctgaagggagccctgaaggagcccattcacatccctaagaccgctcccgccacaagacagaagggaaggaggtgcgtgtctgggcgccactggaggtttgtggatgtgggagggaggggcgaggcggtgttagctcaccctgcttcaaaaatcctttctctcaaacattttgaggaatacattttttaaactgccatttgtggataacatcattcttagtaatgaaactgctttgtcagagataagagcctctattggcttagagtaaacgaagggctgtgtgcaaacctctcattgttttgcctttctcaccccgagcaccatacagggcacatgtctaactcatgcacatgaccttggataagttataaagcatcgagatgttgctgttttctcatttttaaaatggcaacgatcatatcaactatattttatggtgatgggaatccaacaggatgatatgttttaaacactcagcacagtgcctagcagaaagcctgtgctcggtgaagggtgccttaaccattgtccgcatcctggcagcagcaggcactcacgaaggctgatatgcacctcattaaacaaatcagttgcttctccagtgactgccagctcagcagcatcaggaactaaaagtttctttgcaccgccagggatggagaggatctggacagccaaggagacggcagcagccagcctgatacgatttccatcgcctcacggacgtctcagaacacgctggacagcgataaggtgagtcactgccggcactttgtgtgcggaggggaatgtggccagtctctggtcaaagcagccccctcctttctgttactcacagtttgtcatcaacattttcaagcagttgatacgtgccaggagtggtgccaggatcccgtggtggggcagagacttgggggattggggtgagaagacctgaaccctgaggattcaggagaaatcattcaactctttccatcctgccctttgccagtgccaagggtgttactggacattcgagggcagcatacttagactttttaatcttattcctaagcagaagaacctatcatttaaaataaaatcctacacagaacaccagcgtatgttttaatttaggatctttaagatggacagcacccttccagcgactaggagggacacaagatggaaataaagagtgttgcttacaggttctggggatcacacggcatccctggaggacagggagcatgtggggagagaggagtccttgggccaggccctttattgtgtccaggacattatccaaacaggtttggcacagggcgtctcaatgagtgggcttagagcaagcagacacgagtttcagaaggtcatgctgtgactaggaagttgtcactctggcatatctgcacagtccacatgaggtgcgagtgtcagcagggccagttaagcaggtcttatatggctatcccttagagaaatggtcaccagaaggaagttctgtgaagcagagatcaggacctaccacactgaaggcctgggagaagatgctcctgttatgagaaagtccagcttctctgggttcatagtgatgccaaggcaatgtaaaatagtaagaactcatggcagtgtagaagcggagctgctctgatggaaatgggggctgtggccctgagatgccctctcataaccatagtgtgcagcagaacatagaaaacctgccctggaattggcaacagtgatgaccactgtgagctagatctgatttttatcaaaaaagtttgtataggtgtatcttcttcagaagcagcctagagtatctcatgattttgtctgatacaatccaaaaatcccacaaagtaaattgctagtagaatttggaatcctgggtttacgtgatggacaaaagacaaaatgttctctgtcagccagtggggaacattgatcttaatgaagtcttctgttcctgccaagactagtgtgttctgttacattactagaatgctagactgaattctttttaaaaaaattgacagtaaatagggggtttatttatgagcccagaattgctgagcttctcattctccaatgcaagtcagacctcatttcatgagacctttgtccccatcatgagacccgggagtctgttctctgcacatcatttccgcagcccactcattggtaggaaggaacaatgccctgacctcaccgtccttgggaattgattcagacagatgacagagtccagtatttggaaggttatttccgtggcacatcttttagtcccagactggccttttctcacttggttttgtaggaggattcatgatacttaatgttctagtttcaaggacgggagtcagtagatttaaaatactgctctgctgcagtgattccattttcaatatcctagtttaagtgattagattttttttctcattatactttttgggttcactaaataatagatcctaggacttggagtggttagaatgacaagaccagagaataaaaagaatttctcattttattttgttcaaggccctatgtattggcattcagcaaatatttcttggcatgtagtaaaaagaaataagataaatgacatgttcaggcatctgatgcctgatagcatttctctccgagaccccacctatggccattgaggttaaagaaataaagtttgagcttggaaacactttgttagagtaatattgataaattttttattttattttactttttaataaagtaatcaaggggattatctggtgaatttccatgaggctgccacctgaaaggaaagttgaatcatgggtgctcaagtgtgtgggaaagtggcccgcattcagggcatttccagaccatttgagatcaccgtcaagccccaaattgccattcttaagataaactcctaggggtctgctctggatttcccctagacatgagttcaaaagtttattctttttttaaaaaaaaaaaagtaaattttttgaatgaaattgctaaagagctaagtggaaaagttagctttggagggttccttttttggaagttggtctaagaggcaaggataacttgtttcctcgggtagtttatggataaatgggtgcctgggagtctggaaatgacccctctatccaggaaggggctctggagtctccagttcattattccggacagagttgctggtgccacgacttatctcctgcgtgtggagaattccttggctggtacccacctcctctcagccccagcacagccctggcccctaaggcgcgtggctgattgggattccccagcggcttgaacagaaataagtctctatcctggagttaggagtagtgaaattagcacgacttcacatctgttatagcatattagggagggcttacgtgaactgggaatacagcaaattatatttgtatccaacgaaagaggaagaataaatcactaccagaacagtataggtttgccaaaaaaaaaaaaaaagcaaattttaccctagcagtccactagggtatgaaaatgttaagaaaactccctatgagatactctatctgtgaagatgattcaccagtttctcttgacctcatctgatgtgttgtccctaaacttcactcctgagctcagaaatccctgaagggtcggctgagcacgcggtggctcacgcctgtaatcccagcacttagggaggccaaggcgggcagatcacgaggtcaggagatcgagaccatcctggctaacatggtgaaaccccgtctctactaaaaatgtaaaaaattagtcgagcgtggtggtgggtgcctgtaagtcccagctactcgggaggctgaggcaggagaatggcatgaacccgggaggcagagcttgcagtgagccaagatcaggccactgcactcccacctgggcgacagagcgagactccatctcaaaaaaaaaaaaaaaaaaagaaatccctgaagggtctctcctgccagttccaccattgcctctccagccccgctcctgggaggctctttcttactgaggaccgcagcctgccacgcagcaacactcaccctggtattctcatggttaaccatcttgaaggaatgacactccagactcagtttcttaaacagacctggcgaattttcttaatgccacttgctgagagcatcggtccttagtaggctctaaagcacagaaaggatgaaatgtcgtgtcgtgagaacagaaccacagcgggtgtcttactccgttctggagacctgcatttgggattaaacggcgtatgagacttgccaataagtcagaatttggaatttggagaggacgtacccatgcggccttacaaacaagaaggtgcacgtttgctgcccacgtgtgcctgcgtttgtgtgtgctctgcttatgtgacgttttctcttagccatctccctccttatgcctctccagtagaacagttgagggtcattagatgactcaagaacacattttgaaaatcaaggactccatcctttccctagtcagtctgcaaaatgcactgtccctctgaactaggcttaaccagcaaccccatctccggtgacggtaattttcctgagtctcgaagttctttctgccctacgtagtttaagtttaagcagcctctgataacgcaggcagatggatctggcaagggaaatcacttaacgacattctgcctgttcgacttaatttatgatgtctgttattagttagttgttatcatggaatttggtttcatttcagaaactgggtcgggggatgtttttgactcggcctcttggagaattctgaaggcaaaagttatctgctagggctgttagtaattctcagatgaggcacacaaggtttagggagagtctgaaggagggaccctggagacgccctctttccagggagcactgtcagcagagcggggttagccaggccacggccatgagccacaggccccagcagcacgtttcctactttgaaaacatcagttttaaaatatgccttctttttgttccagaagtgaatttagtactgattcttgctgatctccatggtacttaacctgatacaatgatcttatgaaaatataatttggattccaaagaaatcaagcgctttccagattcttatctcatctgtcctgagtgcatctccctgcggtagggaggagagcgctgagccgggcctggggcactgcaggagatccaggccctctgcaaggcctcccagcagcagagggccacagccagacacggaacatgcatttaatcatctgtcattttccaggccttattatttcatgcaagagctgaatttggagctcagtatttttactaaagacacatctttaaaaattttttccctgtctcttccttattagtctgtgatttataatcattaaactaaaatccatattacaaagaaaatagaaaacatggaactcaaactgtattgtagaacaaagcatcttgaggccaacatggaaaaatggccgaggcgagatgaggtatcctgtggaaaagccggcccgagccagcagggcccaggtgtgagctgtctttcgaatcttaagccgtatgtttcttatttctaatgagtgagaaattcagttgagactgataacttcatgtggaacccccttcccaagcttataacatgaatatatggattcacatatttaaaaacataactggtttcagtcactctttttttaaaattcctgaggcaggatctcactttgtcgcccaggctggagtgcagtggtgtgatcagagctcactgtagtcttgaactcctaggctcaagtgatccttgcctggccccccaggtagctaggaccataagtgtacactactatgcctggctagttttttttttatttttgtagagacagtatcgaactgtgtttcccaggctggcctcaaactcctgacctcaagcaatcctcccacctcagcctctcaaaacgctgggattattgtcctgagccccactgcatccagccagtttcagttattcttaatgaagccttagcaccgtgttggagacatgaggttctatgtgttgttttttttctttctttctttcttttttttttttttgagatggagtcttgctctgtctcccaggctggagtacagtggcatgacctttgctcactgcaacctccgcctcccaggttcaagtgattctcctgcctcagcccctcttgtagctgagattataggcaagtaccaccacacccagctaatttctgtatttttagtagagatggggttttgccatgttggccaggctggtctcgaactcctgaccccaggtgatccacctgcctcggcctcccaaagtgctaggattacaggcgtgagccaccatgcccggccacggttccgtgtattttaaaatttagaaaagcaatcagctctttctgtcaagtgacgttctacactccaggaacttggtttgacttacataaattgcagcgtcgaggtagtatgtaaagtagttaatgccaatacattttgaaatatggcctaattcaccatcttgggtaagggtgtatatctatctaatgatgcttgcattcagcctcccgaggttgtcctgcagtcctgcgttctgcctctattcaccacatggaaggcgtagggctgctcggccaggcacagaggtgtcctacacccttccctctggctggagctgctcagagaggatgctctctgcctcctggccagctcagggctctgagtttcccaggacctcagataagtttgccccatgtaagcatgaaattgagtcatttaattcagaagccttttccacaggatggtgcttattttaacgtcctttataaagagcactcccaaccgcagttgaccttcctctgctcagagtgtacctggcagtggcatagcatatacaacacacctaagagcaggcaatcaaaagcgaggatgtacccaccagcaaacctctggcctctgcctcagcagctggtggtcttgggcaagtcacctcacctctctgaacctcagtttcctcatctgtaaatgggaatgatagtactgctcacatatatttagatcagtgactagcatgttctaagcactgaataaatattcagtttctgtgtctccgttatacagatggcttcctcctgcctcactcgggctattggccggcattgctgctgttgcaggttactgtcaatttcagcctccccttccttcatctgcacactcttggggctacagtggatttagctgttgattgtattgtacttgttaggatctggaagctgtcctaagaatgaaatgttttacttcagtgcctggcctgatgaattgtggtggctcaactgcaaaattctgtgtgtggaatgggcacaattactgcagaagggggagagtcttgcgtaaagcacctttccagctgttccatctttcatcctagctgcatgcgtatccagtgacctaatattcaaagggtgggttcatttattctcagatatgtattggccacccactgtgtgccatccctatgataggcattcagtgcacaagaatgaatgaaggagacagagccccgctcccctggcgagctctgagtgatgggttccgtgtgacgtctgcttccttcttttactcatctttgttttctgtttttctaagtgatgtggctttttgtatatttttttagatgagttttttaagttctctcataaaaccacaaactgaatgtcatctttgatcatttcagttaccaaatcagaaaaacaaaatcccccaggcagaagtagaaagcctcagttctaagaaaagacagattttttttaagtttggttagaaatgttacaaattaagtgtttgtaaaatagtagagcactgaaaagtgctatttagtgtaaattttacacaacatgatcgaagttacagttggagatggtgataaagttatgtttcagactcgaagcaggtatttattctgattgctcttcctggtgagggcccagtcagctagttaacataagctggttgaggtcagctagttaacgttagatctcagatcattgtccctccatgaaagacaaaaagaggtatttcaaattaagcttcctcaataaaagattgctttggtcactcaggaaatacagccaacaggtttctttgggttaaatggtcctaagaagtttcttgctttccagagcctaggggagtgcactacgtgaggcaggtgtttttcaactgtttgcctcttccccgccctcgttcccttttccacttcatagccagaaagcgtttacctgccacgccacagggccgcctgtggggcctgcacggcacctccggcatttctcactgggatatgctaaaagcaagagtacaatgttggtccaggtgagcctctgtgaacccttgaagcctaatgcgagggagctgccacgtctctggtttgcctaccctttttagttgtatcttttaaatgcagccgtttttcatccagtatttcattccaattcatgtgtatgacaacacactcaagtcttccgagatcaatcttcacatcagaaaagcagtgtgtgagcatgtgagtagacagtagagggactggcatcctcaaacactgtcctcactccttcttttccagatacagtgttgagtatggtaagctgctggttttgaaaacgttttttctcaccgatttttttttctttaattgtggttaaaaaaaaaatgtaacgtaaagtttaccgtcttcaccatttttatgtcctcacaggtttctttctgtacccctagtgtatcggagcctatcacaatagtcctcctcttttaaactctaagtggcagattttagtgaacgcttcttcttggaatttgaccttatgtaaagcagcttgggtgttggcgtgagcacggagggcctgttgttcacgttagaacagctgctgatcagcccgagtctccgtgaagttgccctgtggagaagcttgggtgggtgagagcctggggcataatagcattgattagggaaattgttgtggctgcctatagttacccttttttgtaaccattgctagcaatagcactgtactctctaattccctttaaccaagtaatcattttttggcctactctgtgtgaaaccttcacggaaccgcaagacccttttgtgaggtttctgaatgactgaactgtagtgggctgtaggctgtgacggttcacgggagttaatacactttgttctttaggggaaaatggcttttattaggccacattctccttttgcttttgaattgctctcagaaaattggtcagaacccacctgcaattgatctttaccacattagactcttgttcttgaagtagaattgtttgcagcgaagactgactgcatcacccaccacaccagtccgagagagccccctcttcctcaggcagagcttgccccagaactcatcgcagagcttggtaattcaaaccaggtattgccgccgtctatcgagagccatatgttcttgagccatacatgcctcattgttgtgtccagggcgggggtgttctgaggaacaaaggaagacgtgacaactcgcagtgtgagaagtccccagccacagctcttgttagttacagccattaactgcgttcgtgcaagacagtgatatgacatggtttctttggagaacatgaaaagtagaattctgttctatgtggtaattgttgaaggttcacatgcttgcaaccagagatgagtatttcattctctcgggtgaaacacagtaagttgtttattttcagtcattctggaaagaattcaggaaaggaaccgatttgattttgccaattgtccatatgtctgggcctaaagagggacttgggtgtagtctttggaggaggcacattggtggtgggtccctggcccctggtccaattaaggctgttttgttgtcttgcttgttagtcaccacattcatttttttaatagtgaaaagttgaaaggtttaaaaaaatctgtcttctgatatgaatctcgcaagtgttaatgtgagtcatggaaagtgagattttcacaaattgcaatcctaaattcaatgcatgaggtgggagcccatgatagaaacccattaaatatatagaagcaacgaagatactgtgagaacttgcacaaaatatggttagaaagaaaagggaatttttaaactagataaataaaatggtaactctttcaactgagggtagaaattctctgaaagccaagacctccgtcagacgtaacatacgagatagtggctgaatgttttctagttcggaatttaatttttcttaaaaagcagtaacgatttgcactgcttcctcaaaatagttatcacaagtcttttgtacacagaaaagtttttttttttttaattagcaaacctggtttcaaagatgttttgcagcaagaagttaaaaatattcaaatgtgagcattgaggtgcatccccaggacagctcttctctgggctagaaaacacccatttaatcctcccctatggggcctctctttttgggtaaagccagttgatttgctgggagatgggaagatttttaaaataattgtagtgccctttgaaatattctgttgttggattttcttaacaagttcttaaaagcctttaaaaaggaattttaactttgtatatgattctttggcagaacatccttgatttttatttcttatgtgctgtcaagtacacagatgtttccaatagtttttgattactctttaagggcctaaaaaatcagtgccagaaataaagtctagcttaatcctccttcttcggcagcccctctctccccttcccacccttcccccacccgcagcccatggctttgagccgtctggaaaattaataagactctggagaatgaggcagccagagggcaggtgatgagacagtgcacttcccagcgtctgggagtgggggctgctagaagaatgtcagggaagcccagtgggtttctgctgggagcttctcacgtgcgctcagtgaagcagcgggtggcatcactggggagctctagccagacccagaggcctgggaagggcaggtccaaggggccatggcaatctgtaccctccttcggggcctgcagaccggtcctgtgttcccggaacaggaagcaccccagctctaagtcacgggactaaccactccatgagtgtggttctacaaggagagttcttttccaggctgggcctctgcctttgagcttttaacattagcatctttgactgttcagagacctgaaaaatttaacatgggttttccacggagaagtttgtaagattgagaaggggatttatgaaaattttccttgtggcctagcaaagctgattcactttgttgatactgtgcttcatggtagaagagtttggttttgttttggtctttgtggttgtctagtggacatgtgtttcttattctgaatatctgaactttctcttaaaagataggctcctacaacaggaggataatcaacagcacacagcatggcagaggctcccagaggtcctcagcacaagggggcagccccagaacacagcgggagtgtgagccatcggaggatgtgcgggctcctgggtctctgggtgtgggcttgtgctcagtggactcccaacaggaatgtttcccagcaggaggctgggccatttcctcctcccttctctcactcccacagccagccccatagcccgcagcacactcttgtgtccctgtagtttgtctgggctactgccctttagcaagaggtgacaggggagagctgagcgtctgcaggctaagcacaggcagagtgagctcctgaagccagtgaggaaaatccaggcttcgttttgggttttcaaatgcattgccttcatttttagagcatatgtgtcttttctttttcatttcacaaatatttgaatgctagctggatgcggagcacagtgcgaggcaggctgaggaggagacccactcctaacagcttctgtaagtcacatgcctaccaccactggcactgggggactcagggtgactgtgcccagccccatctccgccctcccagtccagggatggaaagttcacagaagagtagggtgagcctgcttctggtgatgaaggcagacacacacacgtgtaactccagctgtggctcacttcagaattgaagtgccatggaggacaggcacgagagggacttctcggagccagtggggagcttagaatagaggggacgtgggggctttcagcaagagggatggtatgggctacttacaggcaggacccctcaggaggaggagggaggtgcttctggccactgggggggacctttgcctcctatgctaaggcctttgtgtgtgagggttttgcataagaggatgacgtgtttttagaaggtctcctgccagcagtgtttagatggcttggaaggagaacctggagtctgtgagggaggaagctcaggagcccctgcgggacccagtgaagtgattggtatgggagtgcagagaaaggaagtgatcggagagccgcgcaacatctgctcgacagcatttggagggaaaagagtggggttttttagcttgagtgacttgatggtgatactgttacccaaaagacaacaccggaagaaaaagagatttagggggtgggagggcatgatgagtcatgtcccagactctgcattgcggggacagggaagcatccagttgcccagcagggatcgaaagtagtctgcagttgggatgcttgctttgctcgggaggagtcagcttgagggtgtggttgaagagtccctgcagggggacagtggagaagcagcagagacagaacctgggacagtccagagaccaggagctgctctcgggattcttatgtagaaaaaacaatgaaaagattcttaggtaggagggatgttaatgagcgcatgagccctgtccccacggagtttactgtctaagggaacacacaccagggctcaggccatctgaagcagacagtcatgagaagaccatgcacttgttttaccggcagaggccatggggtgtgtgttgttagagagtttatggatgagctttgaaggaccggaagagtttcagtaggcctaggtgagagtgagcatggtaaaaggagagaaggagggaaaggaacgtcaggctggaggaacagaaggccagaaaatccaggacctctgggaaacgagccgatgtctgcagagcctgtggtgcctgctgcgtgttgaggcctgaagtgggggagcctagaaggaatctgagggcagagggcagagggcctcaggagccacaccaaggggagccctggacaagcaggaggaggcgcttgaaggattctgaagagaggcaggtgtgctttgcttcggtttcagggtcatagcccattgcctgttcagtcccgttcttgtggctgcctctttcctgacccaagggatgcttaaagagcccacatattccaaagcatggaacgcccaacactgggtcagaacagaaatttggaacagaactttatctcattttatcaccatatttcatgataatcccccagatagccttcaagcagagttttttttagtctgctgtaagttaaaaaatgagtgtatatataataccactttgtgaggaaggaaatagaatgtctcaggttcaagaaatttggaagctcttatgaaaaatcatattttcatacggagagtgcagtgatcacacaacctcggagcactcagctcactccggggcagggtggcaggaacccacctggaggacttcccagctgtacctgaaggcaccatggctcacactggctgacctgtcctctcttcctctgttccccccagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaaggtaggaatcagtggggcatgggtggcagacccctactggaagtggccctggagcgctctgtctccgcgcctctcctgcctgttaatgtgcatgagcttccttgtcagctgtgccttcagcacatggtcactgactgtccgggcatttccagtccatcagcacctgaagaggaaatgaggatttcacccacgactcagaaataatgagtgatctcctcacttccagggcggtgtagtgagatatgacatcagtttagagaagaacactgattttggaacattccagttgcttccttcctttatcatctgtgccttcttctgtgtgtcatgatacctcctggaggccatcccctggctccagagggttagtcattccagggagctaatgaagctgcaagagaaaacagctactgagtagttctcctgattaattataggccaagccatgttccggatttctcaggacctaaatgtgagtttactgtcacttcggtaagaaacaggaagaattaggctgttgtttctccagaaatctgaagagaaaggcagaggattttcagactttggccaaaagccaaaggtgtccacttccatttctggtgaagctgcccatgcatttggaacagcggtgggcttcccctcgtggtgtctttgcatttagagatctgagccatgctggcttttagcctgttgccagaatgctttgcattcagtatattcagttgcatcaatataagtccttgaatttgagttgaaaataaagtacaacttttcctgaaattagtctgttctgcagaggggccctggtgaacttaagcatgcctcaaataacacttgttctgaaggatttcttccgcatgtgcctttcctgtggtgtgttcttacttcctggtgtttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgcttggacccaggaggcagaggttgtagggagcagagatcgcaccattgcactccagcctgggcaacagagcaagactccatctgaaaaaaaaaaaaaaaaagattgtttgttcccttgcagtgttaggagctgcgcagcaacagacagcaggtgtgggtcagaagtaacatggaaacggagggcgtcttcaaccacaaggataggaagcggtagggcgtgggtgaggtcctgaccatgtccacgtccaggaaaccaggcagcttgaccagaatctctgtctaggagacagaggccatcatcaaaaagtcgggcaacaagggatgaggatttagacgtggagtccaacaaaagacataggaactgcaggagcaggaggcctctgtcccctgggaagcagagacccaggcttgcctctgctcagccccacagtcctcccccttctcctgccctgtgtgtgaagaggggtgctgcccccacgactggaaagacattggcatgtgccggcctgcccatgccagccatccacatgcctctgcccgtccactctctccttttgagcctcttttcagtataagagctgttcaggcttgaaggatatgcagcgagcgagttaaacatggcccctctttgcacaccatggcatgcatcattctggcagctgggtaagaccccctccagtatcagatgttcaggctgccttgcctcaccctcgcttcagaactcagggacggtatggaactggctttacagatttgcctcttgttgcttgctattaaagttagtttcttatatgtctctgactcttactgctctgaccttctaggcaggaggaaggagcaccttcattcagttctagtgtctctacattttcacaacctcagtgcctcagtaattttttcataacaccctgatccaactttcacatttttatgtcaaatgtaaaaaacatgcctattaaggtcaaatgactatttatttgcttgcgaataataagctgttttaaggattgcaatgagtctaattactcagatcagccaagaagggtccaggatcatgatgagccgtgctcaggttcacgtggtggttttgaagctgggctagacttggaagtctgtcggacactgagaatccatggaatttatgaagaccagatttcttttatcggctatatatccttaaaatgatttgggagaggataaaaatacagcttattttaaatgaacaagaaattcaattacacaatttgtttttcaaggagataattttgtgtctgaaacaagactctgctgtgaacatcattccattgagaaatgctatcttgtggccaggtgcggtggcacacacctgtcatcacagctgctcaagaggctgaggtgggaggatcgcttgaggccagcattttaaaaccagcctgggtatcatagcaagacccagtctctttaaaaaatgccatctgttttgtggacgaagtttgctttggaagcttgcatgtcccggtgtcctttgggccggccagccttcgtgtctgatggcgccttctgctcttgctctggctgtccttcctccgtctcagcatcttggtcatgaattaaacagacgccgggcatagcaggattgaataagggttcagcaaacccttgtgctccagcagtcttatttgtgtttgtcgtttatgctgtctgccgttacctcagaggctctggggctggggcctaggcctggaggctgtgtctgtgcccccagcgagtctcttctgcattctgggctgaggcccactcacctcccttcactctcttccactcgagtgtgtagtacgtgggctcactgttgaaatcggtgtcacgtcaccattgttgatggctcagtaaatccaagttctctttccttcccattgtctcaacttgtaaaacttgtcacttttatgtatttattgacagtcttggtcacaggaagtaaacagaaatgtcaagaatgtgtatatttccagtgaggccagttcaaaacatcctctttgccctacgctgccctgcttttttcaccttttccctttcttcccaaccaagagtcgccctacacaatggtccctggggatttagctccagtgtgatcggaaggaaaagtagccaggaaaaagcaaaatagtgttgtcacaaacctgggcaaatgagcgtctctcactctctgccggatgcatttctggagtgcctggcatgaatctttttgactgatagtgttttgagggtgggacaggagttcataccctgtcctggggagggccttccgtcaccctccccactcaggacatctggaaaaccaccccagggcctgtgtcccgcactactgctgcccagagcctttgccattcgaagttgaatctggaaggcccctctcagaccccatggaatttttttttttttttttttttttgctgaaataaggctttaaccaggagtttgagactacagtgagctatgatcaaaccactgcactccagcctggacaacagagtgagacctcatctctaaaaaataaataaataaataaaatgaaatgggctttaagaagagaccttttggtggcaagggaggagtgagtggtgagcttggaggatgcgttcttcctgtcaggaggcctgagatggggcgggcgcaggaggcctcccagggtcttgccagctctgacattctgagttcagagttcttagaaggctttatgagcaaaggccgattcaaaactgccgtttccttacaccaacccatcatgtgatgacaggtggcctttttgcttgtgctttcaaatatgtctagaagaaaacacccacttataaaaattaacctttaccactctaaaaggcattcacaattttaaagttttttctcctttggatagagaaaaagtatggttcagtacctgcattttatttcgaagaagttcagagtatgagtcatctgcagtgaatgagaaaattaaagggaaaaaaaacatgagaaataaaaccttttgcttgtgggtgacttgagcctctaaacccaggggctttaactcaggatgctacgttttactatggtaaaatctgtgccaaaaacagtcccccatagtttaccacaactccagtgggcactaccaagatcagctctcaggcttgaccagactggctgcagtagttaagagaagacgcagggactgtctttcgtaagtgtagtgatacatgattgctattaatcaaatggggcatttttttctaactcaagttaaaaatgagaaagagacatattttcattcggaactgtccgaaatgttgacttttctgtgggtccaccctgcttttctccaagctctccttgcttctctccaagctctctcccaagggttttcttgtccacccgaatagtttacttttccacttgactgtcttagcaactttttcaaatctgaagtattcagattccctctcccaccatctccccacttgttcacccaagaacatggctaacgcacgtgagggtctctccactgcccaccacagtttttaaaaactggtaaactccacataacaaaatgtatcatcttaaccattcttaagtctacagatcagtggcattaagtaccttcacattgttatgcagccgtcattaccattcacatctagaattcttttttccgtcttacagaactgaacctctgtgcccatggaacaaaaccctccgctctctcctcccagcccctggcactgcccctttcctttctgtctccatgagtttgactgttgtaggtgcctcatgtgagtagaaagtcatgtagtcttgtccttttgggactgtttatttcttgtagaagattccgtgttctgacttttgtcagaatttcctttctttttaaggctgaatagcatccccttgtatgcagatgccacattgagttcaacattcatctgctgatgggcacttgggttgcttctgccttttgactcttgtgaataatgctgctatgaacatggatgtacaagtaatctcttcaagtccctcctttcagtccttctgggtgtatacccagaaatgcaattgatggatcatatggtactgttgtctgaatgtttgcgtccttccaaaatccgtatgttgaaatctaaccgccaatgtgatggtattaagaggtggactgttgggtggtaattagatcatgagggcagagcccttgagaatgggattactacccttacaaaagaggcccagggagcccttttgtccttccgccatgtgagggcacagaaggcaccgtctttgaggagcaggccctctttaaatactaactctgccagcgcctggatctcagacttcccagcctcgaaaactgtcagcaataaatttctgtgctttataagttatccagtttaaggtattttattatagcagcaggaatggactaagacatatggtagttctacttttaattttttgaggctgcccactcagttttgttaactttatctcaataatatatttcaagtatgttctcttttcatttctaccgttactcttatcacctgatcacctgacctcacttcttgccctttttcgtttcacctaaaacataaatgttaccatactctcttgcttaaatttctttggcgactttctcttggtcagagaataaaattcagcttcctcacatgtccaacaagacctttcgtctcatagacgcacatgtacacacacatgtgcacacacacgcacacctatacaccttctcttggagctgtacatcaggtaacataggggcttttttccctctcactcacccctacctaatagtccccgtctcatttcatcaaatacaaatacaaatcctcatgggaaaaataaatgtattcagtgagctcatggaagggaggagagagcagaataaatcttggtctagttagcaagtatttccacacagaggctcccatcaggtcagctgaaaagtccagttagatgaactccaaggaacgctgaagacccacaaggaactgtccaggaactcactgaaagcaccttaaacagattgtaacaggaatgatgattgcagatacactgttgaacttaaaaatgggatagaggaactgcagacaacacaggtgttttaaaccgtaggctcggtagagaaagcagcgagtctccgcagatggccggcactgagagccagcaagaagcggaggagatgggccttcagcagggggttgcggggggagctttaaactgagccctgtaaacatggcagaactgctcagtgggagactctcagcacagacggtcatggggaagtgagtgcagttcatttgtaatcttgttgtcgagttctgggttttttttgtttgtttcgtaactttaaaggtatgcactttatatagatttatttatttgctgggaccgttactcagagttcctagaaatgtacacagcttttttaccagggttactcctcagaatcacttgtcacttctttaaatgaatgaatgaatgtgccaggccctatgcctggaggttgggagcttcatctacatcacattctaacaggtgaccactggggtaagcactgtgtgactgcaaagccagggtgtgtttccatcaacacccagatgaccgtgcctatgtgcccctgttgtcctccctccaggactgcctcctcaccccacccctttctgcagctcctcatctaaacatctcgcctggtgaggtcacggcttagcctgttggccagtggccccaccaccatccttccccctgtgcagattggaggaggccaggtctctccccttagctcctatgtccccttcaccccccatggcacagatgagacattcacagagtttgcagatgatggaagagaagactccaggttgccaggtgtgtccactctcaggaacccccagcccaagcctcactgctcgtgttcccagccaaccccagcacgggggatacgccggtgctgtttccctgctcagaatacaaccagttaccagaaacgacctcacccctccaaccactttccaaggtgccaggacagagaagcccttcactggcccacccagggcagttgacagagggatgccctccttggaggggagcctcacctctacccacagggccgcggccttgtcctggattctcaccggggcagtcacgtcaggatggagaggtcccatgtcagccagttctttggtgggggtcatgtagtctgaaatgacctgccgatggtccaggctgagccagggaagccgagcctgggtgcctttttggtgcctactctgacttgagttggattcatgccacagacccaccttcttgagcaacaacacatatagccaccaacacaagagccagccacacactgagcagagaaagtccctgtcgcctcaccacccaaaaactccagctttgcagagaccaaggttcttctctacctttgcagaagcctctgtgaccaaacccggagcttgcccttctgaggcctctagcatttctccaggtgtttttcagaggacttggtttaaatttgttcaccccaaatgtggtctttcccggatcatgaaaggatctgccgcaaaggtgaatctgagtctcctcagagtcatatgagactgaaactgcttataacatttccgtgacctaataagtcttccaaaaatgtagggtattaagagtttagtgacattaaaaagtttagtcgaaaatatcgtgattcaggtatatttagacatttgattcatgccaaattgccactgttatcagaaaacacaccccaagcacattaatgcctagatatttcaaacccttttctgcccacacattcttaaaaataatatactgagaaatctatatacaggtttttttttaattagcttggaaaagagcagttgtattctgtttgaacagctgctaatgtcaattcctgtgggaagaaagaccaaagaacatggagttacaccaagaattttaaaacaaagacgctgtccctttcctgagcaccgtgcagccaagactgagagatcagtctgagacctgtgattaaggagtgttttctacatagcgtataattatggagccacacaagtgggccattactctgttgagtgcttcatgtttgaggtattttcgtgttccaactttacattaaagtgtttattaaaacaggaaaaatccacgagcaggtattgacactatccatattagatcatcacaaaattatatatatagcagagtcataaacaatgagaaacggtcttcccacacttgctttaaatggccatgacctagtgtttagggaaagcagtaaaatcagcgaggagctcgtgggaaaaatgagacgggccctgagggggtgactcatgggccaagcagggccacacaggtaccaggccgccacgtcctctcctgcctctcactctctggagactggacttcctttactgcctcctttctgacatttcctagacatcagactttgctacttagtacacaaacggggttcccttttaaatttgttcactctagttagcatttgcagaagctgtgaaaaattacagagagatgatgtgttgggtaagagatggtttaaaagtccagcttgctgtttttcattaagtgtcttgaaaatgagtaagtggcgttcctggaggggaacaatcatataattccgcagggtgggtctaaacttgttttctgatagtgtttagcagctcatggctctgagggcacctgataacacagcagccaggcgctgatgagaagtgtgtgccagacagacccgagtgtggcttggctcttgccttatgttcctttctctgttcagagaagcgtgagatgagattttgtgattatattgtactccttgggctgactttcccatgcacagaatgttttacacatcctgatagctgagctgaaaatgcaaagagaagggaaaatgccttaaattgttctggctaatttagaagcagcaggccttggaagtctttgtcctgtgtccctgaacaaatcttatgggagctctggtacctatgccagaaaatgcacataggcacaacacttttacatacacgttcacacaccccacccatatggagaacttttttctaaataagagaaagaaaaattttaagacttacaagttatgtttaggtattttacatggttcagaaaacaagacatgaagcggtataaactgagaagtcttgttcccacaaccccacgtgccaggtacacataaccatttttattcacctctagcttgtgcttccaatgtttgttaggcatatgtaaataagtgaatagataagcatttctccctccttttgctgacatgagtggtggcatgttttgctcctggcttttatcccttgaccccattccagtacctagagacctgcttcatttttttagatgtgtaatacttcatgtgtgcgtgtgccttagtgattaactcgtgcactgtgcagggacatcgggctgggatcagtttgttcactgatatatacagcgctgcgggagataccctcacatgtgtatcatttggtccatgtgcaggtgtgtctggaagatagaattctaggcgtagaattgataggttaaatgtatttatagggaaaaaatcaatataaaactttgcgtgtaatgatatttgcgtgcttttttttttaatttttttacccaaatagcaaaaaaaaaaaaaaaaaaattgtcctttttgaatgggcctctttaaatccattcatataaattatatcttgagtctctgtgtgacctgtctgggaggtgaggtttggatggatgttttcccacagaattacaagagcatgcaatgaaatatttatgtaaatcatctttcatcaacatttttgcgcttttattttagggattctccacataacaaataaatggcagtgatttccaaagagcaagtaacttcccttccctcagtatgtatataaaatagctttcatggtgccccatacgccttccatccttgcaaagttcttcgtgaatccaagctatgcagttgcaagagatacattcacaaggctgggctgttgatggctctcctagtgggccttggagtctctgtataatctccgctctttctgaaggattcagtttcttaccacaaacatttcacagtgaatttcgttttattttattttattttattttattttattttatttatttatttactgagacagagtcttgctctgtcacccaggctggagtgcagtggcatgatcccggctcaccgcaatctccgcctcccgagttcaagggattctcctgcctcagcctcccgagtagctgggacctcaggcacccgccaccctgactaatttttatattttaaatggaggcggagtttcactatgttggccaggcgggtcttgaactcctgacctcaggtgatccgccttcctcgacttcccaaagtgctgggattacaggcatgagccactgcgcctggcctgaattttgaataagacagtttttaaagctctcccaaatctaacttccttccttcctgacactgtggaagagttttgaaggggacagaaaaaggcatgggggtaggaggctaccctttgagctcttgcccctgtggccacctctcccaggagaacatcctcacgcccctttctggggttctgtgtggctcatgctgggctggctgcctggggcttctgagacgtgttcagggtctgccctgcttcatcgtggtctgaccagcagtggctggaacacctcagacttcaggcaattggtcattccacatcacagactattcagggggcatcatcttcccgaaacctttctagccaaacgtaggacagggcccccaaagtgtttattatttgaaggtcctttcaaacattcgagaggacagtaaacaggctcgtttgccttggctgcattgcacggcggctctggaattctttattatttttgtcaagaaatgaagccctgtgtgttcaatctcatctattctctccccaaccccttttcaggagtctgtagaatttgaatgctagaggggaagaatattaaagttctgttcttagatatagatgtgtttcctactgtctcaaaaacatttagatcatttcagtcctgtatcatggagaagattattaacagaagggggagaagggtgtattcatctgctggctgccatagcaaaatcccagagcctgggggattaaacaacagacatttattctctcacagttctgcaagccagaagaagtctagaaggagtcagcagggtcggcttcctctggggcctctgtccttggcttgcagatggccaccctcttgctgattctccgtatagctgtctatctccctatttccttttctgtaagaacaccagtcaggttggatcagcacccaccctaagagcctcattttaatttaatcacctccttaaaagaccttgtttccaaatacagtcacattctgagatactggggatttgaacttcaacatggattttagggggacacacttcagcccatagcaagggggccattggagccttaagaaattaacagtagtaacagagagcacggggtgcggacttgccattgccagccacagtgctgttctctatgttccaccctcaagataccctcatgacaacgtagacatacaccattatcatccccattttagggtaggaaaagggaagcacagaaaaatcacgtaaccaaacatagcaggggacgtaaagtgagatttcaaagcagcagtcagacttaagatagccactgtacatactgctgtctgtgcacgttggaagaaacctttggtgcagggaggaagctgaagcccgtagagacaaactcagttgcccaaggccagacattgtttatggaagagctaattctagaacctggtgtcctaagttcgctgcactctggctttgcccattcttgagaggccatgggccctccaacatttcgtctctatgaaaaagatcaagtttcagatttccagtttgaattatgatctaataattccaaatgcattccactgcccagagaagtcatcttaatggaaatctttttttcatctttgggggccagatttctcctcttcctactcccctagttgattacagaactttactcacaatgagcatgttatgtatgagtgaataaatggaaaaagcaatcacaaaggaaaagccattttttctttatcagtttgcatccaggagtaaaagatttttgccccaaaactattattctgccccctttcctaaatcaaaatcagctgcttgttctcctttgctcttccttaaaggagctgaagaattcaacttcctgtcagctccccgccaccatcaaccctgtgaattttagccctatatctctcattctctgaagtttaagagaaatgggacatcaaaagcacatgttggcagtcaagagttagctacatggctcttaattttttgagcactgttgtttttgttacttttttgagaaacacgatttgtgaggttaccatatcacgttgcagttctgtaaataatccacaatgctggtgcaaacagagaatgtcacatagttaaagtgaaatgtaaaaaaggagtatttgaatgtttggtttgttaaagaaagagaaaaactcacatagtttgtgaaaagatagtaaataaagcaatgaaaaggagcctatcgaattcttggcacccacatgaagagtttgaatgcctccataaaggtgcttttgtggattggcaactgtgctagaaagcagcaggaactcctgtgctgaatggagccctaagaagcaggggtttcgtcatccctttccctccagagcaggaggtattatctatggggtaaagaaaccggagaaaacttcctctgaacaggagtatctttgtgcatggaacctgagagactcaatcctggtggtgcagctgtgcttgaagccagcactgtggacatattgtgcagagcggaaacgcatggggaagaaaacaagggccagggaggtggcgaaaggaaaacagtccagaattactactttaaaaaaatggtatgacatttcaggggcccagcatcctcagctgcagagctgtgtgctccttttaataattggggtttgaggactgacttcaaggtagaatactgaaattttatcagtattaatcaagtctcagaaaacactcctgatttttagaggaaattataatattcctaatcattatatcattcaagatctaatctcagaattcagctaatgttgttttatatatccagtattttgattttgattttaaggatcttttcattctatattaattgcttaattataaatatatgtttactcaaaaagcatcataatttcaatagaaagacttcaggtcctttggctcatcttaattttagccttaagtatatttctagtcttcatttttaaagcaccatttgtatattgatcctttttactgcttttgttttagactccttttggcagaaattacttgtctcattttttatgggcagattaataacagacacttgaaattgaagtccaaattttaaatatttgagaaataattgttacaagagaaggctacataaaaagtaaatttcgtgggcattaactttgaccatgaccatatgagctgcttttcaactaatctaaataaaaatactttaattttcacgaaaataagattgactattgtaattttgttcattcttttgtcccacaaaagtatgtggaaaaatacattttgtattgtgttccttcagtacatttttttcgataatcataaacccctttatttacagatctttaatttgtctgatacgtttctttttctacaaagatcttctctgactttacctacttttttctggtaactttttcatactctcagtttctttagctatttgcatttaaataacacaacactcagttttttttttatttttaaaaacaattatgaaataattttggacctacagaaaagtgacaaaaatagttcagagaatttctgtacaccctgtacccagctcccccaatagtaacatctcacatacggtgatgaaaatcgggcatgaacccgaatgcagtgctcttaactaagccctgggccttatcctggattttgctttcatgtcctctctctggcttaatagtcaattaagaatccacattgtatttatttaggttgatgcaaaagtaattgcagtttttgccatttcagtggcaaaaggcacaattacttttgcaccgacttaataatttcccccaatctgtagcagctcttcagtcttttttcttcttcatgaccttgacaattttaaggcatactggtcctttctgtcataagatgcctcccaatttgagtttatctaatagtaaataaagcagtgttttctcttaaatttagctcatgcatgttgggcaagaacagcactgatgctattgtgcccttctccgtgcatcacgtcaggggtacagggtatcctgagacgtctccctgtcggtgtgtggaccttggtcacctggctaaagtagtgtcgcaggacttttccttagttcagctaaagacagggtcctcatccatcccatggccacgaaaatttaggcttgcagatggtttgaaggctgagtacagcagggttttattgggtgaaaagggaaaaaaagggggaaagaaggatcctccacgaggccggactccctgctagagcacccgcagtttgaatcccaggttccacacaggaagaggagaagctgagctcctccccgctgcaaagggtgcagacttcccgaggctccaccacaatgtgcaggctggttggagtgtttccagggaccccctttcacctcgctgtctcagtagcatctgcagcatttcccccactgtaaagttactgtttttctctttgtaattaataaataccttgtggggaaatatttttgaactgtgcaatactctgtttctcatcctacctttaccctctaattttggcatccctcagtagttcttgcctacaacactatagtgcttacctaatggtatttcatagtttcctcattccttctgaatttatcagttggaattcttctataagagctgtccctctgccattctttacttatatcagttggagtcgtggatacttattgtgtggatcataacccagtgctgtcattgttttcttcttagattgttccagctgtggctatcaggagccctgtctgtgaacttctgacgtgctcccaacttgttttagagcactcctttactttctggcactataggatgtaccaggctcatattgtattttgcctgccacagtcctggagtcagccatttctccaagaagccctcctggtccgttttgttggagaatggtcttagaaactaaggtttgggtgctaggtatgctcattgctgtgtgttgccatggcttcaggccctcttagcagatgtgtgtgtaccaacccatgcatacataaacatctgtattttctgtttcccctcctccatcctcccctgcccccatctccgtctcttcttgtattcatctgttttcacactgctgagactaggcaatttacaaaagaaagaggtttattggacttacagttccatgtgactggggaggcgtcacaatcttgatggaaggcaaggaggaacaagtcacatcttacatggatggcagcaggcaaagcgagagagagcttgtgtaggggaactcctctttgtaaaaccgtcaggtcttatgagacttattcactgtcacaagtacagcacgggaaaaacttgcccccatgattcaattacttcccaccaggtccctcccacaacacgtgggaattcaagatgagatttgggtggggacacagccaaaccgtatcattccacccctggtccctcccaaatctcatgtcatcacctttcaaaagcaatcatactttccaaacagtcccccaaagtcttatttcagcaataactcaaaagtccacagtcaaaagtctcatccaaaacaaggcaagtcccttccacctatgagcctgtaaaatcaaaagcaggttagttacttcctagatacgatgggggtatagatattgggtaaatacagccattccaaatggaagaaattggccaaaacaaaggggctacagaccccatgcaagtctgaaatccagcagagcagtcaaatcttaaaactcagaaatgatctcctttgactccatgtctcacatccaggtcacgctgataggtgggttcccatggtcttggacagctctgcctctgtggcttggcagggcaaagcctccctcctggttgctttcacggactggcattgtttgcagcttttccaggctcacggtgcaagctgtgtcagtgggtctgccattctgcgggtctggagggtggtggccctcttctcacagctccactaggctcctgtatgtgtgtgtatgactttacatcatactgaagtgtctgcaatctatcaacaaaggctttattctaaccttcttcctttcctcatttgtaacctctttctttgatagtaagacacttggatttcattctctggaatgtgattatttgttccatcctattctaaaagttctttttttccctctcctgtttggatattgaattttttactaattatgactgtgagactcagctccacccattctcactatagtagtttcagaattgctaacccatactcatggaagaaacttacagattttttttcctttggttttacagtatacaatcaaaaagctgtttttcaaagttaggttagttgttttcttccccacccacctcggggtgatgttgttcagctgggttcattggtttctgcgtatttatattccatttggagtatagtacccctcacacactcatgccctgatgagctgtgcctggggcagctgtaacaaagtaccacacactgcctggttcaaacaacagaaatttattttctggagactgagagttagagatcagggtgtcagcagagtaggtttctcctgaggcctctcttcttggcttgcagaggcaagaactttcttctgtgcatgtctgtgccctcatctcctcttcccgtgaggacaccaggcatattggatgaggaccaccccccccgccccaaggacctcattttaactctttcacctctttaaatttccgcctcaaagcacagtcgcattccaaggtccagggcttgggacatcagcataggaattggggaatacacagttcagcccgtaatcccaccatcctggtagattgtaatgatttggtttggggcgatgtgaaatatggccatgatgttaagagtcagtgcccaatttgcttgacatagatatcacccttttgttccttcccagcatctctagctttggtcctcagagacaaacgttatgtccttaaagcagcactatcttgatggatcttctgttctctctgtgacattttaaattgtgtgtccagccatcaaagtaaaatgtcaaaaattatcaaaaataccaaaaaacagaagttcttgttttccttcacaaactccgttaaatttctacattacacgtgttctcttccgccaagtgcctgtgacgtttgtctctgacccaccccattcgctccattttcacatctctctcctttctttgcaaaattcaactccatctgcactaaacctgtctcactgtttcattccttttcgaggtcctgttcattgacaattcaggcttctgacatcatttcctgaccccctttacttacttgctaatgttctcacacggcagatagactcattcagcagatcaaatgaggtttaagactcaaagctttaacctcattgtcccctttctcaagcctttcagtagcttccagtttcctttctggttacatcacattgtcgcttctgtaatttgttcccagttaaccaagtcacccacctgttttcacctccttctccttcccaccctcacggccatggttttgaaccagggtttcttcccacggtctgttgaggtcactaacccctgtgtcgtcttctcctgaaccgagtctgttcagattctcagaccagatccctggccatgccaccatggtagaaataggccttggcgtcaaaacttatttccagggaaattttgccagtgatttggacttccttcctttccttttgcctcgcctcctctcccatcggtcatttactcacctccgcatttccgctggttccgcgtttctgtctagtggctcaggttgtcgcccttcagggcatgcctttaattgagataatttctctttacttactgtataaaatgccctgtcccatctgacacgctctgcagtctctcacctacatgactggaaggagggaggggacccagaaggcgtcttccttcctcactccctcatctgtgcgatgctacacctctgacagatgtgaacttgagggtttttttttgtttttgtttgtttgtttgagatggagtctgtcacctaggctagagtgcaatggcacaatctcagctcactgcatcctccacctcctgggttcaagcgattctcctgcctcagcctcctgagtagctgggattataagcatgtgccgtcatgcctagctaatttttgtatttttaatagagatggggtttcaccatgttggccaggctagtctcgaactcctgacctcatgatccacctgcctcagcctcccaaagtgttgggattacaggcatgagccaccgcgcctggcccaaacttgagatttgaagtgatcagtccctagggaaatttcccatacatctttagccaaaattattgtactcatttttaagcttaatcctcttttctttcatagagaacttatattacacataaagtaattaaattccctgacagctcttttttagtttttaaattaatggcccatgttggcagtccgtattttggaaagggacaaagtcaactttttaataacggttgtagtaactgaaaccttagaatgtcaattaacttgatttcctttaggtcataatttttagtgctttttgctaacaaaagaggaggttatttatttggcaataaagttgtcttctcttacataaaatgtgctctgtgcagaactctgcctctcgctgggtcctggcataagtacaccatctggatctatcacgggaccgtttaaagggaaaaacaaccttacgctttgcttttggtgttttaagaagaatatgaagcctaacgtgggcccataaatgccagactcccctctgcagcagttggtgagagagccgttggagcgcctgagacagttttctctgggtgccctggatatagcatcttgatttttatagtagttaattgtcttaaactcagaaagaaactagaagtctgtgctgttttcacgttctttttcctttgaggattttaaaattttattatgcaacaaatgtggaggtggggacaaaaccaaaattttaacttttttttaactgaggaagtaaaaaaaggcaacattcttcttagcaaagccataaaaaacagcacaaataaaattgtttatactgtcaagttagataaagcagacatgagaaaaattattaatataaagaattcaagatagtacatgttttcttaaggttcaacaaagaacacttcctcaaagaaattgtaagcagctcagagccacactacaggttgagatatgtggcgaatattccaggtgacttttcgtcagaccaaggcaagggcatccaggtctagtgtggagggcaccgaggaacaggggagcgcacacacaccacagaagctggaagtcagacccgacagttcccacgcagtggacattctcctctgaagccattgtgtggtgtgggacaagggagcgaacatatggaaactttcaaagagagagtaagaatgtttctccgctaaggaaaagatccaatttccaaggaagacaagaaagaacttctaagatacgctttcctaaaaactccttatagttcgcatgcaagaatttacattttcagttctctggctgcttcctgtgaggaagaatgaagatatgtttttaataagtgaggagcggcattacagcacagtgatgtaaccagttggctattaggccgcattacatttctttttttttatcaagtcacatcaggaggtgctgtttggtgtgtgagtctcagggcggacctccctccagatgtacacaaagcccaagtcagggaagccattcagaacggcctgcgtggggagggcaactgtcacttcacatttcactgagtaaggaaattgcagctctggctagtgcaggcggggagagacatctggtttccagggtgcctgaagaatttccttgagctccaattagagtcagtgtggtagaatgaaatccaccgcgtctgggtattcccacttgtgaaacccaactgcagcgcgcgcgcgcgcgctcagacgccagcgagggagaggcgcgcgctgggccgggccgtgggctggcgccggccgctgagcaacacgctgccagtctgtgtgcctgtccctgtcgcgtcccagtctgtgtctgagtgtctgtttagctggtcgctgcttttgctgccaagcgggtggctctagctgctgtggagggagaggtaggataggggttctgcacctttagcctccagtcggctccagtcaccatgcccaacggattgaagccagtggacacgctggactcgctgtcctctgtcagttcagcctactgcagcggcgggcagccgggcacctgcaagtactggatcctcgacctaggtacacaagctctctgcagatgctcgggctggcgctgctttctctctgcctgctttctttccagtggctgcgcagtgattgacatgtgctttaaaacagaaatgttttgtgcttggaacctgaaacgtgttccgtggtgaccaccttgggagggggctgtgtctgggagatggtttatgggggggccactgggaatgtgaggagcaactgggaacagagcactgcacatccattgtgtgttgtaagacctttttaatatctggggactgctttttattatccctttttcttataaatggcatgtaaagagtgtaaagtaatctgtgctacaaattgccttatgattttagttggctttatgtctgtttcaggtttaattttgtttggaggttttcagactagagaaaacaacatgtcctaacatatttagactctggctctccatgagaactacagccatatgataagataatacaaagttagctggggagagggatgcttccaacgttgccattgtattcaagggagtgtctgtgccagattctggctttatctgcggaactagggaaaagacgtgaagatgtgattcctgcaaaggttatttgagaggtcggtaagcttcactttgaggaaaaggcaacaggatacaaaagagacaaggtgaggggagttgggtctgcagatgcccatggaatgctgccctgttccagaggccagctttgtttcagtaacctttgacagctctctgtccagaccatacagccgaaaaaaggagtctctcacagggtgccacctgcatgccagcaggaatgctctctaccagaatttgggtcttggcctgggtcactttcagtgtttgccttcactttcttgtcagccgttatccgcgtatatgcttcggaagtgggcggcaagacgcagagagccaaggggatttgctgagacttaacggggcacttccagttcattaagagctctatggagaagggtctttcggggtgcagggatcccccaaagaaagggggtagggtgtcggatcaaaaggggggcacagaaaatatgtattgggcatctgaaggggaagtggcgctgcttaactctacccatttgttcatggaatactaggaggtaagagttggctgcgtgaatgttgcatgtgtggttctcaacatcattttcaataatactccttgtatttttgttcacaaaacctttaaaaagtctttgaccctgggctctttttgtcatatttatgctaattgttttaccactcgaagatggtgacctccctgtctgcaggtgtgcaagctgggtaggtccctcggggaccctgtgcgctaggaattcctgcactgggtgggttaaagtagatgatgcatctgctctcctaatttaatgtagtaatttctgtgcagtgcaaagaacaactggtcacatgaaaagtctgatttgatgcctcagccgctagctagctctgaatcttgagtaaattaccttctctctctgaacttctctttctttgtctgcaaagtgggagtaacaatagagcacgcccctcaggatatcataaacatccccaaagtttagaacaaaatattttaatgaacaatttttctaaagagtaatggatcttaagacatagcattctttctgtagagggaatttttgaatcttagtggtatcttaattccttcagaattcttctcaagggacattattaaattcgctttttaaagtactagaggataattgtgctgttacattttttgtttctctctatatatttttgttggtaattcttaaactattaagaagctctaggtggtgttcttcaagctgtcacctcagaatttttaagctaggaaaaattcgtaagaaaaattgatgacccgtgtggaatttcctgaacaaaaaatgatcacttcaccataaaggatagataagaaaaagcgaaattcgtgcatatgcgtgtgtgtgtagaaagtgcctgcccatccttttctaacgcttatagtaatttcaagacaatttcctgaatgctgttatatcagagtgatgttttaatattctgattttacctattaaattgattatggggaaatacatatgcatcacattttaaaaggaagaatgattctgggtaatatccaagaaataaatcccaaagtaactttacagtgcccatgaaatcactgagtgtgattgcaaagcccgtcttacacctgcaagcagtctggggcttcatgtgttagagtactttgggaaaaggcagttttcctgcttcctgaagttcattggggcatccccctgtccaaatgtgaaccagtcttgcttggagtaatctgcacagaagcctgttttatgtgctgacattgccattgtcaataacttacacagacatgagccaggagagttttactgctaagcgattgttaagaaaataagagaaggtaaggtcaagaagaactgtaaatcttcttttatgacgtttccaatgggagagcctagttctacggataagagagtggaactattgggttggttatcattctgaaatcagtattcccttttataggacagatggaatctattccagtgctatacgtattcccctgactcaagctcaggaaaaacataatctggtgactctccttaacactgaacagactcttacacaaagtgaactgtgtgctttataattcttgaattctcttgaagtctttttttttttttctttctgtttgggttaggaatatggattctcaccactgcaatttttgtttttataaattaaagggaaacattccaaagactaaatataggataaagaaatttctttgctgaagaaatacataatatgaacctattctgaaagtatccaagtggatgaacagtactgcctcaaattaaagctgtcagtacatggaatattcagtttcacatgaataaacaaaaaccacagaagtacttgtcacaatgttggattgtttcgactgtgaagactgattgtgtcacacaagttgctgtgcaaactaaattctatctcaaatcgttttttgccctttaagtatctttaagtgaatggtttaagacaggatgtgcagtataggatagtgggaatggtgtgttgctgtagaagccagtttgtccctgctcacccctacctgtgtgatcttataagttcttgataatctcgctgagctgcagtttcctcatgtgtttaaaacaaacaaacaaaagaagatagagaatgctcgctattatggttattatgctctccaaaatctacattgaaggttctatttcattttaagcaaactgcattttaaaaataattttgttcccttgcttccatgttaaacacgaaaaaagagtgttacacattgaatttgtatatatttttagccaagaagcaaagaaacttgaagttatttggtattatagccttttttagagtgaatataaaatcttgaaatattagaatgtttttgaagttaatattaaaattagactgaaacctcccccaaaaagtgcccaagaaacccacaggtcccaggttaggagccttcaggcaaagtggcttttcctagttttggaattcttttcttatttctagacaaggagcaggcaccctcctcgtttaactgtaatctgtctttggtatgtgctctttctaagtatatctcttcactagattttgggggaacacaaatttatagtttttcattctgaaaaatttcctccaggtgctcaaagttggcctcagggacacgtgagcaagtccataaacagagtgagtcggcctgggagctgggtaacaagccatggaattcatccatggagtcttcctcatttcctcttcctgtctccaaggagtggcagtgggggctgggcagccataaagatgctcctattaattttttgcaattctcatataaaaccatacaaatatgagcaaaccacataccccccgccaaatatctagtttctctgaaactatatgtgctaagtggaaaactcccagacagagcgagcagcagaagggaacatagcacccttaggcagccactaatcacgttggacacatcttctagtctgtttatatgtaaaatgacgcttcttttgttgatacttttaatatttgactataagaaaccatctcaatcatatccattgtccagtttctcagatgcgcagttgagaaaccttgctattgctacttcttgttaaaatcaacaattccttctgtagtgaaatggacctgtacctatcagcatgagaagactagaattattcttctgtctaaggatacagcctttgaaaaacttctgagacaaaatatattagccctaaggcaacttccccttcctcttttatccttgaaagctgatggattatggtaagaagtggcccaagggcacagaagcaggcgtgcagttgagtaaggaactcttccataataaaaaggggatgtgcttattatgacataggaactgaacatggaatgtttttccctttgtctctctccagttaaaaagaaagacagcacagtgcccaccacaggcactctgagccccagccccacgcaggggcggtctgcttatttcccactgtcgcctccggtctgtggccgtgcctttcatcacaccacgggcactgattcagccaaggacaagatccgtgctgttaattggtgttcttagcagaggcgttcctttcattccctttgtctccatctccgcgcttgctttgttcctgcctggaataactccagccctccctccctccctcgctcccttcctctatcctcactgtgatcactccgaggcttgacaggcagggaagagttcctcacaggaagacttaacaacaggaaggtgcgggacattcttagaaagccgccttctccccaggcactggcagcactggagagacagcgtttgaaccccatgtgggatacatggagaactccaaaagcagttgctccagccctcttttctttttgtctttggcctttattgttgtggtggttttagtatgtgataacccaaaaaagtgggagacagctctcaataaatgacaaaatggtgatttgaaaaataaaatgcagtgccattcagtgcatgtgggtgggcagggggaagagagggggacaagatgtcataaaatcaaattagttcaggtcttggtgttgcatcccgtaatgctttgtgtgcttgggagtagatggtacctgtggggtgcatgcacctgggggcgctttacctcctccagtctgtgcgacatgtcttcatcctgtttccaagtgcttattagctttagttgagcagcattttccttttgatgggggagttactcaaatataattgtaaaaggaattcctaattggttacagcttttgtttctttgtttttgaattaaccagggactgtataatataatgtactagatatttgctttgtggtttattggggggaaataatcttctggttcctcattctacatagctgtagctctttctaagctaatattccatcccttgaaactctgaaactttagctaacctttgctgtagacagtgtaaagtggctgggcgtggtggctcacacctgtaatcccaatactttgggaggccgaggtgggcagatcacttgaggccaggagttcaagaccaggctggccaacatggtgaaaacctgtctctactaaaatacaaaaatattagtcgggtgtggtggcgggcacctataattccagctgctcgggaggctaaggcaggagaatcacttgaacccaggaggcggaggtcacagtgagccaagatcaagccactgcactccagcctgggtgacacagcgagactgtcccataaataaataaataaagagaaatagtagttggcaggctgattgcagaatactccaaagccacgttttttccccttaatgctgttattaaaattagtatgttgtcatgtggctctgtgaaaacatgtataagttagcatggtttatagtaaattttcttgaatgtaggtaaaagatgtttccatgctagcattctgaatctggtataaattttttaaaataataataaatgtatacatgaatgaagagaaatcattcacctcctgaaataaatcagtcatatagtttaaaccactaattgcacaatttttaaaaccgttttgcctgggagagtctttttgtgccacctgcttcatttaaagacatgtttcaactttttaaaaaatctgcgtatagccccctgcccccaacgtctttggtatcctctttaacaaagcagccaaagtgatttcattttttttcaacaaatcataggaagacattagccaaaaataaatattcattatgaagaatacacttccatatgccttcttcatgtaagattagatctttcatttctaacactctgtgtttaatgtcaagaactattatgcccatgggttcaacattcatgtttcttaactgggtgagcacctctggaaggcagactcagatggacagaagggtgtgtgagcaccgtgggactgcttatttcccccagaattaactttctgtttccttacatgatggttgtctattcaggacaataataagtactttattgccttgggaataacttcccatatagagaaattaagaatcaagaacccattattttataacagggagaacttcggtatccctcagtcagcagtacacaaaataatagtctcatacgcatgctgaatttgttttgttttgttttgtttttaataatctttctttgtatgagtaatacgaatcttgggtaattttgtgaaaagaacagccatttgactttttgggaacacagaggatcagaaacatctgaaaaagccacacaactagaggagcattcagaagttcttgctttctgagcatttaaacagaccagagcccagagtgccgcagcaggctgtcgctccttgcctgcctggggcgggggctgggggaatatggggtcacatgctgcatcctcgccctcagcctccatcagagcgtgggttgtctcacagcaggcctagacgtggccttatgcctgttgttctgtcatgcaggagaggtgcagggaaccggatctcccctgacctctgctgtcagactgaaaagaggaccctggaacagtgccacattggggctcgatgcgggcagtggggccactccctggctggagaactttccccacgagggctgatgcgacatcacctttccaaggtccactacccccagccagtactaaagagccatgtggactgcgcgttaggagcggggcagaaagctgctgggcatggatgtcttcagctggcaggatgtgtgtgtgtctttctggtttcatttatatggaattttttttttttaagtgtctctctttcacccagcaaggctatctgcttttgttcttgtgtaaaagtcaggaatgagtccaagtcccctcccagtaatcactggtaagatagttccttggggattttttccttttgttatagcttagacttttggttacagaaaaagcatactgttcatcttcccaaaaaatatattttaggggctggcttacttaaaaagcagtgaaaatggccctatcatttcaagacagcaatatggcctagacattctcctctagtcaagtcagtatttgtccagagtagagaaagatcacattaaaaagtaagcctcggcctacagagttgggttaaaaaagacttttttacaacctagtgattttttatgacatcgtggtttttaacaatgtgtggccatctgccaggcgagccatcaatctgagtctgcctggttcaccccatctcacctctggaaggaaatgggagatgaggcaggcagaacagactgcttccacggccggtgggatgaaagacgccctctcggccccatctctgctgggaggcagtgtagtgggaagcagagaaagtcccatggaggcggcttccgttagcactggcatgttctgtttggtgacatcgacgcggccagcctcctatctctagggcttctcactctgggtggtgatgaggccattttctttcaagacgtgactcactaagactagcccaacaaccaccacttgattcctatgttggcctcttgttgctcggctgctggtcacaaggcagaacagctataggctcatcttttcctggaagccaacagcctagtgatcaactgtccaccagctgcagaccacgtgtttctaaagcattcctgagcctcaggccagccaggtcctgttccgttcaggacatgtataactccagtctctagccttgttttaattccttacgttgatccacactagcccatttttactgttatccacgatcagtaattggactctttcttcatttattttatttctgaggtgttttacactttcactttggcaatatgtgagatcctgtgcatctgattaaccaagcaaaggatcttaccatctgttttcatttacatttaatttcttcacgtttctttattggaaatttcagtggtgaaaataaaaagaaagacctttaaaatgaaatggtttcctgaccagaaatgctgatagattagcattccccttccaagaatcagcttgagaggaaaaatgatgctcaaagtcttgcatttgtctacatagctacattttccaatgcttatgtaatgttttcagtgttttcagaaacgacgctgagaataagagtgtaagagccagtgtgtacatgtgacttccgttggcttgttctgtttggtgagatcgacgcggccggcctcatatctctaggactcctcactcttgagtggtgatgaggccattctcttttcatgacatgactcatgaagactagcccaaaatggggagactgcagtgtgttctcattttcataattcacaaagaagagcagttgtttttcactgggttggttttaattgatgccagtgattacattgtgttctggcattcagggtcacctggaggtgtctgctggtgaaagctccccactgaatttgtgggaggggctgcgcagggaacggtggaagtgttggcccttctcaggcggcaaagaccatgtgttcttcattacagcatgagccgtggcagtgctgtgttgggcctctggttgaatcttgggattatttaagaaaaaaaaaacctggggaatttaactttctccttcatgttttctgtgttcaattcatatttgaaagcaaagacagagttcatatttttgcatttaggacccactgtgcaatatgtaaaatttgcttttaatagtcttttgccacattttcagtcattaccattctccagactcacgctcagtgcttctctggctgttgtaaagatttcccatgctgacatgacagcataacaaacagttgcagcccagaataaagccctggaacccaggtatgtgcagagaaggagagaacccctggggacgcagtgtccattctaaatctggtgtttcaacccctgatgaatctttcttttccagaggaacaaattaagactcactagtactcacagacagataatacaccaaacatatgtaagagcaaggtaactggaatgaacacatagaagtcagccaagaaacctctccagatacttgctcacaaatagaatatagatttaagtttggagaaatgttttaaaaatacttgtatattccgaaccaccaaaagggtaactgtattactgggcaagtcagttgcttaagatttcccaagtaataccccagctttgtctcatcatcatcattttaattcaatatgcattgcccaggggatgattataatcactgtgtaagatgcagagaagatgcagtccctggaagttgcatccagaggattaacttacagattaactcagtttttatgtgatctgtaagagaatttctagtgcactgtggtcttttctttattcaaaaaaaaaaaggccaccttgattccaaaagcatggaattcaaatccagtttgaaagtgtagagatgacaatcatttactcagaaattttgctctagaacatttgaaccaacaccgtcaacagtcataagctaagaatttgattattctttttaagtaatttatagatctgattttcacatttgccttacagcctcccttgtatggtggaagaacttcctgaataaaaatgtgatttattgcatcaaattcttgacaagacagaagtttgagaaattgctataggccagttatacctgattacaccgggactgccctcttttcaaatagtctgatggagttattttcagacattagaagcagttgctgcaaagtgcctttgaattagctttcatcagcacatagcaataactgctaagtgaacatttctttaaatccttacaactagaattttaaactagccctttgcttcaagaacttgcctctgagttgtgctgtatcctggttagagtttttatcaagacatcatttcattgttcatttgacagatatttttgaacacctacaatggacagtaagatgggaatatctgtctttaacataagctagctaaaatcctttgggggagacagcgtggagaatttgcaatgcaagacagatgttcaccggaactctcctgctgttgagcagggcatccgtgggtggccctgtctcatcggaaacgccctggctgtcaatcggcagcagacccacatgtgtgcatgtttggctgacgttatgtggcatgagggctgccagtcacagcagaggcttggtgaccttgtggggtttgtgaccctggctgtccaaggaggcccggccttcacagccccagctcttcttcccactctgggcctggggcgcttgtccttagattcgtcgtctcgccgctctgcttcatcctgctttcttcctcagccttctgcagctttttcctacacatcagtgtgagtattccctcatactgtgttaggctataagtttccaaagacttttttcataccttttccccccagcagcctggtaaaggctagaggaatcactgtcattttacacatcaagaaactgaagcaaaaagggggtcattgactcataagaacccacacccagcaggtggcaggggtgttagtggaaccccggcccggtggccttgagtgtccactcatctgtaaagaccacaccaggcaaatacctattgaacacatgcatgtgccaggcagactttaaactccagatatacagcacacacaaggcagcaaaagccacttctcctggtgcttccatgctggtgagactgagaaatggaagacatgcagagatttgggtgaaaccttttcaaattcagaggctgaagtttttagtttggcttactactctgctcagcaatgcagttgttactctagaacactcagaagtctttaagacttttttaccattgtgaaaataaagagagggttaaagtgaaacatgatcctccttggtctgcgaccagcaggatatggtcctttccctcctttttttaaaaaaaactttttttttaaggtttttattaatcacagatgtcccaaatttacagactgggcctagaaaacagcctctcttgtcctggcagtccccgtgttttgtgtgttcacatggtgaaactctctcctgcgtggggctgaatgtcagcacttctgctttctcttctttctttaccttttttttctttttttatttaaaaagaaatctagcatggactttttttgaactcttatttcagcaaggaagccatctatgtaaggatttttccctcctcaaaataagaaggaatgaatttgaattgactttctcttggtgcttcaagcagatcacagatggctttctcatgcgcacagctgaacatctttttaagtgactgcgatgtgctgatagtatcttgtgctcaagtttactttgttctattttaaaaatagaaatagaattgaagtaattcatctagattgcttcattcatccttcatattaaaagtgatttttagtacatcctagacgccatgttaggcctgcagttacaaatctaattgtgatgaaacctaattctcattttctgggtactcacagttgatgtaaatacaatgtagtgagttctgtgctatcatggagtcctttatgcctcagccatcctacatttataaacacttaacagtttatgaagtttgtttgttcccattatttcatttaatcctattacaaccctgtgagatgtggaaactcacatgccagaatgtttgctgtgtagtgggagtgccaggttcactcaggccctttgacaagtccagcattctttctgacatcccttatggatcatccatctgggccttggatcagcgggtttccccaggctggaaagggggaagcacattcccaaaccaggcttagtgggaactgaaggcattcttgctgatgagaaagttagcgatggggtgaaaaagcaggactgagagttagttgacttttttttcttccaaggtgataggagttgagggaaaggcaagagatgagtaactatttctttgcataatagatgcatctttttttttttgagacagggtctcactcacccagactggagtgcggtggcacaattctggctcactgcaacctctgcctcctgggttcaagcgactctcctgcctcagcttcccgagtagctgggactacaggcatgcgacacgatgccaactaatttttgtaattttagtagaaacagggtttcatcatgttggccaggctggtctcgaactcctgacctcaagtgatccacctgcatcagcctcccaaagtgctgggattacaggcgtgagccaccgtgccctgcccagattgatctttcatggtatttctcaggtcagttctgtcctgagcccccaccccgacactgctttacatgacaggcagtgttcacgtacacttagtctggactctgccttctgagacagcaaagcagtaacacaagtgagagatgagtcgctagaagggttgccttatttgctttgaattatcatctttgaataaataattcacaaactcatgaacttgactaaaattagatgttacttgtgttcacttcaaaactgatcaggatataccagtaactcaggacatcaccattcatagtggttgacttatcagtcagtatgcataggctgagaaataatagcttgcagctggtttgttggctcacctgtttgtcatttattcagtgtatactcattaagctccaggtgtatgccacgctgcctgctggcagctgggtatgtagttagaaacaaccagacatggtgccctggagtctaaggtcatggttggcttcctgccttcacagttgcccagctaggaaaatgttgtgtccgaaattgttgggttcttggtctcactgacttcaagaatgaagccgtggatcttcgtggtgttacagtttttaaagatggtgtgtccggaggttgttccttctgatgttcagacgtgtttggagtttcttccttttggtgggttcgtgggctcactggcttcaggagtgaagctgcagaccttcgcggtgagtgttacagcgcttaaggtggcacgtctggagttgtttgtatctcttgtccagagttgttcattcgtcccggtgggttcgtggtctcgctggcctcaggagtgaagctgcagaccttcgcggtgagtgttatagctcataaaggcagtgcggacccaaagagtgagtagcagcaagatttattgcaaagataaagcttccacagtgtggaaggggacccaaatgggttgccgctgctggcttgggcagcctgcttttattcccttatctgaccccacccacatcctgctgattggtccattttgcagagagccgattggccgattttacagagagctgattggtccattttgacagggtgctgattggtgcgtttacaatccctgagctagacacagagtgctgattggtgtatttacaatcctctagctagacgtaaaagttctccaagtccccactagattaactagacacagagcagcgattggtgcatttacaaaccttaagctagacacagggtgctgattggtgcatttacaaaccttgagctagacacagagtggattggtgtatttacaatcctttagctagacataaaagttctccaaggccccactagattagctagacacagagtgctgattggtgcatttacaaaccttgagctagacacagagtgctgattggtgtatttacaatcctttaactaaacataaatgttctccaactccccaccagattagctagatacagagtgctgattggtgcatccatgaaccctgagctagacacagagtgctgattggtacatttacaatcctccagctagacataaaagttctccaagtccccacccgactcaggagcccagctggctttgcctagtggatcctgcaccagggccacaggcggagctgcccgccagtcccgcactgcacacctgcactcctcagcccttgggcagtcgatgggaccgggcgctgcggaggctcaggctgcgtgggagcccaccgcagtggggcttgggcatggtgggctgcaggtcccaagccctgccccgcggggaggtggctgaggcctggcgagaattcaagcgcggtgcgggcgggctggctggcagtgctgggggacccggcacaccctctgcagctgctggcccaggtgctaagcccctcgctgcctggggccagtggcgctggctggccactcggagtgcagggcccgctgagcacacgcccacctggaactcttgcaggcgctagcctgcgagcaccgcacacagccccagttcccgcctgcacctctcccaccacacctctgtgcaagcagagggagccctccagcctcagccagctcagagaggggctcccacagtgcagcggtgggctgaagggctcctcaagcgtggccagagcagaagtggaggtggtgctgagaacgagtgagggccgccagcatgttgtcacctctcaatgtgatcatgagccgattacacagggctctgaccacagggctcgccttcagagggctgctcttgttatgggtttgagccatccacaatcaaatcctgagcaaaaaagtaaggacacagtgccaaaaggacaggagcatgcctgcacagtgtgggtgtctgggcagggggtctcatgctcctgtgttcacagccatcaggacctcttctggggaaaggcaactgtgtgcacaaaagtaatttaagatcttcccatggagacttcagaattctagagctctgtgtttatggtgtgatatatccttatcctgtgcccagtaactctggagaccttaattctactcaagataccattaggacatgggatttaatttaaaattcgcatcaaagtagctgatttagtgggcaaagtctatatttttcagatagctaaaaataatagatatgttatttcattctgttaatgatggtattaagtttaaagacttttaaagctttttaaactcctaatgtgtacattgtatcacaacccagcaaagagcatagacatgggctgttacattccattgatttaggccaaaggaatttctactgtgaaaagaaaaaaagttttttccccaccagagagagtcaaatagcatgaagaattgagcattcttgttaaagagaaggggtcattattgtccctctacatttgcagacttctgaaacaaaatttttctcaaggtaaaattttttaaattccacaaaatttttcttatagtttatgaccactgctaacatttttctaagtcataaatattccggcaaaatgaaagaatgtcacttccgtcattcaataagtaggaactcagggcaagaactgctgcttctcatcaatggcagttgtcacccagtcctttgcatttaatctgtggcaccgatgagctcccaccttgggcagccctgacctccccccccccccgccccgccccccggtactaggagtgaccatttaggccatagccacatttttaatgcttaacctgccaggtaagcaggaaatctctttcgaaccagcttcccaaagtgcaaagaaccaaatcccttgcagctgagcccacagagagaagctggggaatgacgtatttaatttccttttcttcttgaaccatttttacaacaactagctcctttcccaggcaaggctaagtgtcctgggaatcatccttgtaacgccagctgggtgccacaaagcattattaattgactgtggttccttctctcatgcgtgcagaggccgctggatctgctgaacagtagggaggtctgtgtgcttcagggctgccctgcgtccctgcctgccctgcatgcccttttccgagagcacgcctgcttctctgtagccctgcaagtctgggtggacagagggaccaggtcagaatacttggtaggtgtcacttaggcttcataccactcctatgccaactccccccaagttctaacttacaggcccaaaaatgtctgtgaggttgatttattggctgaggtcctactagttgtgatgtgtaagtgttctgcttatgaatgttaagacctgtacttgatttcattttactaaaataagtgggcctgggtcttttttttttttttttcctccatcagtttatccaaggcacagcagagctccgtggtgacacctcaccacatctcaggcatccgggctgtctcccgacctccccacgggccacactcatagttccttgtcttgtgcagttgtgaatctatgtcaaacaaaagactgtccttaaaatatgagctgtgggtcagcttgctgtttctttagactgttgatttctgatgtttccatgtaatacttgtgtgcctactgtatgccaggcactgtgcagagccctggaagtacctcaggtcccagacagatgaggcccctgccttcctggagcttttatccattctcctgacccagtgcctaggttacctgtgcccacctccctcaaaggccagcttcagtgccatctccttcagggacccttccatggttcctcctcctgttgccccttctcaaccctaacagggtttgtacctcgcctatagtacaggataattttgtgatccaaataccactgtgtgctgagtcacatggatgaagaaactaggtgttcattatctctgtccagtgggaaatcgggggcttggctccaagtcacagcacagtaagtgactctgaaatctgccacctgctccacctgctgtgagcagtgcagggttctgctagcagttggtactttaaaaaatattcgttgaataaattgtcatctgacatatagattatccaaacctgccccttctctttgtccttcctgaggctaggaactgtgtctacctcatttgcattttatcttaaatcagcacctgagaaagtccctgggaatggatttcattcttttcctacctccttccagaccacaccgaaggaaagtgagactgatagggaaatgttttagtaactcttgtttaaaaatagagtaaatatatgagaaaatatatatacatataagtacacaaacataatatagacacacatacagaggggaaagggttatcattctttaacagatatcaatgggttctgaaccagagtttgcctctgagaaaaatctggattttgaagaatgaatgatcctgcctaaaacgcatcatctgtttctggaatcttcactaatctgtgtcttgggcgaaggaaggaacgggacagcagtgagacgggcgtgtgctgtctagtcccagcgtcggaagcacttggtgggaaaccgctgccaactctgctcctgtaatcacagggttcacctgcagcagggaatggcgtccagagccagagaggcagtgcagcccctacaggtatctgtgcaaaggagtagctcacaagattacttgacttgagaagatagcaagcacagtgaatgatcaccattgtcaccgttctgctttctaaagttggtcacttcattccatgccaccgtggtggagcccctgagccaagagctcaggaaggggcccagcagctttcacgctcactggtgtgcgagttgtacagtagacgtcacacaagtccatggattggctgagtgtctgctgtcacccaaatttcagatttttgaatacaaaaattagctgggtatggtggcagtcgtctgtagttccagctacttgggaggctgagacgggagactcttgaacccgggaggcagagattgcagtgagctgagattgtgccacagcactccagcctgggtgacagagcaagactccatctgaaaaacaaaacaaagaaaaattggattttttttcttttttctcttgaaatgtcatccactccagattgactatatttaatttttgagatccaatgagaagctggtttggatatattttctgtagagcattttggttatttgaggaaggcttctcctcctcacatttcttttcttttttttcttttttctttttttggggatgcagtttcgctctgtcgttcaggctggagtgcgatggcgtgatcttggcccaccgcaagctccgcctcctgggttcacaccattctcctgcctcagcctcctgagtagctgggactacaggcgcccaccaccacacccggctaatttttttgtatttttagtagagatggggtttcaccatgttagccaggatagtctcgatctcctgacctcgtgatccacctgcctcggcctcccaaagtgctgggattacaggcgtgagccaccgcgcccggcccctcacatttctttttaaaatgtggtggcgtttttgttcattgttgctgatatttacttcagcacatgtggtaagtttctcaagactgtgagcaaagtcccggtgtgccgccgtggcctggccgtgaacaggaaagaggctgagggccgctcctccgagagccccaccagctctgccactttccagtcgccggctttgtcctggatgctggtctcccagaggctgctgctggtcagagtctcaccaggacaaatcactgtcattttatccgtaataattacacaattctgcttttgttcactggtagagaatcaaactaatgcacttctgcgacaggattagcttacagtaagcatgtcagttggcatagctaaaacttctcaaaatttcctttaaattcattcttctttcttggtttttgtcaagaaaatgggtgaaaatgattttaaaattctgtcctccaatgtccgcagtaccaatgtccacagtattttatgtgatgaatgacatcttaaatctggctgataacgatgctggtcttcaggattggtgacatgggtgattttggagaggacagtgcatcttgagaatgatcatctctagcagaactcaggtttgctacacatttgagaagagagtgcgtgtaaagcatcagcccctgtcatctcacaccccgtaggcaaagcccgctgacgaggcatccaggcccactggcttccctgcagcctgcgggataatggcatggtcttcacaccggagggtctgtgcgagtcagtgatactccctctctttctccctggcagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggaggtgaggctctgcccgctggttggggccggcgtggcggggcccgctgggcttttgctgcaagaatagttgctgatcttatgagtaaactggtttggttctgttttccgcacttactcagaaattaccattcaagtctctgcttagcagactgagatttagtggggacacttgaaagaaaattgaacccagtaagcacattcaggaccacgtgtggcttctgattaaaaacaaacaaacaaacaaaacagatcaccatgcgccccaggcccagtcagcccccaggcctgggccaggagggagaccagacttggcttctggaccctctcctccccactccaccatgaagcaaagccagaggctctgtgtagtctgcagaagatttgggcagtctctgagctgatcattgtggcagcattttgcagagaaagctcaaattggaaatttggaaggacttgtggagtgtttgcactttccaattgtttttccccaatatttattatacttacagcttgtcttgagtagaaaataaccagttaatttactttgttgacccagtagtaaacattgggttattcccatgtcaccaaaggtaagtgcatgtaggtcagccagagattttttatgtcctattgacaagggaggctttaaattacattgcaagaaacagaattccttcaggatgctggagatggccttcagcactggtggtgtcaatgaggggtcctcagagtttttaattaacttggatcgacccccgactcaagtctcacacaggttcgaaaaagaaaaggcagagagtggggatgagatttgtgttatttgatttatttggcagatagctgttttctgctgtttttttcctgggcatatttttgccatgagattttgttgcagtgtgggggttgggatgtattatgtacattcttgataaacctctgtcctcttaggaaaactaaaactgaaatttgtttctaaaagtgagaatagaggaaaagaatactcaaatccagtgcttaaaatgcatcttggattatattttttatgcccttattatttcagtgaacttttctatagcaagatacccaaagtgaaatcagctggaccaaaggaactaaatcaacatgagggttgtagctcaaatttttgagcctttttaaaaattggcttctcaaagatgagctgtgttcagagcctaacagatcacattggcagtccctttatatgacacatgacacattcagtggccattctgtcatccaagttgacaagcaaagctattgggtagcaggaagagaggaaaagttaccatcgaggtcgagaatagctttgttcctgatttctgccatcccagtctctgtccccaccttgcttctccaagtaacccttggtccacgtctgtgaactggcctggaatataatgagcaaatcttgactggatttcagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggtaaagggggatgagggctggggaatccatgcctgccgtgcaggggcagggcacgctcggtagctgcttcacaccagcctcatttcaggagacaggaggccccaagatgtggaaaagggcaatgcagtgctctttcaggcagcgtcagcctggttgtaccccaaaagtatgagtaacaaagccatttagaatagcagtaggccagcgggtgcagtttttcttacacatgtggctcaatgcatttttaatgatgcttcagtaattgccacttctaaagtaattttaaagtttcctaatgtattgactagaatccctgagagaacaatcagagatatcccatgcaggtctgtctgaaggcatcactaaatgaagagttggccatctcccctctgtgaggtttttgcatgcaggtttctggtttgagatgaggttacatcactgtccagttactttttccaacatgccagacattagtttgtaggatccctacgctagagtgcaggcatagttgtcaaagtgtaggaatcagttgaaagctctttgggtctacgcaggagcttcaagccatgaaagtcatttgttttcttgagttcttacgtagtctaaaattattttgtcagcccaattgtagagccctaaaaaataaaatagcagaaaggaaacctgctcagtgtggcttgcacatcctctagcattctggccctattgtgcccctcaaaatcatgctatgaagtcattactggtgatgctttttttttttttttggcagtaactaaattttctgagtaaaacagataactttatcaacatcttcccccatgcttccctttttccttccctgacttccttgtcagtacttgcacagtcacttgccagattaatcaccctctattttacgacatgggattggcctcagccggtgcttagcagctgtgaggccaagtcaaatcatgcactcctcttaacccaaggcagacctgtccaccaccccttgttggtggaaagctactccctcctccctttttaacacgagaccagcacactgtaagggtgctgtggggcctgcaatgatggctgtgagctgcaggactgagcacaggttggagtcctggagttttgtgtgcatctgaggttcaggctccccaccatgtgtaggggagaaggaacagggagcctgaggtgagaggaccacagccccctaccccacccagtacacaggctacctggctaggacatggggctgtgtggtttctgtgatatttcctaagctattttgtaatacgctaagccatgcctttttgaaaagcagaaaactggcatttcttaaatctgggtggttgtccaaacattgaggggctgggccttgttgacttactcacccataagggaggatttttctccatttaaagagtgacctgcactgtatccttctgtttgctagttactatgttacctcgttgagtattatcagtagcagttcttcatttacaaaaatctgtagtgattttcccacacagtatataatctcgtgactaattttttgttttgttctgttttctctttttgtaaactttcactgcagcattatgttgatttgtgttctgtgtctgttttggctcaatttccttacctttccgtttgaatttttttctttgttttcttcaccccatattccaaatgtcattagaccaaaccaacatttgttttgcaaagtgcatattttgacccacacgtgtaaaagccttgttgtgagtgtatgagcctgtatctgtctgctgtgagacacgcatggccaggacagcccgctgtgggtcgcatgcctcgccgctgtccttaatatgaagcaaggttcatattacgccccttctagttcccagttaattaacggctcaagtaatctgcaaacacgtcgtgtttgctaattactgaaactcgaacttagtagcccctcccccagatttcctgtcaacccctttacgccctcgattctagccataagtggcatctgatagcttgtgaggcctcagctcttctgtactctgcactaatcatggggaaatggatggcacagaaaatggtgagcttgtccccctccttccctgtctggtcaccgcaccccgttcctttcctcttcctcgtttcttttttttcttaatcccataaacacagtaaagccatttcttagtacctgttttgtttcctgattattccaggattctctcactagaccctaagcctctcattctgctgtaggtcagattctctattccttctccctagcccagagccttgccagcacttgcgaaagttacggttagaacgttcccttgcctagtcacctctttgaaaaaaacactgtgatgttacatgactgcgattcaaatcagacactgtctgcttcccacatgtatctcagacaggttttatttaatgtttcttgtcagaatattgtaaattcaaaaggatgactttaaataaatgtaaacaaagacaaacttgtggtctttttgtctggaattactttcacaagagatggagcttgcaggggaatttactgtctgaccagttactaatgtgagcccttgccccaccccctccttttcttaatttcttctgtaggcctcttctcggttattagtccgccccaccagctccgaaacaccgagtgcagccgagctcgtcagtgcaattgaggaactcgtgaaaagcaagatggtgaggcctcccagagaaagtctgacttttggaagctgctctgtgttgctacttgcagatggatttgcccttgtctttgtattgctctgggctgcagaatgtggctgtggcttatggcacatctcaggagtccccatgaccaccctcgggttcactgatttgaaggactcagagaactcaggaaagccattattcccacatttgcagtgtattcccatgaaaggacacagatcaaaataggcaagggaagaactgcatagggcaggtctcagggagtgcctggttcaagctgccagccatgctctcccagtggagtcaggcagacagaggattgccaaccacagcagctcacccgagccttggtgttgagtgtctgtttgggctcagacgcatatggctgactgctctgtgtggctgaccttaggtagtctcctgcccctccagagatcaagacactgtcacattgctagcatagactatttgccttggtcccaggcccccaggtaaacagacattctcatcaagcagaacattccaaggacttacaagttccctcctagaagctgggggcaaacctcactgcacataccctgcctgcagtcactgcaaatgtggtcagctccagtctgtctgaagatgtgccagggtcagtggtacccacagttagactctccgttttgttttgcaacccctgagatctttcatttgggttcacaatgtgtgagagagaagggtttacattattatataagggcttcattttcttagtgatctctttgttgccagttggccaacgtgggttcatttgataaaagccccaaattaaatgttggttctttgaagttaagacaggcatgtgttgcttctaactgattcaaatcaattaatttctgtttttgtagttttcctaactgggaagtggaaaaaccaccaatggtaacaactttttagactggtatatcctactatccctataaagacaacgtcttttaaaagcagctcctcccaaagtaaaagccctcagtctgtctcagcaatccattctccagaggtaaccactgcgaatagttctgatacgtttccctccagacgttttccttgctggtgcaaacatatatatgtgtgtgcgttttctttccaaatggattcattcaatttttaagactctaataattaacacatcttaaggatcttctcacgtcagtacatacagattacctctttcctttatttaataactgtatagtattcctctacatggattctgtgataataataccactgagcacttattctaagccaggcgctgttctaagtgctgagcatgtattaatttatatacttcccacaacaaccctatgaggttgttatgcactattgttatcccattttacagataaggaaattgaggcacacagaacatttaaaaacttgactagccactaagggtcagagacaagattatgctataatttatttaaatatattcctaatacatacttgtttcccatatttctctgaacatccattacatgtttgtgattatatttgtcaggtgaattttcaacactggaattgctaaatcagagtatacttctttaaagttagaagtttctcttcctgcatttgggcattaactaggtaccagatatatcattcccatttcttccttcatccacagacaacctctaatgaaactggttgactgagtcaaatgggaattatataaagaaaaatttggactgacgtgtcaccctgccatagctagaaatttctccccaggtaatcgtgtggtgttccggagaagacccagtgaactttgaacaggaagcttgctagggtgtggtagataactcacgaattcggactccactggttaagattttggaatcaggcctggtgtggtggttcatgcctgtaatcctagcactttaggaggccaaggcaggcatattgcttgagcccaggagttcgagaccagcctgggaaacacgagaccgcatctctacaaaaaaatacaaaaatcagctgggtgtggtagcatgcaccggtagtcccagctatcgggaggctgaggtgggaggatcacctgagcccaggaggttgaggctgcagtgagctgagattgtaccactgcactcagcctgagtgacagagtgagaccctatatcaaaaaaataaaaaaaggagcttggaaccatgccagtatgtactgagttcagctacatccttggtatctctttaaaagacaagttgataaaactgtctaaatgaagggtgcttaaattgtatccagtgagtttttaagcatccttaaacttttttttaaaagccatttatacacgtcagttaaatgaccattaaaatcattcttaccaaatagccgaaatggtttcccagggaacgctgtgaggcagatctggccactattctgcagctgtttaaattgtattgcattttatgtggtctgtgattcatttgtaattaattcacgtggacttccaaatggagaggtggtctgtggcatggtcagttttgactcttactgtgttaatctcctttttcaattctgaagaattaaactttctcggtttactcagtgaaactgagttgtttctgctcacttcagtgggcataaagctgttggcataggaaaggcataggttttggagtcagatagacttgggttcacagtctccttacggtgagttccaccaggcaagtccttcagcctcggagactgtctttcagctacacatgggagctctcaaccaggtttcatccacatgggtgttcactggtgccttcccctcccttgggagaaccatgtttgtactttatgtgataggttcatcccttcttcattctgccagggaatgcgatctaaattctcccctctttttctggttcaagagaagcatcaccctgtgttggtttcctgtcactaatgctctaacgtcacatgggaactagtttttgtcagaaaacactaatgcatcattgtaatatcctaaacttatactgactctgcagtagatccttaagcatccacatgtgttttcttgtgggtgatttctgaggctgtcgcacactcataattggatttgaacactgcattgtttattcttcagaaactctgtatgtgtttattgggttagggaggagaggagagaagatgttcagcagttacacagtatgatgtttaaggaactgaacctacctaaacctaaaacctgaggatttgactcgaaaaatgaaagcccccctgaaaactgttccctggattcattcgtctggcttacctccacgttcttgatgcagctggttattttaaaggctgtgcatttttcctgcatgtcggcaatagagtaatagttccctgccgccacagtgattgtgtgaacttgactttggggttttcttctcttcactaatcaaaatataaagggagaaacaagaaagaatgaaaataaatgaaatcacatctaactcaagatgttagaaaaacaacaaaataaaccaaagaaaagcagaaggaatgaatttatacagataaaagcagaaattaatgagctggaaaacggtagcataataaaaccaaaaatttattctttaaatataggcattaggtaaccatgtcaagaaaacagaaaacacaaattcccaaaattaagaaattataagagaggaaaaaactgaggaaattcaagcaatcataagacattattttgttcatctctttgatagtaaatttaaaatgaaacctgaatgaaatgggcagttttctaagaaaatgtaatttatcaaaattaatctcataagaggtagaatatttctgtagacctatcttcatgtaagaaagagaggagaaggacacaaaaaacaaccaaacccagagagtttcacaaataattcatccaaaatctgtgaagtcccagtggctgcagttttgagacagccttaggctggtgacagccttctcacacacatttgtggaagaggcaaatgggccacatgaaggcgataaggacgtctagccacaactgcaccgcttcagggtgtgtgcaccctctcggcagcccatcttgtcaggaaagatcagatctaggacaggcagccgaggggcctggggactccattgttgcaggtcgagaaagctggaagacaggtccccatggacactgatgaagtccgtgactttacctccctgccgtctgcagcatcaggggcatctggagcctttctctttcttttctttgttttttctcactgttcaaatgaacagaattcaatctaacaggcttcagctgtccaggtgggggatggggggtacagaacatcctcccttcgctctcaaaaacagatgtgatctgatgagcgtgaaacaagctctgctactcacagcaaaatgtttgcttccagtaaagctcaatggctatttatttaaaagagtgcatttatttttcagatcaaactctgttccttaactaacttaatgtcctgtttttcaaaaataagatcagcagttggtgtgttttttatagctccatgggttttaacaagattgcttgtacagtacatgctttgtgtcctcaaagctctgcttaacaatgaaatcagattcagtctgttactgttaagaggagaaaatagaacaagtgttagagattttagtttattaataccaaatgttttaagtgaggtattgtttttgcattttgtattgtgctgttcaaacctagaataaattcatcacatttttttccagttcaatcatatctatatatccagtttgttgctttgggaatgttaaaagaactataaatcttatgtgttctgtgaatccaggtaaaacaacgagattaatatttaccaaattgaaagcaatcagtcaccagtcattgtcacattaatccaaggagagaagtcaccaatattcaacttacagatttgctgaacacttgcaaagatttgcatgaggttctactggggatacagcaatgaaaacaatcacctatagaaaccaaaagccagtgggggaaagaatgtattgcagaagtaattaagacaagcacgattactattttgtatagagggatagaatggaagttgctagatggagattaattttaccagagtgatttgtatgcattgaagtatgagtcaaagctctagtaggataatcaggaaacaaaccaagtttgttggattgctgatgttgctacatagtccaccaacagggaatgcaggtaccatgtccaggtgccacactggcctgacccacgcacatcccagcagctcatttggcaggaatataaccagtaagaaaattgctagatattaaatatgtgtgatatgtccaaaaatgggtgcagtactctgacataagcaagtataacatttctacttgtttgataacaagaaatagaatatattaatgtatgtaaattcactatccttttcattccaacttttctcttttctccacctcctttgactctatttttttattaatagttgggttttttgtgttattaaatgctataatttcacaaacaaagattttataatttcacaaatacattttctgtattttctgactttgggtattttcttgtcttagttttagccaatcatgggctgtgggcagtaagtgttgttgattatgtcaatttcttccaggcactggaggatcgccccagctcactccttgttgaccagggagatagtagcagcccttccttcaacccttcggataattcccttctctcttcctcctcgcccattgatgagatggaagaaaggaaatccagctctttaaagagaagacagtaagacagaaatgttttcattcttattgttctctgggttccgtcctgtctttgttgccttcaaaaatgtgactgagattcagctctgaattaccgagatgagaagctccagggcctctcattaagtaactgcacgtatgtaaaagactcaggacctaataagggcacagtattccatagctgcagtttcttgttttatttgtatatgatacttcataagtaagaatgatgcaagacaaaaatgtcttctgccacatgtggtgagaaactcctagactttttattgtacatgtgattgtgaaagaaaaagtaatataaaattagaaccagtccccaaaacttgaatattctttgaacatactttactggtttctcaatgccagtaaagcagcatatggtgaaaagagtcctgaaaaatgttacaaaaggtttaaacttgcctttggagaaggaaaaaaaaaaaacgtaagctacgaaacggcagagactgggtgttttattcagcactgtatcccagcacctccgatggtgttgggcacatgagaggtgccaggttgatgttggttgaatgaatgactgaacaacacatggatgaaccttttcaggccaattgaggttgtttgctatactgatcaaatggttgtcttctgttatctgagtggccttaaacggttactgaatgtaacaaacagaaatacttgtgagtgatgtgattagacacaaggtttaaacatctgatttaaaagtttttcttgtatagccagtgaaggttaaaatgacttaatcattttttaaaagccacttcctttactatcatggctttgtcagaaagttatgtctaagcttcattgttgtccctgtatgtgatcagaatccagaagggtgaattcaccctgattgccctcatgcactgtgcctaggtgtcttttgacctccagagctctcgtgggtcacccacttgaacctgtaagtgatttgggactctccagaatttaacacctaaatgtacaaatttgatacattactattcagtcctggaaggagtccatcctgaccaggagcaaaggtacaaaaaaattcatttagaaaacagtttgcatgataaacaatattttttctctccagctacgttttgcaagaactagtggagacagagcgtgactatgtgcgggaccttggctatgtggttgaggtgtgtattgccagaaatttagtatcttcgtatcagttccaagagttgtcaaaagtagtatcgttttagacagttgaacacctctcaaaagctttaaaaacatttttgacccaaaataaaaagtgaccaacgatgtatttccgaaaaattaagtttagccaattgtctttaccatctgtattcagttgtaaatgcttctttttcgcatagtgtatcttgacataatcttttttaacagttgaaatttacaattattataaataatttgatattattattaaatgatactaagtaagtatactgtagttagtagacaggaatcttgccttaattgtatcactacagaaatgaagaccttactggttgaaaaagtcagtgtggcccagctgtgggttcggttccatcctgaatccacccaggttcagagcctgtactgtggctgcaccaggtcatttacttgatagttttgtacagaacacattgccatttccattgaccagaagttgccaagcactgtagccatagcaaaccactgccttttgtactggatcgagagccatctctaggctaatccctgccagtcaattcggggattagtgagattaagaaactcaactcatcaaaaagctatttttgtggtataaaattttatgtgtattctttcatctttgcagatttgtacaggacaatactttttggttacacatcccattaaaagtaccagctattaaagtcaattgcataacacgaaagatttaacatgcttgatttatctgcagtcattgttcacaatgagataagcaacctgagtacttaagaggttcttgtacagacttaaatagaaattttaagccacattttagcagcatattcaatcaactgttgtttaaaaatcagtttataaaaagaatattgttaaacccttatttaaccgattacacaaataatccaaaaagaaaagaaaatctttctgtttctaagagataaatgctgaaaacaggagatatgattctgaccaaatatttaatatttacaaactgtttaatgaaaccatttacatttatttaaacttctttaattccttagaagatttttgatctgtgaatgctgaacagtccagggaaataaaattacagcaatgaatgtaataggtatattccaagtatcagttaaggatacttttcatatcggttttttttgtttgtttttagacaaagaactggttacaagacagtgcatgtgtccattttgccctctgtgactattaatcaataagccactagttgattcagacatattccatgaaatacacttatcataactgtttaattgtagggctacatggcacttatgaaagaagatggtgttcctgatgacatgaaaggaaaagacaaaattgtgttcggcaacatccatcagatttacgactggcacagagagtacgtaaacatgcattgtgcccgatggtgtgcaaagcagccacacttgctaaaccaaggcaggccaggccaaagggaatttattctgttcatcgtattacctgtgtagcctcctggagggagctggtgcaaaggagatattgatgtacccaggagttctgcagtagcatttggtggcacggagagagtcttgtctcttcttcgtgctggtccatgtcgagagtctgtggaagggagtagctggaagcaccagcgtggagccagctgccggagctgctggcctggtcctgaccccgagccctcggcctccctgctgtacacttccattcttcatctgcacacccacattataatgtgggttttttgtgaagagtgactgagttaatacttttacctcgtgggttttttgtgaagagtgactgagttaatacttttacagagtacttagaacaacatctgcatagaataagcttcaagtatttctaactagaattgcagccatctttagaataaatacaagttatcattagaggaccttgaagacactcatttgtccaattattttatgttatttttattttttagagacagggtcttgctctgtcaccaaactggagtgtaatagtgcgatcatagctcactgcagccttgaactcctgggttcaagtaatcctcccgcctcagcatctctcagcatctctagtagctgggcctacaggcacgcagcaccatgtgcagctaacttttttggttttcgtagacaaacacgggcttgctgtgttgcctaagctggtcttgaactcctgggctcaagcagtcttcccacctcagcctcccaaagtgctgggattacaggcatgagccaccacgcctggcccaattcaattttaatggaaaaagtagacacgattgcccatgaaattcaactctgatcccactacattccccacacctatcctaatcaggaggcaatccatctgggggctggtgctacgtagctcaccttggctaccagagcttgtcaacatacctgtccctttagatcactttgcttaaactttaaaaatccttaatcatctgaggattgcttaatgctggccactggtcttccagtggaatgttccagatgcactgtctgctccggttacctggccgggccttctgctctcctgtcttgatgcaactgctcctccctctgctcagggtggagcacgatgtcatcacctccaaagctctggcctctctctgaagctgagctccaatacttgcttctccattaggcctgggtgttccccatcagactccttctcttctgcagaagcagatgggaatatgctcttttaaactatgagatactggacagacatgaggaggaactaccgtgtcacgtatcaagtagtgttgttatttctgtgcttctccctcctaacagaatgtaaaacctttgaacccaggtcagagaggtctttattttcatatcccctgtgatgtctaatttatttggatttacagataaatgatcggtaaactttagaaacagcactccagtttatagctctgtgctgtagacttactgaacaactacagtgaaaccaattcaaaaagggatattttgtattatgatttagtctcctacttccaaggctagtttttaaggctgtgaagggaagctgaaaatgacacagtgtttctgggatgaccagacagacactgtatccagagatgctgtctgcgcagcggggatagtaaaccccttagtacaacattaattggcatggtggtttatgagttaatgtaataccaaatattaacataaataaaaatatatttaagtgataactaagctggacatatatcttaaaagacaactacagcccagaaaacaatgaacattgttgtcctacagctattttgtcactgtgatgatacctaattttaatcttaaagggagctgatgtttataacctagaagttgattttgataacatttgagaaaacttcataaagctggcacaggtaacatatttagttttgtatatctgctgtccaatttgagtctctaaaaattatcttagaatgaatatgaaattcgcaggtataaagaccaagttttcagaaataaaaaatgtccaagtactttgaaacatctatttttcactcattattcagcctaggatattagcacttgtgtccttgaacagagatgagaatgtttgttatccaaagaccaggaaggtcaccagccaagggatatacagtcgtgcctcatcttctgtgcctttgtattcctttatgctttgtagcttaacaaaaggttttccttgtacttgttaagtttccatatatttgttaaatatatacttcacacttcacagttgctcatgtcagaacagactattgaaaatgtaaacctggccaggcacggtggctcacgcctgtaatcccagcacattgggaggctgaggcaggcggatcacttgaggtcaggagtttgagaccagcctggccaacatggtgaaaccttgtatctgctaaaaatgccaaaaaattagctaggcatagtggtgcacgcctataaccccagctacttgggaggctgaggcaggagaattgcttgaacccaggaggcggaggttgcagtgaaccaagatcacaccactgcactccagcctaggtgatagagtgacactctctcaaaaaaaaaaaagaaaaaaagaaaaagaaaaaatgtaaacctaaatctaaaattagaaggccacactggaaatagttctaatattttctcctttctttccagcttttttttaggagagttagagaagtgccttgaagatccagaaaaactaggatccctttttgttaaacacgtaagcacaatagcattgcttatatcctgttctgatggtgtcatccttagtcactggtttgtcagattaaaggagaactcacttatactttatgtaagtgcgtatgtttaagataaaatcaaactgcatggtgttaatgagttggaattaaaatcccttcttcaacatgagttacctgctttcccagtcacctggctgaagctggctatttggctagcaacagtacaggttggtgagagaagaccagagccaggcctgaacagtatctggggtgtctgtgaacaggcaggtattgttgagtggagatgtaactgtacctgcagtgggtttaacataacagccaaatagtgtggatatcgaaaataagcgtattaacattaaagttttttgttttttgggaaaaatcatgatatatttttagaagttagtgacaggagtttttgcatttttgccagtctctttaatgtcttgctaagtaaaagacagctggatttttatatctgcttctgcatccaactcattgctgtgttttttggttcaagtatccaaacaaatccatcttcacacacatatagttagaaaaggatgagtattttaatagccttttcagataattacatagttttcttagacactataccaaaaacttgacagctgatcatttcttaaaggttagttgcaatacggaatctgaaaacctacccatgaacttctcccttgctgtgacattaaatacattgaactattgggcttcgaggctcctgcagccatgcgcggtcctgtgacatcaggcatcagtccactggaagataccaggtcacagacttaggcagatcttccagaggttgacacgtttcattacacagtatccaaaaatccagtttttgaacttgaccacccatctctttgaagtctttaagtgttgtgaagttcagagtggcagatacatatttccaaaattttaattttttgcttgaaagctgtaattttcactaacaaacactgccagttgtttgccttgaaatgacaggcttattttgttcatgttcaagaaaatgtctagcagatacccaagagtaaataattatagtttgtgtcaatcattcttccaagtaaaaatggtggtccataaaaaaaagtggttagttccactcacaactcggttacataagtgctttttcttgagacatttatcaagtgcaattaaagtgttatgtggacatcatcttgtcacaagaatgttaaaaacgtgtatactccctggttgagttttaataaaaagaataatgtttactcatccaggacattcttaagtgaaaccagttttgttttgttttttactataaatttgtggcagtgaagagtttttgccaaggtgccagcaatttcacccaccattggttttgcacatcagcacagatgtcagcacaacaaaaaggacaactgacatcttagtggtatttagaaaatagttgtgaccaaatggagccactgaaaggactcagggggccctgggggtctgcacactgtactttgaggatcactgatttatggaaaggctcattgtctacattttttttcttctgcctttaggatttgagattaaagagcttcttctctactaaaaccaaccaggcttactaggactgttggcagggtttggagtgatggcagtaattctttgtttaatattaagaagggtgttgcggccaggtgtggtggctcatgcctgtaatcccaacactttgggcagccaaggcaggagggttgctgaggctagttttgagaccaggctgggtgaaaaagcaggactccatccctacaaaaaaaaaaaaaaaaaaattaaaaattagccgggcatggtgatgcacatctgtaatcctagctactcagaggctgaggtaggaggatcgcttgagcctggaagtttaaggcttccgtgagccatgatcacaccactgccctcctgcctgggcaacagagtgagaccttatctctttaaaaaacaacaacaaaaaaatgttcttttgctacctatggtgtttgttggtatttggtactgtaaagtgaagggtttggtgtgtatggagagtgatgggggaaggactggttttggagccacaccgtagaatgctgatctacatcctgaatctggaatttactcccgagagccttagctgtgcagcttggttttaagatgagtgcctttatgaatgtgctgaaatgtgcgggtactcgtgtattctaatcgaatttcccattgttataacccaactgtttgccttttttattcctaggagagaaggttgcacatgtacatagcttattgtcaaaataaaccaaagtctgagcacattgtctcagaatacattgataccttttttgaggtaagacctaagatacaaacagaaagtatttctgaatcttttgttccaacttatttctaaaaatgaaagtatcattggtttcccaggagactaatttccaaagaaaattagcctgagtgataagacttctgaacctttctttctttcctgtaaatcagagaaatgagtatgaatttagtctgtggtcatacccctggcattcagaagactgcagtcattgttaaaaataagagtttttaataagtgttacacttaagtctcattacaaagtcagaataattattatctaaacttgtagcctaaaaataatatatatatttatatgaataaaataatgcaattgaaaaaatgcctttaaacaagcataaaagactgctttgaaaaacaactcaggtgaaagtgtaaaacttggaaattctgtgaactagcaaagctctagttagtctagtgctttttttcctcgttacttttactgccaatgttgtagtctttctgacaattacaaagactaaaaaattgccctttaatgaacagcccatacgatcttttctctctcttaaaactgtaggacttaaagcagcgtcttggccacaggttacagctcacagatctgttgatcaaaccagtgcagagaatcatgaagtatcagctgttactgaaggtgaggaggtggcgggacaaactctggtgtcaggagtgagtttgctgagaaaataagactcagttggggaaagaaggatttggtaggacaggggaatcatctgtgtaacaggtatattatttctgataagttaaaccttaaaaatttaaatcagctgttaactgaaggtgaggtggcgggacagactctggtgtcaggagtgagtttgctgaaaaaataagactcagtgggggaaagaaggatttggtaggacgggaatcatctgtgtaacaagtatattatttctgataagttaatccttaaaaatttaagaaaacacttcaaacaattttctcaattttttatttacatcgagttcagaatgaaaatatcagtaaaagtgaattttttttcccccaccacagaccttggaatgctaatgatttttcttctgctctatcaactttaattattttctaatcttcttggaaccttggataaaagtaaatttggaatccttttgtattcctctctgttggcttaacactagcccttgattgagttaaattcttaagcataaccgaaggcagagtcacgtgtttttctgtgataaaagagacttcaagtgtattgatattccttcgtgtacaacgcctaggacctggatctagagagggacaaagagcttgtcttggattaaacaggaacaattggatagatctggtctgactctgtgtactgcagcttgaaatctacgtaggaatgcctttttgttgtgttactgagagaataatatgataaagtagaactaaggcaccagacaggtgtggtggtacacacctgtagacccggctacttgggaggctgaggcaggaggatagcttgaggccaggagttggaggctgcagtgagcttatgattgctcctttgaatagccactacactccagcctggacaacatagtgagagcttgtctatttaaaaaaaaaaattctttcagaactaaagtgctgaaccccaatgtctggccagtgtgagtggccaaaaaggttagcttgtgtgcattgtctcattcctgtagtcccagctactcaggaggccaaagcaagaggatcacttgaggccaggagttcaagaccagcttgagtaacatagtgagaccctgtctcttaaaaaaaaaaataaaaggtcagctgctgttgtctttgtcaccattatcatgtcctctccatttcccttgcaggacttcctcaagtattccaaaaaggccagcctggatacatcagaattagaggtacatgcatcagcggctgtgggcacccaaatccccaccagcctcttttcctaatccccaagtgtctcctaacagtggtctggccctgggagggggtcaaagcagtggatgacagagtctctccagtgcatctccataagccctgcacactagagggtggggaggaagaacagaacttcatcaggtcagagggtgagcacgtcagattttccctagaggaacttgagctttcactcttctctctcccctcccacagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtaacgtgtgtctctgtgtgatttctctgtgccagcgcatgtacccgtcacaccgatacactgtttccttttaatgatgacataccctgatgcttcgtttaagtatttgagaattttctagtatatttcagagccttgaattcaccccatttctctttttactgtctgtgttcttgagtggctgatgtcttgtacacacctctgtgtaaccacagccattcattcttaccatgatgagaactggtcatgggtagtgtttatgcacccccttctctaggaccgaggaaaactggtttaaatttgatagcacggatttgggggattgctctatgatcagagaaaaagttcactcggtgtcttcttctcttcctccactcaccaaggaggtactgagcactcagcaacaggcgtgagggctccaggaatggcccagctggatgccctccctgccctgatgtagcttatcctctaataggaaaggaagacagagggacaaagaaaataattgccaatggccctcaagtctgtaaaagggacaaaccaagggtgaggtagagaagagcagagggcaggcctgaggtcccagcagatgactcctgggagatacatgcccccgccagggtcctcctggctctgcagctgtgcagaccctgaggtcagaagggagatgtacttccctttggtagggcctcctgccctacgccatcagggacagggaactctcagaccgtgcacacctgcgggcctcacagcacacaggcagaacattgcgtcctcccccatccgactctccgttcaggcttttgttggctgtccccagcagcctccatttgcctaaacctggggtgggtctgtccgtgggcacaggtgccaggctgggggcctctgcccaccagcacctaggagggctctggagccaaacagctggagaaggaggccgcctctgcatgaggctgggctgcgggccctcgcacctcccaccacccgcctgcccctccagactccgccttttgaggcccctcaccctgaggccatgtcaggcacagaccctctgggctcaccactacacttgagcctcccatcccctgaactgtgcgcccatcccctggacggcagccatcatctgaactgtgcacccatgccctgaactgtgcacccatacgctgaactgcacccatacgctgagccgcacccatcccttggactgcagccatcatctgaactacacccatcccctgcactgcacccatcccctgagaaccacccatcccctgcactgcacctatcccctgagaactgcactcatccatcccgggcactgcactcatccatcccctgcactgcacccatcccctgagaactgcctacccattcttctcacaagtcttttggcagaaaatcactccagcactgtaggaatttcgtatatattttttacatatttttataaaattatttgacatattttaatcatgatatcacatacaattttataacataggttttagtgatatttgagatttgtttaatggtgtcatttactccctgggaagtaagtaaggataaatactgaggcatcatagaggggtttgggaaacaggtaatcccagacgcatatttctagttaattgttcaggctgttagttcaaactattagtttaacagccttgtattccccatgtacctgagttaagaggcattaaaaagcttcagatgttttctgaggcagtaaaaatggcagttcaactgaaaagtgcttgtttcaggattgagttaggatgaacttcactttgcacttggccagtggggatcaatgtgctttaattttttgttgtggtaaaatacacataacataaatgttccatctttaattacctagctccatgggattaagaacattcatgttttgcagccatcaccatcatctgtcttcacaactcttcatcttgcagagctaaagccctgtacccattaaacagtaactccccacttccccacccccaagcccctggcaacctccactctacttcctatccccacatttgactactctaaggacttcctgtaagtggaatcataacaatagttgtattttgagactggcatatttcacttaacataacgtcttcaaggttcatccatgtcgtattgtgtgtcggaatttctttcctcattaaggctgaaaaactgtccacatagcccacattttctttgtccattcatcggtcagtggacacatggtttgcttcctttccacctgttagctattatgaataatgtttttttttttttaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatggtaatgtgtgttctgttactagatgtgtgctttctttcctcgtgtactcacttgtatttatcttccctctcccattcatatccatagtaatgacagaacttagcactcaccactcttcaggcactgcctagatattgctttatttcatcttcacaaccaccctgtgtggccagtactattattattcctgctttacagatgagaaagctggggcactgagcggctgagtaatttgcttcgagtcccacaagttgttgagggcagagtcaggacacagagtggccatctggctcttggtctgtgcccctcgcagctacactgtcccacacataacatgtacgagggcccagtcctaggaagaggagtttgcgagaacacgagatggcattggccagagacattcacgagggccttgcacacccacacctcctttccccattaaaaaaataagagatggggccaagcatggtggctcaagcctataatcccagcactttgggaggccaagttgggcagatcacctgaggtcaggagtttgagaccagcctgaccaacatggagaaaccctgtctctactaaaaatacaaaaaaattagccgggcgtggtggcgcatgcctgtaatcccagctactcaggaggctgaggcaggagaatcacttgaacccaggaggcggagatcgtggtgagctgagatcgcaccattgcactacagcctgggcaacaagagtgaaactctgtctcaaaaaaaaaaaaagagacggttcagtacttccctgcttccgtgacttgagggattgcagagatgctgcagaacacagcgggcgtggccacactacccttccattgcctcttaatgtatttgatctctttgcaaatgttggcttcaacactggcttttaatttggtgatcagcaaagaactttgagaattcagtccgaagctatgtgcccatgtcatctgtgtcttctgggttctttgcttcatgttcgtattcacggtctgcatctatgcctgctcaagctcaataggatgttgtaatgttctctgtcacaagaaagccacctctacaccttgcgtgatgttcaagagccaggaacataggcactcagtgaaaaatctcaagcctcatggcatttttagccaagtgttatgtgctgcctgggtgttaactccaagtttccatcctgcttgcaagctgataatcatttacatctgcagctaggggtgggcgcttgaggatagggaggcacagttcctcaggtgcgaagaggttcaatgtggtgttcttatgtggtgcattgagttccaatccatagcttggaattgagaatgctctaaattttcatcattgtctttaaaatagaatgaactgcccccagattgcacgcatggtctgtgatgtcagagtttacttgacacccactcagttgagtaactagtaatacctatcccagaggattaaaggagatcgctcatgggctgggagcttgggaccctttcacctgcttcttgcacaccccttagtcctggaagaggctgtggccagcacagagtttgtagactgcctctggctcctcaacgcttgctcacacatgcctggggctggggctggggggctgcatctgcttgtcgtatttttcaaaggctttaacacttcaagagtttgtgcatgtttccatacatgttattttggcctgatttctgtgtttttctacaatgaagatgtaagaaaactcaggcacccaagtcaagagatgggacagcctcccgctccaggggcctctagtagctccttagcttccctcagggctgtgttcagcctgcagagcagaggtggtctatgaaaccgcctccacggcagccccagggtttctttttcaccccaggactctggtttaggaaagacctttgcggaagccagttggtagctggaggagttctagtcaaatctgttgccttggtcttcctgtggacactggcccttagtccgggatgtgctgaggaatgcggccccttccacccgctgcactcagccggcatcccaataccttggcaagcaggggcctcttctagctctcctgatgggtggggttgctctgcgcccctgcacggggtctgccccatgacccatcccagggtgggccctgttcctccctcaccccgcggcgtgctccttggcgccctgacccagtctctcccgctgtcttgtcttacagccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacggggtaagcgcgtcggggggcccgcgccctcccgcccccctgcctctgtcccgccagctctaaacgccaccgcggctgttctcactaactcggctgcccagcgctctccgccgcccgttgcggcctctacctgggaccaggctaaccctcctgcgggccggcccacggcgctactaactactccttgctttgttcgtgtcttctaataagagcaagccgatcattaaccttctcaacgcagcgtcttttggtttcttccatttccaaccagcagaatatcttcttggaactttcttttttaacctctgccttcctcacgcacctattttttggagggttccttttccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtggtgggttttccctctgtttcctgcttcctcactgtcctacccacctgtttcctacagggcagatggcctggcccgtaacactttcctgaaggcatgcgtgagtgaatagaactgttctaatgagtgtatgtttgaacgctttataaatttttaaatacatttctctaaaagggtctgtgtctctctttatattaaaaaaaaaatctagcttttgcatgtctttctctttcctctggacttattaatgccttaattggtttgacttggtcttatcctttcctactattttttgttatgtattttgttaaactttaattggggaagaaattaacaaatgggtcttgatacatttatttacagttgaagtggccgggtaggcatccgctgtcatggccaccgtactgtgtcctccagagcaaggtggcctttcagttaggttggacgtgctaggtaggcaggtatgctaggcgggtgagcatagatttgagtccagtgtggggtggtggggagatgcagtcaacccagtgacgggctatacccgtcagcacttagttggatactcagtatccaggtgtggccttatagctgtgaccctcgctgaatctgccagttagcatctagagctcatcatagcctggacacattcccattcagtacgagaggagatttcagagtctgtgtttcaaaattaacacttcaactgctccaagacaggagccaatgccagtcttctctggacattcatgagaagacatgaaaaatggccacaccctggctccatcctgaatgctgtctctgaggccaaggcgcaatctgcaagtggcacgtgttcccgcgagctttaggttgggaaagttgcttttgctttctctctttctcttcctacttgttctcatgtggcagggaacctggaaagggaacttgctgaacaggatttcagacaagtcaagatgccttacagaaatgccctaaaggcctaggaagactccagagctccaaaatggggctttaaaaatgccctctaggctgggcatgatgtctcacacctgtaatcccagcgctttgggaggccgagacgggcagatcacaaggtcaggagttcgaggccagcatggtgaaaccccatctctactaaaaataaaattagctgagcatttaaaattaggtgagctggcacgcacctatagtcccagctacttgggaggctgaggcaggagaatcgcttgaacccaggaggcagtggttgcagtgagccgagatcgtgccattgcactccagcctggatgacagagggagactccgtctcaaaaagcccccacgtatttgcacttctgtccccctggagatctgcaaaggcctccttcctccttgatcacttctgtcaagctgtctgtggtcacagtcaagcagctgtgcccagcccacagcccggctccctcttccccctttagatgagcagcttctgcaaagctctgctgacagcaggagtgacatggatgtggatcaacccaaaccatggctgcaccagtccttcctgcagctcagtggtctggccttttggcctgctttattgagcagcaataaaagtgcatgcacactggagtcactccagccctgcctttcttgcacaggccaggtggccagtgccagctcactgaccttccactctgagagactgataaccacgcccactggtgggttggtggtgagaattaagcaggatagacttgaaatgcctagtacataggagatgcccagaaaatactaatagttaggattgtagtagcaaaatactctaattatgagattgtagcctggtatattaccaaaagcagctgtgctgcagaagttgttttttgtttacatattcttggaaatttagctttgtaatctcagtactcttgggcattgccatataagtcagaatactaaagtccatgctaaaagtataatgcataaatgagtatgcacaagccaaagccttccctgtacagcacgcttttttgctgaagagccacaggcaaacagtgggcacccacagggacaagaacaggaagcagactcctccacggcagagacaaagaacaggagctgggcagcaccgccatgtttttaagtatgcaccacaggtctagattcatagccctggcacctggaattcccagtggctggcttgttggctttctcaggcttgacctcatggaggagggccagaggtctcttccctctggtccttttggccagctacagcagtccgccacctgctccagcgtgtactgatactggctcagtagaccagggctgagaggcggtagagcagggttatctgacaaattgcatctgcactgacccaggatctgcccagggcgtcggagagcccagcagaagctagcacctttggagccttgggaacccatgaacatcccgacagtaccctcagtggaagcctttgagcacaagttcacgggaacgaggcaccagatgccgtttctcacatcctaacttgatagaggggacttgggcaagatgcagcttcaggcgttggcaggggatctgcatttcttctccacccagaaccataggccacgcgctagatgagagtgggacaaacactgccgtttgtgtttcttctcaggagctaacaccactctgtgtgtggcctgggtagggccttaagaaatctctgtcttgctgttgcaatcctgcctcactgaccgagtcactcaccatatgttgagttcctgctgcatgtcagccctgtgactgaagagatcgggtcccacaggggcagcggtataagggtgggggtacgcatcccacaccagaatccgttcccaaagcttgagtcacagcacctggggcgagtggcactgggatgctttgtgatatgttcccatggcagcagagccttggggacacttgagtcatgcaagttcataagagggacacctagcaagttcgtattgctggagacagagtcgctctccgtatgagcagaatagtgatcgatttacgttcaggggttccatgttcttctttttgaagagacgaagtagaaatgattaggcatgtcagcaacttagcatgattctagagtatgcattcccaatgaacattctatctggaagatttagggacttctctgttatctaatctgtcagtgaaatgaagattaattttgcatcaattaattctaatacctttttttaactgataatgagattcacagtgatgtggctatgtttgcttaggagtaacctaacgtggcgtcagcaggaggactaagatgttcccgtgagggtgcaaggaagaccacagtggaacgagcttccaaaaccaaagagtcattattgcagtgaattttttaagagcgtccctaaattgctttctagagaaattacattttcagttattgaaatagatgcacacagttagccagagggtaaaggaaatgttgaaaatttctcggtgcttgcctggtgagccctgcacggggtcatggtgccatggggcacactgacaagggatttcatgtgatcaggtctcgtttcagttcctccctgcctttctctgtcttcatctgtccctctgcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagtgagtgcttgacagtaacggcgtcctggcaggcagcagagggagggggcacagcacccgtgaggcacacgacctcagacggggtaagcatgtggaagggagatctgcgctggtatgttagaacaggctcagctctgagcacgtgggaagatgggtggccttccatctcacacactcagactcacagggtctttgaataatctgcatttagaaatagtctgttctagcacattgttgaggaatcccatttgacatttttgtgttagtcataactcaagaaagtgttgtttgtttgtttgtttgtttgtttaagaaacctaaggggaaaatatcccctatctttgtttctttgacatacattcttaggccgcatattagtcagggtccttcagaggagcaggaccagtagggagcgtgcggagatgttggcatagacacaggcacacctcaggttgttttgtgctttgctttaatgtgctttgaagacattgccttttttacacgagttttgtggcaaccctatgtcaagcaagtctctcggtgccatttgtccaacaacgtatgctcacactctgtatttgtgtcacattttggtgattctcaaatatttcatgcattttgttattgtatttgttacggtgatatgtagttagtgatgtctgatgttaccattataattgttttgaggaacaatgaactgcacacatacaagatgccaaacataataaacgtgtgttctaactgctccaccaactgtccattcccccatgtgtctccctctcctcaggcctgcctgagacacaacaatatcgaaattagaccagttaataactctacagtggcccctaaatgttcaagtggaagagtcacatgtctctcactttaaatcaaaagccagaagcttagtgaggaaggcatgccaaaagtggatataggccgaaagctaagcgcctctcgcaccgaacagttagctaaattgtaaatgcaaaggaaataaaagtgctaccccactaaacacacaaatagtaagaaggcaaaacagcctttgctgagacagagaaagtttgagtggtctggatagaagatcaaaccagccacaaccttgccttaagccaaagcccaacccagaacaaggctccatctctctccagttctataaaggctgagagagatgaggaagctgcagaagaaaagttgcaaactagcaaactagttgattcatgaagtttaaggaaagctaatcctgtaaaataaaagggttaggggctaatgcagctggtggctttaagttgaacccagtcgcatttatttacccttctgaaaatcctggggtccttaagaaccatgctaattatcatcacaccttatataccaaaaggttaattcagttaagaaacatgaagccggttttgctgcactgagtattattttactgaatttgatggcagtttttacaactcttcatccccctggaatgcctgctgtggtagaggcatctactctgcctgtgctctagaaatggaacaacaaagcctggctgacagcacatctgtacaccatgtatttacaacacggtttactgagtattttaaggccagtgtcaacacgtactgctcagaaaacaaaaattctttcaaaatattactgttctttgaaaatgcacctggtcacccaagagctccgatggagatgtgcaaggagattcgtgttgttttcttgcctgctaagacaatatccatgctacagcccacggatcaaggagtaatttggactttcaagtcttatttaagaaatacattttgggctgggcatggtggctgacacccatcatcccagcactttgggaagccaaggcgggtggatcacctgaggtcaggagttcgagaccagcctgacaagtatggtgaaacccaggctctattaaaaatacaaaaattcgctgggcatggtggcatgtgtctgtggtcccagctacttgggaggctgagacaggagaattgcttgaaccctggaggcggaggttgcatagagcctagatcatgccactgcactccagcctgggcagcagagcgagactctgtctcaaaaaaaggaaaagaaatacataaatacattttgtaatgccatagctaccataggcagtgatgcctccagtggatctgggcaaagtaaattgaaaaccttgtggagaggattcaccattccagatgtcatgaagaacactcatgaatcatgggagaaggtcagaatgttaacattaattaacagtggtttggaagaagttgatttcaaccctcatggatgactttgaaggttttaagacttcagtgaaggaaataactcagatgtggcagaaacagcaagaaaaataggatcagaaatggagcctgaaaatgtggctgaagagctgcaatctcctcatcaaacttgaacagatgtggagctgcttcttaggggtgcgcagagaaagtggtctcttgagatggaatctactcctggtgaaaaggctatgaacactgttgaaatattggcaaagaatttagaatattacataaacttagttgacagtgcaacagcagggtttgaaaggattgattccaatttccaaagaagttctactctgggtataatgctatcagtgtcacatgctgcagggaagtcttttgtaacaaggggagtggtggcaaatttcttgttgtcttactttaagaaattgccccagccaggccaggcgtagtggctcatgcctgtaatcccagaacgtttggaggctgaggcgggtggatcataaggtcagagttcacaaccagcctggccaacatagtgaaaccccgtctctactagaaaaaaaaaaaaaaaaaaaaaaaaaaaaggccaggcgtggtggctcacgcctgtaatcccagcagtttgggaggccaagacgggtggatcacgaggtcaagagatcgagaccatcctggctaacagtgaaaccccatctctactaaaaatacaaaaaaaaatagctgagcgtagtggcaggcgcctgtagtcccagttacttgggaggctgaggcaggagaatagcttgaacccacaaggtggagcttgcagtgagccgagttcgcgccactgcactccagcctgggtgactgagcaagactccgtctcagagaaagaaattgccacacccactccagccttcagcaactaccaccttgatcagtcagcagccatcagcatcaagacaagaccctccactagcaaaaacagtacaattcactgatggtgcggatgatagcattttttttagcaaataaactgtttttaattaaggtatgtacattttttagacataatactattgcacacataatagactctagtatagtataaacttaacttttatatgcactaagaaaccaaaacttgatgtggctcactttgttgtggtagtctggaaccaagtccccaggacctctaaaaggtatgcctgtctagaagtggatttatgatgagaaattgcctcacatagttagggagactggcaagtccaaatctgcatgtggaccagcaggcttcagaccccggagagcacgtggtgcaggctgagcctgaagacagtctgctagagaacgccctcttgcttgggagaccagactttttgtgttcccttaaggccttcggctcattggatgagggccattcaccttagaaagggcacatgcctttactggacccatcaaaatgttcatcttattcagaaacaccctcacaggaatacccagaataatgtttgaacaaatatctaggcgtcctgtgacccagtcaagttacacataaaatcagttatcacaggcacctttatattttcatcctcaaactttaagagattgttggttttatctcctggttcttaaaaaaaaggaacattttctctaacagaggtcacagttcgtagaggatttcccatccccctgcacacacatacgttgaatattcagcttttctttaacgcttccaggcagcacttggtgaatgttggaaaggcataatacccacagtgtgttcatttcccctaggaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaaggtgtgttcgggggtcttcaggagtccgtgtcatcccagcatgagagaaaggatcagggagggcagagactctgcagacctgaagctgggcttgcttatgacctccctcccacccaccagccccgtgccctgcgtgtcctgtagggtcttgttaggggcactatgctggccagcacagggatgggtgcgtcctacaaggaaccaggtagacccctgcacacttccgcaggtgcacatgtggcttctaaagaatatggttaggtttgcaaatgaagcacagagactaggttctcagaagcagcgaaggtgcagagaagctatggctcaggcttccttcagtgttcctgccttaaagccaaggggaagtggctagatgtgggggtgcatatgggctctctggctgtgacagatccccttggggacaacttcagtcagctttagtcctataatcggattgcctgacacctgcggtgggggttgcctggagaaaaagaaggtatctcctgaaagggactctgagcgccaggggccagggcgttggcggctctgcattaggaacgcatctgaggaccagctggactcagcctgtagcatgagaaaaacacacatctaagcagtgtttttgtgtttgtgggtaggaagaaaaagacccacccaaattagtgtgacatgaaacttttgagtgcagtgaaaatgtggtctgttttgattgatgcccaggcaagtcagtttctgcaaatctttcaacaataattgtagccctggaatgaaaggaatacaccttaaagtagctcatttcagttaatgcttgtttgctgtttccatttcagcttctcaatcccaactacatttatgacggtgagttctgttctttttcttctagtcctagagatgattctagacctgtggggcatgtttcagagcacttgagtgtggcctctggaaatgagttttccgtggcgctctaggcgtgcatagcaggttaggtcctatcaatctgtcggggacatgtgggtgggtgtggaggaggagccagggctgatgggcctttaccgactcctttcccatgcagttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacaggtgagggaggcccactcctggtgggtttcgctggctgggagcaccatcttgtcacttggcaactggaaattcctccttcacggatggatttctttggctgccttcggcactccacttcttccgtgagagcccatttcacgcctgggtgtacagctcctcatcagcacttgagctcctgccttcccttgatcctgaaggaggaggccagcgctgatggccacgtgctcagcttttctgatgcgcagtgtgttcccatctgtgccgcagtgacctgggagaggccacgctgaagattgtgggcgtgaccacggaagatgacggcatctacacgtgcatcgctgtcaatgacatgggttcagcctcatcgtcggccagcctgagggtcctaggtaagcaccgtgcaacgaggattctacgtgacccagtggggcacgtctttcaggagtctccttaagtcctgagtctgcccttacactccaagtggcctgaaagatagaacaataagtcatttgtggggcttcaaaagacagttgtaagtagcagaccagagtgtctgggatgtcacaggagagtgacctctcggcaccttatgtaaagtcgggggagacaccggagctcctgttgctgggaggaggatgggggcctgcctggtgaaggcctctggctgcccaccatggggcaccagggccccccacgaccagcttctgagttggagcagggtgctttccgtgctcctagtactcaaaacactcatatccagctacccagctgaatctggatctggtctaggttggtctcatgtagaatgtgcatgggaaaagcaggaaaggagatgtgggtgagtcccgggcctgcgcaggccctgtgcctgtctgagaccctaacagcaacccttctgggtgaatgcacgccctcctcaccccatccaggaggagccaggcccagggcggctcagtagcttgtccagagcatctggctaggaggcatctgccatggggcctgcttgctccagtgtgaagagcttgttctttctcctcagctaaaccacaagctccctggggcagaaccaatatcttaggctctttcaaaacgtcctgtagttgcctgatgtagatagctgctgagaaaggtgtggactgttctctgctgccatcttgcagaaggccggccatgcagtactgggctgcaccacaaatggaggtgcctccagaggacaaataaaactccaaatgaaagataaattgagtcctggagcaccccgtctgtagacaataagcagaatttgtcttagaacttttgtcccagatatcttaatttcctgtttttaacaacattaaatcagaagacatgttctgattttttggatcatggaacaagaaatctaaaactctagaatttggcagtaaacaataaaaggtaaagattttctaatttgtaaataacacagaaattacacaggtgattttttttttttaatcactggcaaaagctaaaggactttagaaaggtatactattcagctgggcgtagtggctcacacctgtaatcccagcgctttgggaggccgaggtgggtggatcaccaggtcaggagatcgagaccatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtctcaaaaaaaaaaaaaaaaaaagactattcataccctggaaatgcaaatgggaaaataatccaagtgtgtagttacttctatcacacaaattcagctgcacccctaaaggtcttcagaagaattatcttatgtggactattccaagatgatcttaaccatttccaaattgttctctgagagaagccactttgtttgcaggcatcagtaattttgtgttttgttttaaatctacccttggctccactcctgtctgcctgaggctattcctgcacccacaagctgtctggggtgtgcgccctcattctctccagccctggctgccttgcagagccccagttctcagatgctcaggaaacaaagccttattctcagtccagctctggctcaaggcaggtagctggtcagagtctgggctatgagaggggagtcctgaggctggaggcattggccctgcaccctgaggacaggtgcaggcccccaaactgtgtccgagagaatcatccaaagagagccctgtcatcccaccagccagggccgaggcttctgttgatgagaaaagggggccaggtgcagtggctcatgcctgtaatcccagcactttgggaggccgaggcaggtagccatggcttgagcccaggagttagagaccagcaacatggcaaaacaccatctctacaaaaatacaaaaaattagctgggtgtggtggtgtgcgcgtgtggtcccaactactctggaggctgaggtggggggatcacttgccacctgggatgttgaaattgcagtgagtcgagattgcaccactgcgctccatcctgggtgacagagcaagactctgcctcaaaaaaaaaaaaaaaaaaaaaaaaacacacagggaaaaagaaaggtgtgttttagaggagccagggagcacctgcccactatgatgctctgtctctgggtctggttggtggtcacagagtcgccatttatgtttggtccacttttctgtatatatgtaatgctcgaataaaaatgtttatttaaaaaaaagaaaaaaaaaacaccaagccctttcagttaaaaaaagaagaaaaaatatttttatgtaaataatagtccaatatttcttaatgtgagttggtagatgcttcaaatctgcctagtgaaataattttatttttattaatgcttctctctcagtactccttcacctgcaaggtcagaattaaccttaccatttataaagcactttaaaggggtgcaaatgtgccagcattaacaaaaaaagactgcagaacaaaacgtagcctttggtttaagtgattgacgtgaaattattgcttctcgtgtgtccttcagtgaagatttgaggctttgtgtgtgccaggcattcttctggtttctgggaggctgcagaggtggatcagacacgggttcacttgtagtcatgtagcggtcagcagtactcctgtgacaacagtgctagctggcagcacatggcatccaccaggactgcccactgctatgtgaggagatgatttccagccatgagtgagtcagggaaggcacatggaggaggtggccaccaccccagggagcccaattagacaagtcagcttggattggacatggtttaaggaaacgcattcccagtgacaacctggggagaggtgaggaagcccacgtgaagatagggatgggcagatgctcggcctgggctggactgcaggtcaggtgagcgggccgaaagaggggagaggaaactaagtggggagaggaggctggatgagtggggtcgggagggccaggctcccgtggaggcctagaatcacagtggcagctgtgcttcccaggggctgcctggcagcaggaccacgtggggctcccccacttagtgcttcttttcacaggaagactcttgaaaggatgctttctgttcctgtggacatgtacacagggttcattactcacaggtgatttacagttggcacttttataataaaatcctctttgtagtgtatttatgattcattaaccatgtaaaaccctgtggacgttaagtaaatactgtggactcttgatctctcacggctgtgaaaggaggcgtggggaggagagagcaacttagcctcgaggtggtgcggccaggtgaacggggaggaccatctgtagcagtgctgtccaatagaagcaaaaagaggccacatatgcaagtttagatttttctagtaaacacattttaaaaataaaagtaaaagcagtttttactaacatgtatttaatttaatgaaatacatccaaagtattagatttcaacatgaaatcaatatttgaaaaatcattagtgaactattttgcattcttccttcacactaagccccagtgtctgtgtgtcctttatgcagccaccacatctccactcgcatgagccgtgtggcaggtgcccggtggccacgcgcagctgctgtgagggacagtgcgtggcgatagccttcttacccaagaagctccacgggaaacaagctcaggcaggtgctgttcttcttgcaggtccagggatggatgggatcatggtgacctggaaagacaactttgactccttctacagtgaagtggctgagcttggcaggtatgatgcacaacccagaacgccttccgaaagagcagagcgtggggaagacataccagagagtgcagggataaagctaagcagtgttatcttgccagcaattggaagctgtgtgtcttgcatttgaatcgtaactctcattgcctttagacgctaaacactggggaagtaaggaagccattttccactcgggttccagcagagagggccgaatgccaccagtcacccctcaatggggagaaattgcttccctctgtgaatgtggaatagtggtagctctgtgccgtccttgggagagttcaggagtctttcaaacgcttcttgtagttcttaatcctcttgtgcccttcacgtttcatttgtgcatggagacttcaaggagtgacagtaaaattagatgcacaaactaagagagaggtttccccatcaaaggggttctttctcttcatgaggggcagccgagtcaggggtggcccagcagtgccatcagacagcccggcttctcttggctctgcctccagggccacacagcacacacattcaggtgttgtgtcccatgtggcaggaagagcaaggtcagaggagcatgacagctgtcctttgtcccttggtaagaactcccccagaaactccagccagcagcaccctctggcattcattcctgaggtcataactagtcacatggctcctgttgctgtctctgtcagctgtctgtggctgcataaaaagtcacaccagcacatgctgtcttaggacagtggtgacatgtgccttcttccagtgcagtgggcagatgggaccattattctgttggcctctcctggcctggtcagctggtgcaccatgccccatgcgtgtcagaggcgttgtctgggacactggcctctttccacatcgactttcaccctgggctcccccacgtgagggcagtggcatcccagaacagcaggagcaggagcgtcaaggcctctgaaggcccagcctcagaacgaccaacgtcctccacatcctgtgggccagagccagccccaggcagccctgattcaaggggacgaatagcccccgcctccgagtgacagaagtagcaaaaccgtggcctttaaccacacagtctgcccgccacaggcgcatctctggtcctcacatgtgcagaatgcactcacccacctcaggcccccagcccaggcccccacctgaggtccaaggcctcgtccagatcgcgttgagttgtggccagtccccaggagtgggtcatcaggggcagctccagggtcctcgtgcctgccccacacacccccacaggggcgaggctgaggcagtgaccacagcagacgcacctttcaaacgtgcagggaaaggtggctgacgggaggcgtgagcagccatcccagcttctgctcgtcgtgggaagcagaagggagtcgcccggcaaggccaaggctcagaggtcttcctctgtcacttccaccacacgcagtgctgggaaagcagccaccgacgtgaggagaccaaggctgcctgggaggaaggaccagcagaaccgcgtggctgcggggacaagggcagatttgggggacagccatggcaccacagcccctccgtggagtggccgggagagcagggcctctggacagggctgggccaccacacagccagtccatttaggataacagagtctttctcggtgccagacctcagcagcctctgcaaatggtccccctgacatattttacaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatgtgcgtacacacctggccttccctctgcccagccctctgcctccacctcagggggttttgttgttcctgtttgttctctaagaaggatagaaattgggtttgtagaatttacagaactaaaaaacatcttcactgtcagagcccgcagttttcaagccttccagtaatggcagaaagcagtgtggtcttccacagggcggttgcctgatgaagggcagtcactgctgggatggaacacctgatatgctcagccaacccggagatgcaccccccccaccccttttctgaaggtcccatgaggccaggctgtctctggtgctgaacccaagcccccattagtggttggaggctgacctgataccccaagcctgtgcagggccagctcaccccggatcagcggggtgcccctcaggcctcctgccaagtgaaggccagttggatgggagggtaagacgcacctccccgcagaatgtcctccgaagagggggcgcgggcacaccaaccagagctgcccctctggtccccgttgtacttactgggctcctgtgtaagatcagaaaataatttagtcacgtcaagaaaagagtttgaaacctgtgtcccacaggagcggttctcatctaggggtgggttctcgtggaaatgtcaggagagctcaggctgggggtgagtccggcagggagcggccggaggccagggatgccacccaacctcctgcaaggcagggacaacccccatggattcatccaccccaaacatctgtgcatttagctttgaaaaatgtcgattcctcctttttagggggagtcattttatacatttacttgcatttacagctgcttttccatggggaagggtaaaaccttttgtcaccatttgggaagtttgcatagcttcttcagtgggaaggataggattagcagggcgcccccatggggtcatgtaggggcagactcaagctcggggcccctcgccggcaggaactccctccaggccctgtacctgatgttgtagttattgtcatttttttcttaaagaaactataaatgcctccccatacccttcctagggcaaggctgccacagcgtcccacatggccccacatgcagccttaccagcttcctcgggccgcccatgtgccatgggtgacagtgggtgtctcaggaaggcctcccacccatggctgcacagctagaacctcccccagcacatggggacgtgcttccagcccgtctttcaagaatagaaaacacatctcatggcagaagggcagacggtggggcgcagtgaggctgagcagtgtgtatggagaggaggtccactggcctcgcctggcctcagtccccgccctccctctcatcggctcatttctcaccctggtgtccttaaaagtcacactggctttggagggttgtcgtggggccgagatggggcgatgtgtgtggaagagccgagccgacatccaagccgaggcctggcctgggagcctcaggacccgggaggtctcctttctggctccagacgctggtgaccaatggccactgctcaccttccctggggagttttaacaaaactgtggcttgagtgcttgtcacaaatctcctaaaggccttcgtttctggactgacatttcagtgctttcagctgtcatttctgggaaacaaaatggtttggcctcaccatcctgttaataggatccgttttcatgacagattactcctgttctcaccggcgactccccattgctagacaggcagctgatcttcctacagatttctgttttgcaaagagagcagcataggccggtgttgagagaggtgggggccagaccacctcagtccaatcctggcttctccactctggagctgtgggaccttgggaacgtttcatgctttctctgtcctgagtttcctcgtgtatcaaatgggtacactaaggcccacttcacagagagtcataaggattaaatgagttgttagaaggcattgagcccctggcacttggcagtgctgggtaagtgtttttttagtatgaacagtagtttcagaggaggaagtcttctgagtccaacactgagcactcagtgtgtcacctcctgcccagcctgtggttacatgatctcggtgagtcttcccgtggcccattctacaggtgaggaaactacagctccgagaagcatgagctacttgccttccttcagcagataccgcaggatgcctgctgcacctggcactgccggcagccgggccacgccatcccccgcaacaggcgggtttggacccttgactgtgccgctctaccaccggcttccctcttaagatggagacaccctgtaccccactcgcatcttcccaacagagctttacaaaatccccctccttgtctagtcacgccttagaggcacggccctgagatcccgatgacacattcataacaggtgacaggtccgacatgtttacttcttactagcccaaagaggtcttcaaagcaaatcgcatcataacagtcacccgctcctgcctctttagggctgaccagggtcgcctcctggactgcgtggtgcgatggggaagcctcactgaagggaagatcagggcgcacctgggggaggttctggaagctgtccggtacctgcacaactgcaggatagcacacctggacctaaaggttggtgaggccccgggcaggtgaaggggggtctgagcacaccggcttggccatgcgggacacagagccccctctgaagccaggccaggagcccccaagtgactagggacaaaaagggtgggtggggcagcgcagacactgattgctaatctctctctctctaagcgtttgcgttcagtgatgcacacggtcaggagcacactgggtaaaacgccggagccctcccagccttccacgactttcagaaagtccccatgagttttgcccggtgggtgtggcgggtgcagtggtagcttaggcgggaaagagagcattccccttggtgctgggagggaaaatgaacacccagcttcataaagcagcctggtttcattaggctacttggcacttagatctccaaagagagctgccctgtgtggatctgggtcccagctccgctgtgtcatctcttcctcctcaccctcggctgccagctgagtggtccggcctgctttgcacatgcatggcttgtcctagttgacatcctagattccttccacctcaccatagagtcccgcccatcatcacgagtaagcttaagattggatggtctgaaaatgacagttgtattctgatttccagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgatttttgtgttaggctttttatttaaattggtcactgttgaatcagaaagacagatggctgagggagagactgatgcagagacttctcgtgggcgggaggtggcagaatgtactggattgagaaccctctgtacacactcagaaatgggagttgctcagcctcctgcagactggttcacagacaccacactcgagaccctggtatgtgccagaatgtcgactgaccgtgcacagcgaggctgtagcttgtcctggttagaatagctaaggcaccctgttgcctgatgaacacagaattaagcgagggaagagctcgttcatgctggcctcagaaaagcaaaggtaatgtccagatagattcaagaaaatgaaacagtttcatttggttgagaataaaccaaagatcctgcacctgggagaagactcgccagtggtggccctgcctcggcctcggccctgggcccacccagtcca

SEQ ID NO: 15981 - DNA, 15371 bp, Human
  misc_feature (1)...(15371): n = A,T,C or G
cttcctccagcctccgcatggaaagttcccaagtgtccctagaagtctggaacactctaatgttgactggaaagaataagatggatctctttttctgatatggaagcgtcccaaatccagtcataccagctgggaggcagtgcccgctagcggtaaaaagcatggattttggatttggacagatccccctgaattgaaggcacaagggaaaccacttgtgcctctggccaagttaatttttctctccaagcgtcagtttctccacctgttaaaaagtaacggcaaacctacctcactggagcttaataaggattaagtgaaataatgcaggtcaaatatccgagccttgatatatataagcctcatgtgtatgtgttcccatttatgtaaaataacagtgtaagcatattcaaagaaagcaattcagaatgtactcttaaactaagcaatggttatcttggtgtggggagttggggaaaccaggggcctgcctttttctctattatataatgctgcaaagtttgatctttaaaaaaggacattaaaaagcccaattgtactttaaacaacacaagttttaatacttgggtaaataaatggcatctaaacaaagaaagaaactgaaggcagagccaggcccaaccctaggagactgaggaagcgattctgctttgcctgcccccagctcaacccctgcactaaaaccccccggccccagccccaaggtccagggggttgtattcctgggggcgacccggcgcccctcaagtctccctcctcttgcacacacacacacacaaaccagactcgaatccccgcctcccaagggaaagtgttttttaaggtctgttccagggcctgccggggccagggaccgaggtgggactgagtggccggaactcctccacctgggagagtcggtccgggtagctgcggccaagctgagtcagcccggcgggcggcgcacgcggcgccgcgtgacccgcagccacgtgacccgcgcggggccgggccgccggcgcagtcgctgcagccgccgcgggaggcgtccgtgtaagtgggtagcagggctggcggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaaggtgggccagtaggaagacccctccgctagtccagagagagcacacagctccccaggcagagctcattgccccacctgctctagtggcccagcatgatcccatgacctctctacttctggaggaagagtcttggggtagacggcggggagggggtagggtatcccgttccggtaggggcagggatgagggaggcggggctgagccgagcatctatctggatggtaacagccaacgtagaaaatactaagttgtttacatgcattctctcatttcatattacccgtcgtgaagtctgtgaagtaggtactattgtcccaatttttacataggaggaaacggctcagagagaacttaggtcctttgaccgaggtcctgcaggtggtaagtgaaggagctgagattagaacccagatctgcccccagtggcgcctcctcgtggtctgtgggtggtggagacgactggcctagcctcttagctcctctgtgaatagaaaggcctttttcctggctcagacagcttgggaaggggattgttgctgggtaagagaagcttctcccaccacctccatctctttctctgccccttaccattgattcctttctgtcatcccctctcccccactgcaggacaagatgaagctcatcatcctggagcactattctcaggcgagcgagtgggcggctaaatacatcaggaaccgtatcatccagtttaacccagggccagagaagtacttcaccctggggctccccactggtgcgttcttggatggagagggtgccgtggataagggtggagagagtaggcaacaggggccaggtacaccggctcactcagccaagggacttcacgggggctctggggtactggtgctgagagagcaccttcctgccccttccacatacaaaggacccagcttcccttatgggttggtttagtcgctgcctgtccctgcagaatcctggagcagaagggatcttggttggcaggaagaatttgatttttaggctacatcctaagtcagccctgtccaccagggtttcttaacagaattaagtcctgataccctaaggcattcattttatgtaatgaattaatttctcttctctgcatctagaggggtaccagctaagtaccatccttgggagaattgaaaagatagtcacttaggtaattttctgtaaggcttaattaaacacaggacctaaataaaaaacagttctaatttcttttggaaaaaatcaaaatgttgctttttcagaaagatattttgaccccagctcctcaagacaaatgtcctgattatttctttcagagatggatgggtttgccctagtggccctacctgacccatccattagcgtgtctatgtgtgtgtgtgtgttggaggggtcttcaaacttgttctttttcctttttttttttttttttggtcttccttgcagtccagactttttctgtaaatggccagtagtaaatatgttagacttcactagccatatagtctctgttgcaacaacttaacccttctgttgtttgaaagcagctataattagcctggcatggtggcgctcacctgtagtcccagcttcttgggaggctgaggtaggtggattgcttgagccagtagattgaggctgcagtgagccatgattgtgtcactgtactccagtctgggtgacagtgagaccctgtctcaaaaaaagaaaagacaatatataagtgaatgagtatggttgtatgccaataaaactgtatggacactgaagtttgaacttatataattttcacatgtcacaaaatattattcttctttaattaaaaaaaaaactatttaaaaatgtaaaaaccaggccaggcatggtggctcatatctgtaatttcagcactttgggaggctgaggtaggcagattgctggagcccaggagtttgagattagcctgggcaacatggcaaaaccccatctctacaaaaaatagaaaaattagctaggcatggtggcacatgcctgtagtcccagctactgaggaggctacggtgtgaggtgtgagtattgcttgggccaggaggtcgaggcagtgaaccatgattgtgcaattgcactccagcctaggtgacagagcaagattctgtctcaaaaaaaaaaaaaagaaagaaagaaagaaaagaaaaccattcttaactcataagctgtataaaaacaggccacagggccgggtgtggtggctcacgcctgtaatcccagcactttgggaggctgaggtgggtcgatcatttgaagtcaggaatttgagaccagcctggccaacatggtgaaaccctgcctctactaaaaatataaaaattagctgggcatggtggcgggcacctataatcccagctactcaggaggctgaggcaggagaatcaattgaacccagcagatagaggttacagtgagctgagattgtgccactgcactccagcttgggtgacagcgatactctgtctaaaaaaataaaaaataaaggccgcaggccaaatttggcctgtggaccaaagtttgctgagttctgcactagaggtttgtgggagtagtatccacctgtgcctgtgaaactaccaatgtctcaggccctcggaggctgtgctaacatcctgtctcctaactgtggagagacccaacctctgtatgggtcagagtctggccttctgaaaccattccctcgttcccatcattgcagagtcagatccaagctcttcagagtggcattcaaggccctccaaaacctggcctctccctgcctgtcctgcttgaaccaacaggacagcgtttccacacgggttccttggaacattgcttctgttagatgtagcacctgtcagggttctgagtggaaaccacagaaaccaactccagctaaattaagcagaaaaggagtttattggctagatactgggaagttcagagaattcatgggaaggctagaagtttggaaaatggcaggagagaggaagctatgtggctcaggcatagctaaggccttgtcacacggaccaactaattattttgggtgggctgcggggagctgccattcactcagcaggtatttattgagtaccctctgtatgcaaagctgttctagcctctaaggatacagcaatgaacaaaaaggatatgaacttctgccttctgaggcttaaattataatgggagagacataataattagcaaaatatagagtatgttagatggtgataagaggaaaggagaaacatgaagcaggaaaggatagggagtgtgtcggcaggggtggggctgtgcagtgttggatatggtggcagggagggtctcatagccaggggccaggttctgtggagccttagaataactggtgttgctgagggtgaaatgagaagctattggtgggttttgaaaagaggggtgacatgacgtaatctcgatgggttttttttctttcatttttttagtttgcaaaatttcaaatattcaaaaaagaggaaaaaaacaggtcaataccattcacctaaattcaccaattgttaccattttgccacatttgcttttacctttctctggctcttgttctttatctacacacacacacactttttttttctgaaccacatgaaaataagttccagacatcctgacacttatctctaaatccttcagcacatatctcctgagaataaggacattctcctacacaaccatgataccatcatacctaagaaaatgaaaaatcatgccatcatctaatatgcaaactgtgttcacaattttttctcaattgtccacatttatcttttataggttggtttttaaaaaattaattcagtgtccagtcagggttcatgcatctttagtcttttaatatacagtgtcctcctaccttttattgtgtgtgtgtttttatgacattgactttttttttttttcaagatagagtctggctctattggccaggctggagtgcagtggtgcaatctcggcccactgcaacctctgcctcccaggttcaagtgattcttgtgcctcagcctcccgagtagctgggattacaggcacatgccaccatgcccagctactttttgtatttttagtagagacagggtttcaccatgttttccaggctggtcttgaactcctgacctcaagtgatctgcccgccttggcctcccaaagtgttggggttacaggcgtgagccaccatgcctagccatgacattgactttttaatgagactcaactagggcttcgctgctcctcagggaagtcttccttgaaccctgaagcactgggtgagcctgtgctttaccctatcacaactgacgttcctgctttgtgttctactcctagtgagttatcttagagtagctactgtcccttgctcccctgtgtccttatcacatggccctgtgccttgcacatattacttgttcagggagtatcatgtcaataatgaagtctgatgttcactcaggtactaatcagagtgatttcagtcatcagtgtgctggatactgggagattcagcagtgatcaaggcagacacagtcctgccctcctggagcttacagtctagtggcaaaataggcattaaacaagcaattaatggatggatggcagttaggattggagtactgggtaggacttcagatctgacaggttctccctgtgagcagccctgacttattcctgtgaaccctctgggcttccagacttggggtgcaaggggtgttcatgggtgtggccactcttgcagggagtaccccacttggctgctacaagaagctgattgaatactataagaatggggacctgtcctttaaatatgtgaagaccttcaacatggatgagtacgtgggtgagtctttctctttcaaggttctttcctgattctaggagagtgatgctcctcctctcattggcccagtcctggagaggaatcggggagccagtgacatttgatgataggctcaattatcaatacttacctcttggtttactcagctataaaatggggctaataaagctgacctcacaggttgtaagcattaaattcatttaatgcttttatgataaaagatgtggaagtttcttatacataacaaatacttaataaatattagagtatctccttctcctctgcctgctcctcaactccattccatttctttctggaacaaatgattgcaagtgggatcctggctcgggtgtttcccctaggatctgtgtctgtgctttctcttctgtgtgtggcctccagctcccctttctgccaggtacacttgaaggggacctgagattggtatccttcctgctgctgaaagactataccttggtcttctatcacctctccctcacccagtccttttgtaatagcttcattttaaacatcctttttttaaaaaaaaaattgtggtaaaatacatgtaacatgacatttaccatcttaaccacctttctgtgtatagttcagtagtgttaagtgcattcacattgttgtgcaaccaatttccagaactcttttcatcttgtaagactcaggctctatacccgtgaaacaacaacttctcatttcccacttcatcagccacggaaaccaccattttactgtctgtttctatgaatttgactactctagaatcaaactagagtatataactggaatcataaagtatttgtctttttgactggcttcttacacctagcataaagtccacaaggttcatccattgttgtagtgtgtgtcaaaatttccttcctttttaaggctgattttacatattcttaatgcttaacattaaacattatttttttttcctggccaaaaaaaaaaaagttgatctggggaagccctaagatagttctctctaaccacctggtgttcaagctgggatttattcaggctgagtggggtagaactgggagtggatggtgggttgagaggcacagggtgaggggtgtgcttgcttgctttctaagatgagttcagccctaccccaggtggccagagtgtccccagcctctaacctatggtcattgccttatgaaaagcagatcagatcagaatgtggggatttcccaggcccttggtgtgcagttactctggccaagccctgtggccacagatggtggtactgggtgggtggacacttatggatactggctcagcctgtgccgagtggctaggggtcagagggctggtgcctaaggctcccagatgggcagacccctgggagtgtctctgtaggtcagcatggtgtcctggcatccttcttaggagaggggctttggcttggcctaggcataaccgagtgtctcacggccccacaggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggtgagcttgacactctgcagcacacatgtccagggccagacccgtgggaaggaggacaagacacaatgcctgtctgcagacagcttcttctgggtgtgctagtgaccgtagagacagaggcgggagaaatgggccctgcctggctctgttactcaggaactatgttatcttggagatctctttctgcagtttgatgccttgtctgtaaactgagaggtttgggtttggactctgagattctgtctactccccagtcttaaggttttatggatcagtcctggaacttatctaaacatttaacatcatggactcatgtagttccggaaggctccacacagcccctgtagatagccagttgaaccccagagaagttaggtgactcactcaaggttcacaggtgggagcaagtgtgtgcttcttggatttgtgctcgggtcctctgggctgcccttctgtgtgtccatctatcgccacctctggagttacccatgaggggtaacattgaactgccttttattgctctagagatcactcttctatacttcaaggtggggaggaggggggcaggacctctcatcctctgagattttagaaccttggcagcccctgtccaggttctctgggtgttttgttcactgcacctctatcccagcagcaggaccctctaactacaggcagaagagacagagaaggtccacttttctgacaatctggggaggcagaagctgtttggagtgtttcctcctcagctttttgagggtgatagcaagttaacaatgtctgtgtgtgcctcagatagacatgatggggagggtctcctctgagacagtatggcaaagagaaagaaatggtagggagggggacagatcacatgtttaaggtgtacctgcccagggctgcaaatgagaaaggtgacacagctttcaatgatttttcttcagaccctagttagggaaggagagattgtccattcttgaaatcttggatccctgggactgacagggctgcacgggctctctccctataggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtaagggcataagggccccaccagcttgcgctggtggacttgtctttctcttgttaatcttaactatactggtaccacctacattcttattaaagatgaaggcatggtaaataaggctaaaatccctgctgaccctgttactcactgttcctcttgcgtctttggaagacatcattattcccagtgtgaggtgaatcccttgagcacgtttttggtgcctttggctgactgcctgagacagcaggctctctggcctcaggcccctttcatgcttttcacaggcagagaggaggccagcatcgctaatgttggaatatttgtacctgaccaggtatggagagaggggttcccttgttccttgtagttggtagaggtcactgttgggacaccaaggatgcttgtgcttctagccccgtgctcagagattaataaatgtggtgaagtatgattaaaatataagtgttttaaactgaatttagcttttcccctaaaaaattggctatcatttgaatgtgaattttttgtggttccaatttccttattttcattagaactttagaagcattttctcttcctttctgacgtgtatagacatgttagatttacatttctttgcccaagccaataaacaagcatctaaatcagtgaaaacttccctgtttaaagtgaacttttgtgaaatgagtgatggcacccagatttctgttgggtaatcttcaatcagtacgtggggtgggggtgtttactcgctgtttttagctctgcagcttggaaacaggtttagggccgtctttatcatgagggcatcttgatctgggaaaggacctggggctggaaatcaggaaattatcttttctaaagagttctgggttgctgaggggtccggaagaaatagtcacattccctctctgcttctgcattctaatcttttaagaaaggaacagtaaatcctgttcacaactctgtggcacatgtgaattaaaatgaaaggaaatctacagaactgagtttttttctcttttcctgcccttgaatagagctgagttctttaagatcacttacattctcgatattttaactgttaagtggagactgtgcctttgttttattatatattaacaaaaaccatcaccccaagtcacattagttcataggtttaatgctgtgaactgaaagtgaccagataatggggcaacctttctgggattcagccttagaggccccacagataactcccaccattgcttgcaaagtgcccttgctggtggtgcaggttgggagccctctttcacaaactgtgcttgtgtagagtcacccagctgatgggatagcaggcctgggcatggcatgtctgtttacagggcaccttcatagtcatcatcaaagatacctggaggcactgtcacgtggtagtcaagaacatgaactttggggtcataaatgaccctgggcaagttatttaaccccccggggctctgttttcttataagatggagataatgatgctgcctgcctcgggttatttgtgtgataaagcacagggagcactgagcaaaagtatgttgcatggtaaccacttacaatgtgatatgaaaaacaatcatccttacaactgtttagggtgtctggaatgctcccctccatcacagacttgttttctgatccccaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtgagggaggtgtgggtccaggaggaggtggtcaagcttagggtgtgctaggagtaaggagtagatccggctttcatcctctggtcattttaattgacaactgtaatcttaagaaatatcaaacccaactgcatcacactacacagtcatttctcttctgcctgtgactgcaaagatccacttctggagatctgtttgctctgaggaggaggaaagaaaacgcaatgtggtccaaggactatgtggtgacctcacagtgccattaagcctcaggttttctcttttcaaatcttaaacaagcgattcctttcttttatttactttctttttttttgagacagggtctcactctgtcgctcaggctggagtgcagtggtgtgatctcagctcactgcaacctccacctcccgggcttaagtgattctccttgcctcagtctcccaagtagctgggattacaggtgcccgccactatacccagttaatttttgtatttttagtagaggtggggttttgccatgttgcctaggctggtctcaaactcctgacctcaggtgatccacccacctcggcctcccaaagtgctaggatcataggtgtgagccacgatgcccggcccttcttttactttaaaaggatgcacactgctttaggcaaacatgtgaaaatcctcttttactcaagtaggtcaattaggaatttgtcctttgctgaaaagactaacctttaaatagccaactcccatagtgattgaatttataaaagttccatgaatgtagtactcactgtgaataactctttttgtactcttagggtgtttatcatttggggatcatagagaaaagagagaagtgtcagctctaagacaaaatttgagagctcctggatgttatgattgataatcaaggaactcttgccactgcctgaattaactactttttgtttttaattttttgtaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtattttgtctttagcttttctatgtgattgtgccgtcattctgttttaagctcatggatcaatggatttgtttacaatgtgatattttctattaaatccagtattttcaaataacatgtcatttgtggatttgagcccccaattttagaagactctctgggctatttatatattttagaaagagctggtaagcaaagcctcacattcagtcctcacaagagcctgcaggaaggccacaagcatagcaaccatcatcagagtgaaaaataagattttatgaaaatggagcacttacaggaaaaagggtaggaatgaacagatgagcaataaattgtcatgttggggctgtacctgagatccaaacgaggatacagctgttataaagattaaggcagatttgtgatgagggatattattgcaaggtatgcaaaaatacatttaggttttttttttttttttaaagttaatataatggaatatcttaggtcaatatagccaattaaggaggtagatacagaagttaaaagaagggtttaatttttttaactattttgaggctgggtgcagtggctcatgcctataatcccagtgctttgggaggccaaagcaggaggatcacctgagatcagcagttcaaaaccagcctgggcaacataacaagaccctgtctctacgaaatttttaaaaattagccaagcagacacctataatcccagcgctttgggaggctgaggcgggcggatcatgaggtcaagagattgagatgatcctggccaacatggtgaaaccccttctctactaaaaacaaacaaacaaaaatagctgggcgtggtggtgcacacctgtagtcccagctactcaggaggctgaggctgaggcaggaaaatcgcttcaacctgggaggcagaggttgcagtgagccgagattgcaccactgcactccacccagacaacagagcaagactccgtctcaaaaaataaaataaaataaaaggaaaagaaaaaagaaatttcaggcagaggaggtcgcggcgccggaggccccagaagggtcgaaggcgccgcgggctggggtcggtggcttagggagcccgtctggccatggtggccgcggctggtggttggcgcggctgcgctgcggcccggggcagtgcggagccaggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctgggaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15982 - DNA, 25124 bp, Human
ctgcctcggcctcccaaagggctgggataacaggcatgagccaccacgcctggcctgaaacctctaatttttttaaaaaaaaaacaatgtttcagaggcccacatgataatagacttttaagatctacatgatgagcaaatacacaatgacaagagaccagcaagaagtcagggacacttctgtactggggtagggctcattaaggttcagttttatccaaaagttgggcagggttttcctctccacactgctgcccctctgtgttcaagggcttgttgcaggagtgcttgcgagtggtggccatggaaaaggaggcagtcccccctgggatggtgggatgagttcagcaaagtttctggacagctaccagatgccagtgatggatgggaacaaatgcaggcaccgtcaggtctgctaacccctatagtgacaagccatagtttgtgactcacttctactctccactccgtggcctgggtcccgacctctggtctaggtggtacactgtaacctctcctctccctaggctccgtcatcatccggtgtccctggggacagggggtgggagttgggtctctttctctgtctgtgttctcattctcacctatccttaagtcataaactcgaatcctaacttccccagggccttcccgtttagttcttaaggccagaactattttactctctgtgaatttgttacaaaaaacccttattctctgacaggctcctggagagagtcagactgatgaggaattggctctaaccctggctccaccactgcgtgatactggccaaaccttagtgcctccatcatctttagcaaactagcacaggaacagaaaaccaaataccacatattctcacttgtaagtggaagctaaatgatgagaacacatggtcacaaagtggggaacaacacacacgggggcctacctactacagggtagaggatgagaggatgagaggagggagaggatcaggaagaataaaaagtactagacttaatatttcgtcactgggtgacgaaataatctgtacaacaaacccccgtgacacgagtttacctacataacaaacctgcacatgtacccatgaacttaaaagttaaaaaaaaaaaaaaaaagtggcccaggcgccgtggctcacatctgtagtcgcggcactttgggaagccaaagcgggtggatcacttgagcccaggagttcaagaccagcctgggcaacatggtgaaaccccatctctactaaaaatacaaaaattagccagatgtggtggtgtgcacctggaatcccagctactcaggaggctgaggcacgagaatcgcttgaaccctctaccgggaggcagaggttgccgtgagctgagattgtgccactgcactctagcctgggtgacagagtgagactcggtctcaaaaacaaaacaaaaccccaaagtataatacacctgacttcaactttatgacattgctgtcttttattacatctttttatattaaaaataaataaaaatgtcataaatagtaattgtgtaaatataaaaggccttattaaaaaaacaaatcttagtgcctcagttttctcttctgtcaagtgggcacataaaattacctaagtcatagggtcctgggcatttaaatgagagaatgtacgtgaaatatttagcacagtggagggctaggcacacggggagactgcagtttaaaagactaaccaggcacatgagaccaaagacacaaaagtctgttattttcctagagtcaaaaacaaaacttattagaaggctgtctttacccaatcttgtcctcaaaattgactctaaatctttagttcactttaaacattcagtaaattattaacactgctttgaaattctctttctattctctctatcctgtgacctctgacatgatgtcacaattcaccttctgctctgactttgtgaggatttcccaagctggttggtgcatgggcttcctcacttttttcctcacgaagaggtctctggtctcccctctctgagcactctgaggtagggttgctgtgtgttttgctcttggtctaattcctttggctaaacatgaataattatattaatgaatggctttggagattcttcttccgtcctttgcatttttccgagatatgtttctggttttggtatctattagaagggtattttggtttctgttttgtgacaatcaagatttatagtacagaaaattagaagtgattatttctatttcaaggttctttctgtggcagccaggtaatcccttgggtgccctgatttactcacttggtttttttctctctcctgggtataagaccaactacataatttacaaagcccagggcaaaataaaaatgcagcctctcattcagaaattatcaagaacttcaagagggtgagagcacagcatcaaatcaagagcagggcacttcttttttattttaatttttccataagttattggggtacaggtggtatttgattacatgagtaagttctttaatggtgatttgtgagattttggtgcactcatcactcgagtagtatacactgcaccctatttgtagtcttttatccttcgtccccctctcatccttccccctaagtccccaaagtccattgtatcattcttaagagcaggccacttctaaatctggggcccttctaagtgcagggccctatgtgactgcacgggttgctggcccatgaatctaatcctgcccgggaggcaatggtggtaaaagctttagaatcctgtaggcttgggttagagtcttagctctgcaagttactcttttggaggaagaaatatatgaaaaagcggacacaggagcttattagattgtgaggagcacattagtttgatgggtcccaggagaaggagccaacatttctgtattccacttaagtgctgagaacggtgctttgtacctaaaaaaattttttaattaagacataattcacatgcaataaaattaactcttcaaaagtatacaatccagtggtttctagtacactcacaaagttatacaactatcactgctctctaattccacaatattttcatcacccaagaaacaccatatctattagcggtatctattagcagtcacttcccattccctcctgccttagtttctggcaaccactaaactactttttgtctctatggatttgcctattctggacatttcatataaattaaaaacaatatatggctttttgtgtttgacttttttttttttttttgagacggagtctcgctgttacctaggctggagtgcagtgactcactgtaacctctgtctcctgggttcaaatgattctcctgcctcagcctccctagtagctgggactacaggtgcccgccaccatgcccggcttattttttgtatttttagtagagacggggtttcaccatgttggtcaggctggtctcgatctcctgacctcgtgatccacccgcctcggcttcccagagtgctaggattacaggcgtgagccaccgcacccggccttctaagggttttatagttttagttcttacatttaggtcgttgatccatatttagttaatttttgcatatggtgtgaggaaggaagtgtataattttaattcctgcttagcctgacgataatcatgtgacccttggtaagttcttgcacctaagtctcaatttccttatttgtaaagtgagaataacaaatggtagctaaatcataagattacagtgaagatagaaaatttacgtagagcatttatcacactgcttgaagcatcctaactactcgataaatgcggtcggtgttacagttataacatgagcgatgaatgcatgcttccacagtggagtgccagaaagaccggcagcatttctgagaaggtaaacgggaggaagtaggcttgcttagtccacttggagaagcaggtctgggattgttgtgagagtctctgccctaggtagaccactgcctcatgatcccctctagagattggtaaaaattcgaattctcgggccccatcagaactactgaaaagagcctcctgtgagcacagggctcgcagtaagtgggggtgacggtggtcgcgccggcagcgccgccttgggcctgcgggaggcgcccgagaggcaggggcgaccacggcggctgcgcagagtcctccctatgccggcggtcgcaccagcgggatccgcctggctcagctgacagctcccgagaacggaagaggcggcgcgccggttgagcagggcgtttctaggcctggtcggctggcggcggtgagtgggccccaggcaagggcggagggcggaactttggggttcggcactgccgggcggccggaaggtacggtggggatagctctctgggcgcgcgaggcagagaaggggaccgggctgggactgtacactgggcctcagtccctcaaatccgggaccgggcgtccgcagctcggctggccgggactcccttcgggacgctgaggaggaaggggaaggtgtgggccctgctccttcgggacgccccaggctggccagcagctcacacatccgcattgcgccctctgatcccagcgttggggcggatagctagcgttgggcctgcccctgttttggggcagtcgcccaaacgacgccgcacgcctagtggcgagctgaacccagactaggacacccgaagaccaaatggatagagtgagaaggaaatgggggttagcaacctgaattgaggtactggattccaggtgacagcttcacaagctgaaatcttgtagggtaggtcatgaggaactgttgaaactgcttggagtagaagttcttagccctggctgcatattggaatcacctggagaacttggaaaactactgaggcctgaattaattgttctagggtgtggcctgggtattgagattttaaaaaacagctcctcagaagattctaatgtgcaatcagatggagaacactaacctaaaaccataaactgcatgaatgaatctctcatcccatttgcaaatgttttaacaggaagaaacaaaaagcttaattcaattagcaccatatactcccacctagtaaaataagacaatgtgaaaggacctaatacagtacatagtaggtgctcaattaatgtaaattgattctgaatctcattcttatctcatttgggagttacacatccgagaatctggtttttaattatggttttgtatatagtatttttgcatataattttagggtgttgataggattctccgtagcccatctatagaccacactcccttttcccctcaccccagtgaagaagcctagctctaaagcatttagaataaaacttaaaagtttgtgtttgtgtactcttgttttgtttaagtatttttctgttaccaaaattaaccttgagtgccactggcaggcttaattcatgaacaagagaggaaaaactggaggggagtggcaaatgaaggaatacaagaagcagaagaggaaaggagaaaaaaacaaaacaaaaaacaaactgaagagattgtttgttatggggcatggtgtcctgtactttcatatgaccttggtgttcctccttagctcctcccatagctgagggcagacagataaaaagtcctcagtcattgctggggacatgcaaatactcctttaaccacatggctcagttagcctgccctaggagagtaacatgcacttgtagattaggattggctatatgttaggatatgtttgacttaagcagtgatcatggaaattcagaattttaatttggagagggtcctaacaccatcttttgtatttcttttctgcagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtactaactgacctcaagtagaacatgtaattgtgtcttagatagggatgcagcttaagcagagccatgaactaacatctcctagaaaaaaagtgttttttgaaaatgaaatcatttttaatttcatagtatgaccttttaaaatgtaaaaaatcctaactttttacttatgtacattttaattaaaaatattttagttgtgagggaggatatttgcaaatgcaattgtagttcaatattttaattgactggtagttttgttttattaaaatgatttttgtaaattctcattgcatatttttttcacatttaaattatctgaaattgctgtatctttcagttgatgctattttaaaaaacattgattcatactttattttttgagacaaggtcttgctctgtcccccaggctggagtgcagtggtgcaaacacggctcactgcagcctcagcatccaaggctcaagcgatcctcctgccacagtctcctgagtagctgggactacaggcatacaccaccacacctggctaattttttatagagacaggatcttgctatgttgccaaggctgatctcaaactgctggcctcaagtgatcctcctgccttggcctcccaaagtgctgggattacgggcatgagccaccatatccagccagttcatactttaattgtagctaatttctttttctttcttttttctttctttctttctttctcttctttcctttctttcttctttctttctttccttttttttggagacagagtctgtctctgtcacccaggctggaatgcagtggtgcaatctcagctcactgcaacctctgcctcctggattctagtgattctctagtctcgtgcctcagccaccgagtagctgggattacatgcgtgtaccacaatgcccggctaatttttttatttttagtagagatggggttttgctgtgttggccaggctagtcttgaactcttggcctcaagtgatctgcctgccttggtctcccaaagtgctgggattaaagacttgagccactgtgcctgggccttgtagctaaattcttagtattacctaaaataatggtaaatctttcttaaaattattatcttttaaatattcttgagtcataatggtgaatctttaaattggtgactgcttggatttgacaaaatctattatttcaaaaatttaatattattttgctgcttgctcagttatctaattttcttccataatatctatgcctgtaacattctcaagcactgttttctcacctgggagcaattttgcctccaacccccatcctgccccaggacctggcgctatttggagatattttttttttttgagacagggtcccactttgtcactcaggctggagtgcagtggtgctatcatggctcactgcagcctcgacctcccaggctcaagtgatcctcccatgtcagctccccaagtagctgggaccacaggcaagcaccaccacacctggctagatattttcagttgtcacagctcttgtgggtggaagcgggccactattgggtatctagtgggtaaaagccaggggatgctgttaagattctataatgcacaacacagctctccaacaacaattatttacttcaaaatgtcaatagagctgaagctaagaaaacttgccctaaagattcctgtggatttaaaaaatttacttttttgtttttttgagacagagtctgactctgtcgcccaggctggagtgcaatggtgcaatctcagctcactgcaacctctgcctcccacgttcaagcagttctcctgcctcaacctcccgagtagctgggattacaggggtgagccaccacacccagctaatttttgtatttttagtagagatggggtttcaccacgttggccaggctggtctcgaactcctgaccgcaggtgatttgcccgcctcggcctaccaaagtgttgggattacaggcacgagccaccgcgcctggcaaattaacttaagaaaggagtgtaatatactttgaccacttttgcgaaccaggcacattgctaggttcagtggacaagtcaaagtaaatttgtgatttgtccttttcaaagaaaattttcaaattgtgctttttttcctctaattcagtcataaaatatctaactgataagatcaggaattagaagtaccacaaccatcccttttgaaaaagactgttaatattgcaaaactaatggaatgccagatatggctgtcatttttggtttaggagaaaagtgataatatcgattaattctttgcagttgttttttgtgccattaagctttttccacctctgtgcattttcttttctttttttttttttttgaaacggagtttcactcttgtcgcccaggctggagtgcagtggcgtgatgttggctcactgcagtctccacctcccggttcaagcgattctcctgtctcagcctcccaagtagctgggattacaggcacctgccaccacgcctggctaatttttgtatttttagcagagatggggtttcaccatgttggccaggctagtcttgaactcctgacctcaggtgatccgcccgcctcggcctcccaaagtgttgggattacaggtgtgagccaccacacccggccagcctctgtgcattttctgttcttaactgattttaatgttttcaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggttagttaataatttcttaaacagatttttctattattctttatttcttagtgtaccttaaactatttgtcattttgtgttttaggcattagtgataggtggtagtattacagaggtaatgcatgtttctgttttaaatgaaaattgcaatgaggggcaagcagttttcaatttgattctacctttttgatcactgaagagggatattatcctgcatatttcatacatcctggtctgctaactagcagtttatcagccatgagtcattggctgttacatagcagtaatcaaagagaaaatgaatgtatgtgaaaacgcttagaaattttcaagtacagtggtggtggttaatactatttggtttccagaatcatttcaactactataaacatatgacacatgctattactctgtgaccttttgcttcagaaaaaacaaaactgctgcttttgatacagacatttacagaagactttgatgcacactttctcaaaatgtttctactataaagggattgagtaaggaaagtaagtgtggtaatttaaatgaaactttgattgtgagagtgttgtgtgctatattatatcctcaaacctgagatcattgtgttggcacaaattttcccaactgattcatgggtagttgggacatgctggtctaagtgggacatgctggtctaagtaggtcatgctgttcaatggaaatgaacatcctttctctagattgtgtctttaatcatccactgtaaaccaaaccacaacaaaacaaacattgtgtgttccttggtcattagtgttaggaattgtacccagaagtgtatacaagaataagttgtagtattttcattatacatttcatggtgctgtagatttttcaagggcttacaagatttttttttaaggtggtggctaccaagttaaaattaagaaatagaaagtgctttgggggagggtttttattccctcaactaaagcattaagtctttcttgagcgctgctcaacagtagtggacactcaagtgttgaccaactgatcctttctaatctttgtttttggttcaggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcaggttagacttgaaacttaatttttcctatccatttttagaaacttaaaaatcacctttaattgaagactatcttaaagatcttgaattcagtgcatgaaaaacaaatggctttggttttgtaatttttttcccttgccttggtgaatcctgatgttaagaaattgaaaatgtttggtgttttaaaaaggaatggcagtaattaaaacaatcatgaattgtagtaggagtaatttttaatcaagtatattatttcttttcttgtcttgctattttcctgtttaatctgtattataatggagactaagaggtcttcctcattttccttagacattgatactacttttctcttagtttcttatccattccttaaatgaaagattccattgtaattaggactaaaaattgagctaatgtagttataataagcaaattttctgagtgaatacaataactgattttctttgtaaaaatctgtattaataacaaataacagtcaactggtatcacgtagacataaatgcatacaagtagaaatgtgtatagttcctgtagatatctcagtaaggcttgaggccttatgttaagcacctcatttcctctgggttatatatacttttctagtaacaacctcaactcttgattgagacataaatatggcttgaagctaaatataaataatataaagcattctgggagagataatgaatcagcagctgcttttctagaagtcataatgaagatcaatagactaatgtgtattaagacaaaagctcagcctgtgcaacatggcgaaacccaatttctacaaaaaatacaaaaattagccaagtgtggtggtgcgtccctgtaatcccagatacttgggaggctgaggtgggaggatcacttgagcctgggtggcagagattgcagtgagccaagactgagccactgcactccagcctgggtgacagacagagaccctgtctcaaaaaaaaaaaaaaagaaaaagacaaaagatgtcagagttgctgacctcaaggaatagctcattagtttttctctttggatcatacagttttcatttccccatccaccaatctaatcttttaagtgagagtactttcacaaactagagcttatggtttaaaagcaaaattaaaccttaaaaaggataacacaggtagaataaaaaggagtattactttacattctaatgtctgtgccagaggcaacagatgcaagacagttgatttgtccaggaatatcaagactgtttggcatttaggccactgatagttggcttaattatttagatcttcatagtcctatttcaccagagagcttttcatactttacatccacgcatgtgcgtgcatgcacgtgcatgcacacacacgcacaaaacagggacagattaactggatgcgtggttgtggtttcagattccagccaaccagcatctacttaatgctggatttgggggcggaggtgtgtgctggggaagagagttgttttatgtgttacagctaaaattacagtagaattcttaatcaaataaatgtttatgcatataattaacattttaattggtctcttatattccttcttggttcagttcttgtttgttgctgtaccctgattccttggcattatgactctcacctgttaatggtgaaattgacacatagagctgtcattccctgaattggggcgggtagacagagggaagtggttttagttttctaaaaccttattccttattcctcccccaatatacttacacagtctctttcccgtcccccttccatttacatgcattccagctgcctttctctctcttttttttttttttttttttttttttttttgagatggagtcttgctctgtcacccaggctggagcacaggggcacaatctcagctcactacaacctctgcctagtgggttcaagtggttgtcctgcctcagcctcccaagtagctgggaatacaggcgcccgccaccacacctggctaattttttgtattttttagtagagacagggtttcaccatgttggccaggctgatcaccaacccctgacctcaggtgatccacccgccttggcctcccagagttctgggattacaggcatgagccaccacgcccagccccagctgcctctcttgagaagggactggggtagaaaagaggttggagaatggcttcttcataggacttggtagctcacacagcactcatagcttcccttttagtatttatcacattttacagatgttagcagatttctcaaaagcatggttgatttataaggatatttatgcaaatgtgaaaaatcattagttgttcaatcttaactcatcaataagtatttaaggtagtacctatgcagggtttagtcagtggcactacacagagtgtaagaaacagaaaatctggtcccttttcatttgtcatttaaatttacaaaatttgtttgccatctggaaggcatatttttggatgtttacctaaaaaagaaaagctgcttataattcctgtgctctagttaaaaatattttatatttctaatggaaaatcctccaacatttgcctttcaaattgaacagaccacttttaaagaggaaaattccaaataatttaattttggttgcttagcttaggaagtgtaagctttctctatggctgccaaaccttgctgagggcttgtgattaggaccagggtcaatatcaggcagcttccctccattaaccaggatctgatataagcccagattgcttacttaaaagcagcttgtaaatctgaacaaggactctgaggttgaattctgttagtgattgtttcagatgagttgactttttgataaaactgaaagaattaattttaaaacttggatagtatttttaaactattctttttctaaccattattctaggatacgaacagggctaggactcctaatggaagaaaaatagtttatttttagaactagatctctttgtcctacatgaggtatatggcagtactaaaagattaaagaacagaaaaaagtcttccatttcagtggctaaaatgtacagctatttctctaccttacggagtcttgctatttctcttcttctcatggtacttcttgcttctgactttatgttctactctggctcatgttgccgaatagtttaagaagtgctccagtaagaatgtttgtactgttttgtagcacagtgtatcacagcagtaaaaaatagtgttagaataagggcctaacttgcaagtggaaaagatttctagggaaaccaggagttggcagcagcatcatctttccaaactcaccaacatcttcatgtgttttctcctagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtaactgtttaccctgctgatggttgcctcctaattctcttccataaatggagatatcatctcaggaacttccttgatagggctcatggggcagtccgaggccttggagccagcccacaagttgttttgctgtatccattaaaaatgctatggtcttagtctactgcttaagcaaatggaatgcttcctttggccttgcagtgggcaaggatgagtgttaaagtagttattaagtaattgtgataatttactttgtatatctgctagtaggatcccataaaccttggggaatcactagcttattcttgtgtgaggttggcatctgaaggggacgtctcttagaatgattaaccaacttttttatagacttcagcagaagtacagcctacttaggtgttgttgttgttgttgttgttgttgttgttgttgttttgtttgagatggagtcttgctgtgtcacccaggatggagtgcaggggcatgatctcagctcacggcaacttctgcctccaaggttcaagtgatttcctgcctcagcctcccaagtagctgggattacaggcacccgccaccatgcccggctaattttttttgtatttttagtagagacggggtttcaccacgttggccaggctggtcttgaactcctgacctcaagtgatcctcccgctttggcctcccaaagtgttgggattacaggcgtgagccactgcgcctggccagttttttgttttcttattaaagcataattttacttaaaataaactacacatttaaatcatacaaggctagcatggtagcttacacctataatcccagcactttgggaggccaagataggaggatcgcttgaggctaggggtttaaaaccagcctgtgcaaaatagcatgactccatgtcttaaaaaaaaaaaatcaggcatgatggcaagtgcctgttgtcctagctacttgggaagctgaggtagagaatcatttgagcccaggagttcaaggctgcagtgagctatgattgcaccactgcactccagtctgtacgacagagtaagaccccatctctaaagaaataaaactaaaatataaaataaattggacactttgcttagttttaacaaatgtgtagacccctataattgtcatctcagtcaaaatgtacttggtttgattttgaagtgaaagagaggttttaatttatgtgcccatctggtttacactagcatcctaagaatcgcctcaggttcagaactggttgtggaatcatcaaacctatggtgttttgtatttccctccaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcaggtatgttttaactgtgaacccaaacccccatccccagtctctccctcacatttcactctactaccagggccttatgacttcattcttcaatttggaagtattcatttagcagatatttctgtgtcagtgactatctcaggccttggggctgtagtagtgaccagaagagacaaaatgtctgccctcatggaactcacattctaccaggggagacaggaaaacaaaataaggatattaggtggtggtaagtgctgaagaggcagaagaaataaagcaaggacaggatatgaaatgttctgaaggggaggggacttgggattttagttagggaaaacgggaggcctcaccggcaaaatggtttaagtaaggacttgaaggaggtaagaaaaaccgtgcagataccagggaggaacattccaggagaaggaatggcacaggaaattctatatacaaacatggaataatgtagatcctggatggccaatgcagggcatctaagctgccattcttgtctccatggcacatgtgtttgactagtcatcaaatgctttctccttgagcccagagaggcctcagaatcttcctcaacatggcacttcggaaagctaccctctgatgaagtagacacaggagtgaaatgtgtttgccgtttccagtctacgtaaggaatcataaatcaggcccttaacgtcgatttaattggactttggtggcttagtcttcttcagactaacagggataatgataacagctacctcacaaaattgcagctagagcagataacaataacttcacggggttattctaaggatgaagggaacgaatatcatgctattcaaaattgttatatttgttacactggtgtataatatatagaaattgagagggttagaaacttttatagtgatttcacataattttatgtcaaatctaataaaaatttagactttttttcatttttctaataattgattgttagctgactgtggtggtgcacacctgtagttctagctattcagaaggctacagcaggaggatcttttgagcctcagttgagactagcttgggcaacgtagtgagactctgcttctaaaaaaattaaatcaagcaaacctggttatatcttataaaagtgttgatctttgacgtatcagagaaaaaataaactgggcctttaccataaatagtttgagaaacagtgggctaatacatgtaaaatgcagaatggggctgggcatagtggctcacctctgtaatctcagcactttgggaggccaaggtgggcggattgcttgagtccaagagtttgacaccatggcaaaaccccgtgtctacaaaaaaatacaaaaattaacgaggtgtggtggtgcacatctgtagtctcagccactcaggttgctgaggcgggaggatcgcttgaaactgggaggtagaggctgcagtgagccagattgcaccactgcactccagcctgggggacagagtgggaccctgtctcaaaaaaaaaaaaagaggaaaaagaaaaatagtaattattaatgctattattattgtagttattacttgctaatgttagcagactgtcattatttccaagaaagtaccatgagaggaaagagtgggtagataatttcagttgcctcaggcagcaccttgcagaaggtaaggccagatggaatggagaacttagcaatgtataatataagcctttactttagacttctgtaaccttttcattaaaagtcaacagtacatttcaagtgtttcacagcattcagggaagaaattgaagatagattcagggctttagcaaaattaggaatctctccctctctttgtatgtatatattatataaaatatgaaatacaattttattattttgggaagactaaagcaatataacctttgtccttaagatgcctaggaacacaaaaatgcattgaattattagagggatgagatttacattgcttcactgctacattgaagtagaggtgatgaagctgtgggaatgtactacacagagaaagaattcacaggtgaaagcaaagagtggagataggatataggattctataccagaagatgtcttttgctttaaaagggagatagacttccaaataatgtgaggaaagtaaactgataaaataactagaacattgttgagaaaactctttaattaattgtattgaaaaattaaggtaatacaactgtgaacaaaagccttttgtctgcaagtaaaacctttgggattggttacctgttccatttcagttaaatgatagagcagtagaagccagattgaagagtatcgagggaaaacttttcagcacctgtagcaaagcatagtacagggtgagacttgggtggtaagttttattcactgatttttttttttacacagaattgaagaggtagtctttgcccttaagccaaaagtgcctttgtatttggtaggcctcttcattatcaaacagtgaatggtgctgacttagtggaaaaatcaatgtctgtttcaacctttgtgtcttctagataagtcagtctttaactgcatacttctagatgcataaacataccaacattaagaaatcaaaatcaaaggaaaaaaatagcctatcttattctaccacttttagcagatacatcttttctagttgggggattcctttccatttattatcatttgtgcaagtataatttttactgggttataacataaatatactttttttctggattctgtgatgagtgttttaattgggttgtagcgaacctaattatgtttttaataattgaatattatgtcattaaatggctcttccaaacataattatttccttagaaatttaatttttttgccattgttatatgcatctccatgcatatgactttggattatttccttatgataaagttctaggaataacattattgaatagtcgaagattatagccatttttaatgatttttggtcagcattacaaagttatataaaagttaattttccatttcactttgtagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagaggtaaatgttttgggacagacttggaggccatcagacttgcaaggatgttatgattaccttaagaagccttactagtcaattttatgacttacaaaacacatgctggtattattacaccttcttacgtggaaggtggaaatttcactattagatcttgttatcgaccttaaatgtttgtagacttcccttttcaaagtatttgcttacagtgaccattgttctcacattgtatccacctcaaaattgaatgggttgtaaggagggcatactagagctatggtcaactcttacctcatctatgtgattaaaaaaaatcaaatctgatctctcagaactatttatcctggaatgctgcacacctgtttaagatacactcaggaattaatttgagtcaaaataattagacagatatattgcttcttgacaaaaatcttaatatgttttaaaatcaaaatacatcttagcatttgattctattgttctaatctgttatgtctgaactgaacatagtgggctccagttaaggaaactaggactatatgtaatcacttttttttttttttttttgatactgagtctctcttgcccaggctggagtgcggtagtgcaatctcagctaactgcaatccccgcctcccaggttcaaggaattttcatgcctcagcctcccgagtagctgggattacaggcgccagccaccacacctggctaatttttgtatttttagtagagacagggtttcaccatgttggccaggctggtctcgaactcctgacctcaaatgactcgcccaccttggcttcccaaagtgctgggattacaggcatgagccaccacacctggccatataatcacttttgacataccttagccctatgacagagtggaggacttggtaccaaatatttacttagatttctgtaaaaattaaaaacccacacgttacatccaaacattttaatattaatctaactacattttccagttatacgtgtgtgatttttatctactgcttgtcagaagagattgtgccaagtaactaattgtagtaacactagctattttctgtattttacttctaatgcaaaatagaaagaattacatagtcatcagtgtgttacattgatatctcaaccctgcataagaaaagggagaggaccaagacaatgttgtactgaatcattttggcatgtgctgtctcttctgcttttacagccttgatatttttctctttctatccttcccaccagaaattagacggatgtaacaagatgacatgtactggctgtatgcaatatttctgttggatttgcatgggttctctctctagagcaaacccttacaaacatttcaatgaccctggttcaccatgttttaaccggtatgtatacacggaattcctcaggctcaccagcaatttttggtacttgatttgcagaccacaaatccagtgttttatttaagtacttggacttatttagagaattctcttacatgttttcccctataaaggaatttttatattattttctcaaaaatgagttttataatgagacttatacaccatctggaagtttttatagtgaaagttttcaaacagaaaatttgaaaggataggactatgaatagtaggatactttccacccaaattaacagttgatagtactttgccatatttgttcccttaacatttttactgaactacatgaagttggagttatgataatgcttcaactctaaatatttccacgtttctcctaagataaggaaatgcttctacataatgacagtacttttaaaaaacttaatgatagtggcatactattatctagtaaacaaacatatttgaaacttcctaattatttctgaaaatatcttttaaagctatttgattgaaccagaatctgaacaagttcagtcattgtatttggttctatctctttagtctcttaatacagaaaagctttggcccaccttttttttgtgtgtgttttgtgaacattcacttttttttttgttgagtcagagtctcgctctgtcgcccaggctggagtgcagtggtgccgtctcggctcactgcaagctccgcctcccgggttcatgccattctgcctcagcctcctgagtagctgggactacaggcgcctgccaccacgcccggctaatttttttgtatttttagtagagacggggtttcaccgtgttagccaggatggtctcgatctcctgacctcgtgagctgcccgcctcggcctcccaaagtgctgggattacaggcgtgagccaccacacccagcaaaacattcactttttgaagagtccaggtcagttatcttatataacgtcttaccttctagacttttatttgtccatggtgtcctttagcttgtttctcttatttgctataaactggaagttaggtctagactgaagcttgattcgatttagaataacattttttatgctgatacttcatgaggagtgatgtgtattccgtattggatcacatcaagaggtccatgatgtccctcattagtgtggtgctcatttctacagtttgctttattgtaaaggcaagttttccattttgttattaggaagtaatctgtggggtgattccttggcacaatgtgaatatcctgttctccaagagctctccactttcagcatcagttgatgatctttgttaagaggtgtctgttaagtaaacacattggtattgtgaaactgtaagagaaattgaagaaacaagccctgccatgaactattggaaatctagtgttggaaattgcataagttgtagataacataaggaaaggaagacaaattgacagctacaaaacattctacaaatggagggtgcaaggactgtgaagatagaatggagtgatgagcatgtaatagtaataatagtgtcttgaaagggttcagtttaaattgcctgacttccccagtcttgccttattccatgtattgtatacgctgagtatcagttttgtgatacctatccctcattattgtttatccttggccctggagaatttgtctggattctaaaaggactgttttgttcgtttgttttaatttggaaaggagagctttatttctcataaagagttgaagccggcaaggtggctgttatgacaggttgggaagcatagccttcagccagaagctggaaacagacactctaaggatgggaagaggaagacagggatttatgccctacaagatagccagatatacatattcagtaaggtataggaggagtcatgaatatttatgaaaggagaaatacgctgcatgtgcagttgagcttcattacccttcaggggacccatgttcaaaaaatggtggcattagcatgatctctgggggagttctctgatatcaaaaggtgaagcagagaacacgaaaacctcagtccacatcctccatagactggctagaaccactccatggtcagtggtctattggcaggaagaaatgctggtcggtttttgtgccaaaactgcagaagggaggggcagcgtcaggcagttggttgatatcagcggtggagcaagtcttcccaaagggttggtttgaacccttagggaaagaaagcctaatggtggtcagtgagggaggggggtatgaccaggtgtgtctggcctcccatcccatcatggccgggaactgttttcagggtttctctggggttcccttggccaggagagggtctgttcagttggttgtggggcttagggtatcatttttatttctcattttcccctttttggctgagatttgccagaggcagcattgatggtcaaacttattttgtcccatatcattgctggagtggtgtggctaacctgcctcgcctccatctaggccctcagtgggacccctatggccaagggacttaaggccaaaagacagccaattaaatcttctaggccagtgggaatggagctggacaagtactcatccaccttaaatgggccattcttaactaactttagggtagattgttcagagggacccatatttcagccctcctcagtgcaatgattaaaggagaagaaaagatgtacaaatttgttataagagtacaaaaaatatttttcagcggagaggcaatttatattgtttcgttcaagtgtataaaaatgtaccttttttaatgcttccaggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgacaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagctttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaattgaggttaaagaataaattaaagataagaaatggaaattaaaatgatttgttctacagtatatacctgagaagagtgatttctgtgatcaaagagttcaattcagatttattcagaaagagctactcagaagctctatagttcatgagctacttgatattttctagagatcattttatgttaagctattatacattgttgatgatgtcatagaagtaggaaagaagcctttataatacagttttatgaaagaaatgggagccttttttcccatttatgatattaaaaacaacacaggtatttggtgtttagtctcaa

SEQ ID NO: 15983 - DNA, 22143 bp, Human
tcaacggaatcactgtttatttttttattttttgagagggagtcttgctgtgtcgcccaggctggagtgcagtggcacgatctaggctcactgtaacctccgcctcctggattcaagcaattctccctgcctcagcctccggagtagctgggattacaggtgccctccaccacgcccagctaatttttgtattatttagtagagacagggttttgccatgttggccaggctggtgttgaactcctgacctcaggtgatccgcctgccttggcctccccaagtgctgggattacaggctcagtgagccaccaatcccggccccaaatcgactgttttagggagagcaaactgagacatgccatttattgaacgctcttttatatcttcctcggtgcggggtgtttttccaattattaactatttaatcttcacaagctcacgacagccattcgtaacctaattttgcagataaggagctagacactcatttgggggggagaagaggaggactggagttcagaaagtgcatttgatgctcttatcctggaggctggagctagttcacctccctggagaacagcttttgggaatcccgtttgaaattgccgctcaaggccagctcggcatccagcctaggaattggaggattttggagaatccccttagggggaaatgtttaaaagtgcaaagtgaatagtagaagcccctctcctcgtcactaggggtacatttgccgttttcttatcaacagcctctcaagtacaagcatctgggacaagaactagaaccgtgcttggggcagcccccacgtcctctcgggaacaggggtggagcgctggcgggagtggctgagggcggcccgccgccgacactgtgtgcaggaagcgggcgctttgtctgctctcccaccgcggagaacacgaggcggaggcgcgccccagctggccacacgctgcccagggccggcgtcggtcaagagccctctcttcaagcaggattaagagggaaccaaggggctggcagaggggcctcagaagctcctgggcgaggcctgagcccgtgggtctcgacactaaaatctggcgagctccctgcgcgtccgcaaagattttggagctctgaagagcccggcgacgcctgcgctggccaggcgccgtgcccacgggaggcgccgtcctctttgtaactcgagcagaccctggcgggccagttgctatggcaatgttcctcgctctgctcggtgaggccgggaggtaggcgggccttggcggacgtcacccacattcggctttggggagccgccccacccccaactaattgtttgccagaaaggaaccgtaggatagatgctttgtgagacatctacggggccatgttagaacagaaagtcgcgacagcctctttctccgtcagcctcttcacaaatcccttcgtgccaacgattttaacggtccttcaaagccaggaggagggggcgtggtaattcgaggggtttgttcgaagggccacgccctttcctcggcctttggatttttccaggccgcgcccacggcgggggggtgggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggcgagtcgggcggatcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtgtgagagaccattgggggtctgtagggggaaggggagtgggggcgtgtgtaaggggcagggtgtgtgaggaggagaggaaccccagcaaagagtagtaataataatggccaccgtcacacgataatattcgagtaatatgtgcggggactttacaaagcatctcatatgcttcattttaacttctactccaatcctccgaggtgcgtactgttatcaaacccattttacaagataggaaaaccgaggcacgaaatagattaagtggcttatgcaaggacacacgactactacgtggcctggcctggcttcgaacttagttatcttagtcctaaggcccgtaattttaactttgctttaccaaacaaaaacagaagaagaatggcgtgtcagaaggaggaggactgagtgtgatttgaagtggaaggatgatgataaacgagaagagaatgatgatgggagacggagtagtggggaggaggacctgaatttggaatcttgcgggcctcccccttctaaatcgccgcctcttccttagttcttgcggccccataactttttcttggtgttctatggctttatgaatggaggagccaactcacagacctgggccattcgggtggttttaagaagtttgaactgcggttcaatccagggcagtgccttgagacactgtttggaggtaagggagggtcagaggatcctcttaaacgctgctgctatttatttcttcaaacgtgccacttccttttctatcatatctatgcacggcaaagcctttgttcagtcctctagaataaggaagtgatgtttattgtttccttgtacacttgggcttaaacgaacaaaatcagactcaacgtttcttttcccgagcaaggccttgattgcttgcagagaaaactttcctgtggctttatcattagttgcccttcagagctttcctgtgtaaataagaagctatgttttggagaagtttacaccgtagatgaacgggagcgatctgaacatactgcactgcaggtcaacacagagcagggacttcagtaattcataggtgtgagtgtgtttgtgaaaacctttccttcttgcacagttttctgtgtagctcatgtgggagtcaagtttttaagtcagcccgtgaggcaaacattgtatgtaataaaaattaacccttaaaaattcctaggaaggtgcaacgcttgagattagcatcctgtttctgactacatcctggacggtttttccttcagttttgaaacttgttactgttgctttggttgtaacccagataagtaattagattacctttaggggctgtgttgtgcaaataagcatatttgaaagccatagagttgtgatgcgctgtgagatgcttgccctgaggaggcttaaaaggaggaagacaaacccctatcttaggctcattttggagcatgtgcttacaaagtggaaagtggcaggcagaattgctggtatgatgatgatgatgatgatgatttttttgagacgtgctcttgctcagtcgctgaggctggaatgcagtggcgtaatcacagctcactgctgcagccttgacttcctggggctcaagtgatcctcccagctcagtctcctgagtagctgggactgcaggcacacactaccatgcctggctaagtttttgtactttttgtagagacggggtctcactttgttgcccaggctggtctcgaactcctggctcaagtgattctgcagtctcagcctctcaaaagtgctgggattacaggtgtgagccactgcccttatcctgctggtatttaagttgctattttattttattttttggccagcatatgcagtaatttgacttgctaaattaaatgtgcatagtgcgattcctctttaatttttgagtggcactacattcaggggcttgcaagctattgtttacttccccacagatcctagctaactttggagcaaaaatggcttacatatttttgccaactgtctggcttcggcagtccccatatatatgccagatatgtataacagtggttagctttttaaaaaccaattctcttttaaatggaagttaaaggcgtcttttggttgtgtggggttttttgttgttgttgcttttgcttttacggaaacatctctcaaaaactcaggagtgatacacccacttcctccaaagtagttatggttatgtttgaaatgacaccaaaaatgaagggtattatttcagttagggaaataaggaagtaccaccgatttaacattatatgggtatagaaaatggttttaaggccttttgcaggggagaaatcttaagcaagtttaggaatctaaaattctgagtcgaaacattttctgaattatggtcagatagtgtaatttactccacattcattctgaacttctctcttttcctgatctttattgttcttttgcaagcctgtaatagaacaaaaacaagagaagaaatttattctggctttaagaagtttctactatgttttttgggggagatgccacatagtctacttaagtttaattactgtaattacagagaaaaatctgtggaagtataggataccttgaataaatggaatcttcaaggtttgctggcaaaccaacagtttgatttctcagaagtttcttagagaaatgatgccagttttgttttgctccagattctcattgttgcatctgccaatcttgaaaataggaagcaaagattttccttgctctgtcccttgggaaccacttacattcgttttactgtttctaggaaattttctttaaatatatacattagagcccactattgtgttgtggatccatgcagtgggcttgccttagaagtaagtgcctttatgataagctcttttttgtttgtttgtttgtttttgagacggagtctcgctctgtcgcccaggctggagtgcggtggcgcgatcttggctcactgcaacctctgcctcctgggttcaagcgattctgctgcctcagcctcccgagtagctgggactgcaggcgcgtgccaccacagccagccaacgttttgtatttttagtagagacggagtttcaccgtgttagccaggatggtctctatctcctgaccttgtgatccgcccgcctcggccttccaaagtgctgagattataggcgtgagccaccatgcccggcttttttgtatttttataaccaggccttgtacgttgtttgccataataataacagcattcgtcagagacccaatcatgttgaatttttttctcacagaatactttcccctccctgatttttctcctggaaaatacaccatgaatcattctgtttctggttgaatgatttacaccagccatctttagtcctactgttgaattgctgcatagtttctttttaatttatgtgtttaaaagtaaatactggccggtggatcacaaggtcaggggttcaagactagcctgaccaatatggtgaaaccccatctctactaaaatacaaaaaatagctgggcgtggtggcgtgcacctatagtcccagctacttgggtggctgaggcaggagaattgcttgcacccaggaggcaaaggttgcagtgagccaagagtgcaccactgcactctagcctgggcgacagagcaagactccatctcaaaaaaaaaaaagtaaatactaactaaaattctgatttgcattgtggtttttagggttcagattagcaagtgggattgttttttagcacttaaatccctcacttcatgctctgtttgcacaaatctaaagaggcactggtatgtctaaagaggcactggtattgtttattacctctagttgtatttgactttgggattgtagagaaaaataatttccttttgtgggatgggggaagaatcccatgccagtattcatcatatgggtacaaaggcttgagtgtgagagtttaggtccacattctttcaggttttcagagatctcaggtacattgaaaatggctaagatgattcctgtaggactgtttccatgatttggtctctgtgcaaagtgatgtgaaagtcatggataagggcatatttgtggtaacggaattattttggtctagtctacagagagctgaaaaactagggtagtggtttcacttctgtggcagaggactgctgggcagaagtttcaataacttcagtttcttcaagaaagaactgtgtgtgtgtgcgtgtgtgcatgtgtgtgtgtgtgttgacaaagtttctccatcatataaaatggagaataaatataatcttaatgttttaaactaatgaagtgattgtaaaatattattttgatgtctttgttgtgttgacatcttatgtgtgtgtaaacttacatgattttaaaatgttttacaatctagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggtaaggagctctactctgactcaccttctttgtcacttttaaagttggggtcttgctctgttgcccaggctggagtgcggtggctattcacagatgcaatcatagctcactgcagccttgaactcctgggctcaagcagtcctcccacctcacctttccaggttgctgggactgcaggctcataccactatgcccagcttgactcaccttcttatatggatgggtttagggaatgtttaatttgagattttgaaaagaatgggtatgttccactaaagccattgtaaattaaaccggatggaaggttgtgttgcttcatgaaatatcaaggtagccagtgtctctgagaaggatgtaacctctagtatcttagattttttataacattattctgtttgaaagtctttaaagcagaagttacgtcatcccctagggcccagctgttccacagatatgttggatttgactatacgatgttaagaattttaaaaatttattgccagcatttaaaagtcaatagaactcacttgaattccagatttctggcatctctgaaaaaaaaaaataggaagatctggcaatatctgttatccactcctgcctgacactggctggagagagagatgagtattgtggtaatattaagggcctcctgtagacgggcatgtgctctctgttttactccagtcccgattacttgtactattttcatacctagctgactttactcctttacattagctgcttggagtttgtgactcctgctttagaaattatagagttggccgggcgcggtggctcacgcctgtaatcccagcactttgggaggccgagacgggcggatcacgaggtcaggagattgagaccatcctggctaacacggtgaaaccctgcctctactaaaaatacaaaaaattagccgggcatggtggtgggcgcctgtagtcccagctactcgggaggctgaggcagagaatgcgtgaacccgggaggcagagcttgcagtgagccgagatcgtgccactgcactccagcttgggggacagagcgagactccgtcccaaaaaaaaaaaagaaattacagagttaagtctttagcttggtattcagagctccttccagtcttttcactcaagctaagcctgtctctttatatttttttctgaatggctgtttcacttccctgtatttgtatttttattcatatattgttctctacctagaatgttcttaattgactgcatatctacctgtagttactcaactctttctattgacattctgcttatttaggatcaagttgttgtgcaaagcttcatgattttagtgcttcttcagtagataccaacaagatcagtattttaagataggattttggctgggtgtgttggctgatgcctgtaatctgtgcactttgggaggccgaggcaggtggatcacttgagaccagcctgggcaacatggtgaaaccccatctctacaaaaaaatacaataattaactgggtgtggtggtgtgcacctgtagttccagctacttagggaggctgaggtgggaggattgattgcacctgtgaggttgaggctgtagtgagctgtgattgtgccactgccctccagcctgggtgacagagacagaccaaccctatctcaaaaaaacacaaaaagaattttgtgcccaagtttggggcttgccacataacttttataaatggaggtaaaattttatttatgaattaccaattcagcatccactgttttgtgaaaccttgtgatgagagactttttccttttccaggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacgtaagtgatttctaaataaatgcgttaattttaagttttgttttcactgaatccaggtgggtgttggatagagcggtcaagcagaggacggaacagggaatctcagcaagtgaagtcctgcttaaagaactgcagcagctcaacaatgaaaagataaacaacccaactaaaaatgtgcaaaagatagacttttcttgaaagataatgtacagatggccagtaagcacatgaaaagatgctcaacatcattagtcatgagggaaatgcaaattaaacccacattgggataccacttcacacccactagaatggctatagtcaaaaagacataataagtgttgttgagggtgtggagaaaattggaaccctcatacattgctgctgggaatatagaattttgggggaaattctggaaaatagttttgcagttcctgaaaaggttaaacatagagttgccatatgacctagcaattccactcctaggcagtggaaaattccatggtatgtatataccgcattttgtttattcatctgttgatagacacgtgggttttttctacctcttgactgttgtgaatattgctgctatgaacatgggtgtgcaaatatttcttcaaggtcttgccttcagttcttttggatgtatgcccaggaattttcaaagaaaatttcggggagactgtcattttgctgattgcataaaatgatgttagtgtacttcctattgtatcctgctttgtttaactgggcatcgggagtgtttcatgatttaggagtaatctttttttcctgtcaatacagggtctcgctttgtcacccaggctagagtgcagtggtgctaacatggcttactgcagcctcaatctcccaggcttatctgatcctcccacgtcagccccctaagtagctgggactacaggtgcacgccaccatgcccagctgattttttgtagaaagtgatcagcccgctttggcctcccagagtgttgggattacaggtggagccattgttcctggaaggagtaattttttttattgttgttcgtatgttttggaaatttccttgaggttcaagtaattttgggagatcatctggatctttcctttaactgcattttttagtttattgtcaaagcctgtagtttgtaccataaaaataatataatacaaggaagaaaaatgagttatttcactgagtggtttgggtatgtttgggtttaaaataatgtttacttgcagccgggcgtggtggctcacgcctgtaactccagcactctgggaggccgaggtgggtggatcactggatcacttgaggccaggagttcaagaccagcctggccaatgtggtgaaaccccatctctactaaaaataaaaaaattagctgggtatgctggcaggtgcctgtaatcccagctactcaggaggctgaggtgggaggatcacttgaacctgtgaggtggaggctgcagtgagtcgagattgtgccactgcactccagcctaggtgacagaatgagactctgcctcaagaaaaagaaaaaaaataatgtttacttgggattgaagcctagttataataagcaaaacaaaaaaaaaatgtttatttaagtggaaaagaaacttgtgattcatcattggttttaatttagtggaaaaaaatcaagattgcagtggttttcttattgtctaacccaagtttatatgaaaagcaagtgaaagtctagtggaacaggagtcgtttagcttatttccttacttttgtattacatggtattataaataattcctgtggttgaattaatggatatatctttagagtggaatattatgacagtgttacaatggatgagtattgatttgtaaagatggtctgtgatgtagagatgtaagggatgtaggtgtgtatgtgtagatagagaaaatagtctggaaagatctgtaaacaaaggtattggatctgtggggtagcattatacgaccattaattttttcagtttttttcatgacagagtcttttagataatcatctgtataccaagtaataacatgttacaagttatttaattctgtcatctagtaattttgattaagagaaactacaagtagctcaaacaattacactagtattcattgtttgaaccattagcaggaatagactactttaaggctggctgttgcttcacgtgggttacaaataactatttgctactttttcatagataaagcccctgaccttcatggaagcattagggaaaaagaaaacttaatttctttctttcttcaaagaacttttttcctttcactagatataagaaagaaaaagtcaacaataatacatgtgttgcttgagctaaaagacataggagaacagacaacacatacccattacatttctaggaaatacgaggtaaagagaaaaaaaatttttaatgtcttttttaaaatataaaagctttagttaagttgtaagtctgtacaaagaagctagatttgctactctccaagaagtgaagggacctgctatgtaatatacagaaatcatttacttcctttccttttctttttttttgaaacagagtcttgctctgtcacccaggctggagtgcagtggcacaatctcagctcactgcaacgtctgcctcccgggtttaagcagttctcctgcctcagcctcccgagtagctgggattacaggcgcccaccaccatgcctggataatttttgtatttttctagtagagacggggtttcaccatgttggccaggctggtctcgaactcctgaccttgtgatccgcccgccttggcctcccagagtgctgggattacaggcatgagccaccatgccccacctatttactgccttttctttttcttttcttttcttttttttttttttttttgaggtaatgtcttgctttgtcacccaggcaggagtgcagtggtgcaatctcggctcactgcaacctccacctcccaggttcaagcaattctctgcctcagcctcctaagtagctgggattacaggtgcccaccatgcctggctaacttttgtatttttagtaaagacggggtttcaccatcttggccaggcttgtctttaactcctgaccctcgtgatccacccactctggtctcccaaagtgctgggattacatacagttgtgagccaccgcacccgacctatttacttcataagaatataacttgagctttgccaaagctttatgttccctgagggcatctaaaacgccagttcatggaacaggcacttctttctcccactcctttccatttatgctgtagttttcatggatttctgctcagtgtcacagacggtggccaagaggctatccaagccttgttctgccagaagtaggtctggaggctggtcctcttctgggcttcctacgccacttgagtgctgcagctactgggattccagggctgtggcttccttggcctggaccgcttcctccctctgcaggtggtactgttaagtttcatccttagctgctcctttgatctacttcagcctctgggtcttttgctcatgggccttggataccttctcagtggcacatttctcagcctgcagcagctgctggatcccctgagactcactggccatggtggcggtgtctgagtctgaggcaagcagcctgaatcagctggaaggcgcgtcaggtcatcttagctggctgcccaccatctgtgcctcaatatttttttgttggtttattttttttttttgagatagagtttcgctcctgttgcccaggctggagtgtgatggcgctttctcagctcactgcaacctctgcctcccaggttcaagcgattctccaacctcagcatcctgagtagctgggattacaggcatgtgccaccacgccctgctaattttgtatttttagtagagatggggtttctccatgttggtcaggctggtctcgaactcccgacctcaggtgatccacccacctcagcctcccaaagtgctgggattacaggcgtgagccaccccacccggccttgttggtttttttttttttttttttaagtttatttatttttttgagacagagtcttgttctgtctcctaggctggagtacagtggcgccatcttggctcactgcagcctttgcctcctgggttcaagtgattctcatgcctcaacttcctgagtagctgggattcaggggcatgccaccacgtccggctaatttttgtttttttgtgtttttttttttttttttgagagggagtctcgctctgtcatcaggctggagcgcagtggcgcgagcttggctcactacaacctctgcctcccagattcaagtgagtctgctgcctcaggctcccaagtagctgggattacaggcgtgcgccaccacgcccagctaatttttgtgtttttagtagagagagggtttcaccacgttggccaggatggtcttgatctcttgacctcgtgatccgcccaccttggcctcccaaatttctgggattacaggcatgagccaccacgcctggcctaatttttgtatttttggtagagacagggtttcaccatgttggccaggctggtttgaactctgggcctcaagtgatctgcctgtctcagcctcccaaagtgctggtattacaggtgtgagccaccatgcccggcctacttattttatttttgagacaggatcttgctctgtcacctagactagagtgcagtggtgtgagtcccctccagttcttggcctcaaacaatcctctcacctcagcctccggagtagttagaactacaggtgcataccaccatgcctggctaatctttgtttgtgtgtgtgtgtgtgtgttgttttttttttgtttgttttgttttttttgagacggagtctcactctgtcacccaggctggtctggaactcctggtctgaagtgatcttcctgccttggccttccagagtgctgggattacaggcgtgcaccactgtgcctggtgttattggtttttttttttttttaaataatgagcaaatgtatacctattataattaggaaatttagtttatggaggaaaatctcatttttctatctgtcacagaaatatgatctactttgcatgcttgtttgaatgttggaaagagtgaattgatctattaagttaggaaaagcatttcaaaaatacttgtactataattataaggtggtggtaatagtgtggccactacttctgtttcattattcaccagttaataaataaacaccttgttttttagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcataggtcagtcctagggaatgtgtatttctctctcactttgggctacactgaagcagggaattgaattcttagtcatttttgcagtcctagtgactgttctgttcagcagcagcagccagaagttgaattggtgcttgttgcccatgtttcagtttttcacaaaacactggggctcatatactggtttgtttcacacagtatttggctctatcatgtggctatcagtgggtttaattccaagtgggaatatggtgggtgtagagggtcacagtacttggttatcttttaaatggctgtctcggagtttcttaggtacttgaaagccagattctccttattttaacttctcagtacttttggatttttggtgaatcgaatctacaattaaaccccttgggtacttttttatatctcccatattagtctgttaggttgttattagaaagttcagattataggccgggcgcagtggctcacatctataatcccagcactttgggaggctgagaaaggtggatcacctgaggtcaggagttcgagaccagcctggccaccatggcaaaaccctgtctttactaaaaatacaaaaattagccaggcatggtgacgggtgcctgtaatcccagctacttgggaggctgaggcagggataattgcttgaacctgggaggtgaaggttgcagtgagccgagatcgtgccattgcactccagcctgggcaacagagtaagactctgtctcaaaaaaaaaaaaaaaaaaaaaagattcagattatagtacgataaactactcagaaaaagtgaaagttcctaacatgaagtagcatttacaagctttgagaaataaaatggttgaacactggggcctgataaccactgcttttttaacctctgtggtttattctcttgtagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaaggtatatgatgtttttcttaataccagtaacaaaaagaaggacagaaaaaaagctgactttgctttattgttacgtgttcagcatgcatttttgagtactagatgctagtgtggtggtagacagggtataatataaagctgatttggtcagatatttgtgtggtaacgatctttaacctggccatgaagggaaccctctgcttctgtcatcttaaggcaggcattcttcactcgagggccatgaacctaatgaaaaggtataaatgctgtttgttagggatggggtctgtggtataacagattcttagaggagttcttaactctagaaagttttagaacttggtaccgtaataaattgttgacatagagctttgctgtctagaattagagtgggatttactatttcctcagccttgcaattctgattttaatggcagagttctggaaaaattaacaacatggaaaggagcaaaatgtaggatgtagcacaatatagcgtctggaaaaagggaataaaagagctaaaaagaggttactaaggcctgttaaataaatggcctgtccccacttcttgctagaattcagtgaactcataactgcacttagttggctccagtaggggcatgttgggtttgtaatattatctttgttctccatacatctccagggaggtcttcaggaagttgctgatcagttggatttgcagaggattggaaggcagcaccaggcaggctcagactcactgctgacaggaatggctttctttaggatgaaagaggtaagcttccttgaatgtgatcacaggcctctcggcagtaacttgctgaaggctaaggaggtagtggatggtctgttatgtgggctgaggtttgttgaacatttattttttatttatttattatttattttttttgagatgaagccttgctctgtcacccaggctggagtgcagtggtgcgatctcagctcactgcaacctccgcctcccgggttcaagcttttcttctgcctcagcctcctgagtagctgggattataggtgcccgccaccatgccctactaatttttgtatttttagtagagacagggtttcgccatgttggccaggctggtttcaaactcttgacctcaggtgatctgcctgccttggtctcccaaagtgctgggattacaggcatgagccactctgcctggccgaattttttgtatttttagtagacacggggtttcactatgctggccaggctggtctcgaactcctgacctcaggtgatccgcctggcttggtctcccaaagtgctgggattacaggcgtgagccaccacgcccagccacatagactgtttttttagcaagttgatgtccactttgaaagtggttgttttttgttatggtattctgcatgtcacatgtttgagaggcaaaagcagcattctgacgtgaaagccactttccagtaaccaagtattcttgagcacacccaagtccagaacttcatgttcttgtcagctctaatcctttcagttatttgctttttttctgattcctgtaatagaaatatatttgttaggccacctactgacattatggtaagttctgttaattattattaaataaatactatattgaatttactataaccccttagtaaaaattagactcttaatttcttcttttagtttctttactcactgactcaggttttaaaatatattcaaagatgtagaaggagtaagacgctgctttgaaaaattgaaatattgattttgttgacacttttgaggaccggatcagattaattgatctgtagacatggatctcctttttagaactaagattgtagagagggagagtacatttcctctttgttactcttaattataaacaactgttaccatgtgttggtaaatgttctaggtcagtgattctcaactggggatgattttgccctggagggtacatttgttaatatctgtagatgattttggttgtcacaatctggtgggggagagtggtgtgctacctgtcaggatgctgctaaacatcctgtgatacactggacaagttcccccaaataattatcctaccccagtagtgccacagtggagagatcttgcgttaagtgcttactgttcgttatctcattcctcataataaccctattatcctgttttatagatagggaactatggcttaaaaggagtttaaatgactttgccaaggtcaagtgagtccggctgaatccacagcccaagcccagcccattgctctgcctgttaaagagaagggagcagttgtgttaaacagcagcagcacagagatactggcagtaaaagaatacatggaaagtatgttcagataggagagcctttctcctatagagaaaggagcatgaaaagactgcattaaaaggaaaggtttaggccgggtgcggtggctcacacctgtaatcccagcactttgggaggccgaggcaagtggatcacttgaggtcaggagttcgagaccagcctggccaacatggtgaaacctgcctctattaaaagtacaaaaattagtcaggtgtgatgacatgcacctgtaatcccagctactcgggaggctgaggcaagggaatcacttgagcctgggaggcggaggttgcagtgagtgaaaccctgtctctttttctttttctttcgagacggagtcttgcattgtcacccaggctggggtgcagtggtgtgatctcagttcactgcaacctctgcctctcgggttcaaacaattctctgcctcagcctcccaagtagctgggattacaggtgcctgccaccacgcctggctaattttttgtatttttagtagagacagggtttcaccatcttggccaggctggtcttgaactcctgacctcgtaatccacctgccttggcgccccaaagtgctgggattacaggcgtgagccactgtgcctggccgagcctttctatactattagtttttttttctagtttggtatattttcagggctttaggaaggctgggaggtggtgatgtggtagtggtttttttcttttttgagatggagtcttcgctatgttgcccaggctggagtgcagtggtacggccttggcccactgcaccctctgcctcctgggcgcaagtgattcttccgcctcagcctcccaagtagctgggattacaggtatgtgccaccatgcccggctcatttttgtacttttagtagagatggggttttgccatgttggccaggctggtctcgacctcctgaccccaagtgatctgcccgcctcagcctcacaaagtgcttggattccagacgtgagccattgcacccggccagatgtgataatatttatacttgtcatgacttctagcataactctcaccatggttctctgtcccattctgcagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcattaaggtttggtctttcatagctatggattgctggctctggaagatggtcatttgccatcagtgaaataagagcatcttgcctccattgtccccaagttggcttacatacaaaatatcacttggggggtgggttcgggaataaaaaaaatacatatcacttggtaggaagcttttcacgagcacctgtgtaaatggaattgtctcttcatactcaagattgttgggtcttaatattatagaattaaaccagtctaatatttcctggggtcactccactatatatggtggattagcttgttaattagtgggattcttttaaacaacctgaacttcagatatcctagagttggctcaagactttgtttccagccatttctgttgacacaaaatatgtggggttttaagaagtctggtacaggggcagatatggaattgtgactgggaagttgacaaaacaagagatttatcactgtaatttctggtgaaacagcagtcagtggttctcaaccagggtgccctggcatgctggtgactgtgagcgctatgcagatacccttccaaatttgaattaaagcaggacatttaatattttctacaattaaggacttacttacatgtcaggagaaatgctcaaagggttgaggaactcagtgttgagtgtggggtttggtcatcattgcatgtgagagttaagagcttagagtagtgctttagcaagaaagagcacaagtcttggaactggcaagaactttgtgtgtatgagtgcatataggtctatgtgaatgctcatcctcaaaaagtgatggcactgtagggtaaccaagagaatcacttaaggtgtaattctttcgaggtttagacagggtctcactcggtcatccaggctggagtgcagtggcatgatcttagctcactgcaccctcaccctcctgagtagctgggactacaggtgcatgctaccatgtccagctaatgtttatatttttttagtagagatggggtttcaccatgttgggcaagctggtctcaaactcctgacctcaagtgatttgcctgccttggcctcccaaagtgcttacagtcatgagcccccgtgctggcttgtaattcttttttttttttttttttttttttttttttgagacagagtcttgttctgtcgcccaggctggagtgcagtggcatgatcttggctcactgcaacctccgcctcccaggttcaagcaattctcctgcctcagcctcccaaatagctggtgccagaaacagtcagttcctcttcaaacttctttgtttcttttagcgactaatgtcatttcacattgctagaagatacattcttgttctctaaacaagcctttccatctttgccatgcctaaacatgcccaaacatgccttaacggacaatccctccctcccctcctttcttttctttacaagttacgcatttaggctgggcacagtggctcacgcttgtaatcccagcactttgggaggccaaggcgggtggatcatgaggtcaggagattgagaccatcctggctaacacagtgaaaccctgtctctactaaaaacacaaaaaattagccgggcatggtggtgggcacctgtagtcccagctacttgggaggctgaggcaggagaatggcgtgaacccaggaggtggaggttgcagtgacccaagatcgcgccactgcactccagcctgggcaacagagacagtctcaaaaaaaacaaaaaacaaaacaaaaaacaacaagttacgcatttaaatgtttcagtttactctgtttggaaaagttttaccactcctaccccttcttccccatctaccctatttggaaaaatttcaagttttagccaatcgggttagcttacattgtgtggtccgactacagccaatggggaaaggacacagaaacagaagctgcattagggataaaaacttttctcctttgttcagtgtgctcttgcgatcatgactgttgc

SEQ ID NO: 15984 - DNA, 22581 bp, Human
cataaataaataagtaaaaataatagaagtgaagagaaacacttgctactttttagttgaaactagaaatggaaataggtaaaggcacaagttctgcattccagtgtgcctcctgtggtagcaatagcaaagaaacactgtcgcacaacaggctgagtaggagactgtcacagcatccagtctgcttaccttagtaagaaaaaccatacatgagccttaatgttagggcatcagcaacaattgtattcctcagacagttaatttagacagagcccaattcctactacatctgaaaaataagatcaatgtcaattttcatggactaaaatttgttcaaggtttaaaaaaaattacaccagcaatgccaggtttttcatatatttttcctaaatgacattcagaaattttactcatatctctgtggaaatcacagtctgccaactcttttaaatgcctatttttattatcctttacataaaactaaggagttgtcaaatatctttcagaaaaacaaaatgaaaagaatttatatgatatatataacagtcatgaggctaagactttatatagacatttaattatctagatcacttattttcctatcttttgtaccattatgtttttctcttttaaattattctttccccaacatgcaacattttaggttgttcacaattcattgtaatcaatttgccatgccctttgatcttctctttttctctcttttcttagccaatttatgagaccaggttagccacatatgttgagtgtgtggctctccaaaattatataccacaaatggcataagtttgaggaattcagataactgtggcaaactctaacctcagctgtacccaacaaaaatgaaaaagaaaaggctttccctttcttaagcccctaaaaacattttaatagaaagcagagttaaagtcatcctgccacttcttctttttacctgtgtgggcttttcaagacctaaattctctaggtctcatcatctttctctttctttttatttatttatttattttttagaaaagctatttgccatagggaaatccatttttcggattggatatataataaatacatgagagaataaggtatgcctaaatgggacaaaccagaatccatgtaaattttgaacctcacctgcaattttgaaagtcctattaatttaaaaaatagtaaataccttaattttcatgatagcttactgtaaggctccctagaggcaatgaaaatgggaatctcaataaaacgaatactaccatacatcctggcttcagagatgaaaacagagggagaggattggctagttatcaacagaagggtaaggaaaaaaagcacagagaaagaacagacaaggcaacaaaagtggcagaactgtaagggccaatacgcatccactgcttcaagtttttcagccatgttccattctccgagatttctggtagtgcttcaagaatactggtctccaaactcttcctgaaaagggctaggaatgcttctgcctgaagatcttacctattctttctgggccccgtgatctccctacatgattgatcaacctactatttcaactctttcaagccttttcacaaatgtcaacttcagtgaggcctctatttaaaaatgagcaccctacgaaatcctttcctcatttctgattatcccctgtgaatttacatctgcctactccgtaccctcagtttatgccccttgaacactcttgccgggcgcttctcctttaaatcttgcctggaaggggcggagctatgtcccagactcaccgagaggagcgttctctaggctccgcccacttacgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagtaagtagtgtgctaaggtagtgcgtggcaagagccgttcacttgtcaagagatgatgttggggaaggtttttcccagtagccaatgcggagaaaatgggaaaggaagttccaggcagtcagaaccaccgttcagagtgggagggaggtcagaagttacagagatggtgcgtggacgtgtttgtggtcgtatgtggccgaagttgagtacctgtgcaggaatggctggggagggtaggaagggaacttgtaagtggaagtgaggcgtttaacatttccactgaaaggatgaggaacctttgaaatatttaaaatgggaagctaaccttatcagatttccgttctggaaacagcgctctagcaacctcgtggtgaatgggttggatgagggagggagaccagagaccaagtacaaaccaagtgactgaagatggtttggactatggcccgctagccaagttccttctgttacagctctcggactggtttaatctttcctgcaagctccactccagcaagtgttcagtgcctccaaattaccgatactgagttactttactttctacctttaattcacatctatttcatatcactgattttagcacctgaattagtttcctaagggctgccttaaaaaaatcaccacaaactgggtagcttaaaataacagaaatttattgaaacatttgctgtttttttacaacttgtgacgtaatgactgaccgagaaacggatgttggaagctttccaatcatattttaaaaagtctgtctactttttaatttataaataatgatatcacaactgtgagcatgtgcacacagcctgtcatgattgtttatactttaatgaagcaaaggtctagctgacattccgaaaagtcgtgaaatgatggtacagttttagtttattaaatattttcctacagctattttgtgtaatgattagcgaatctataaagaaaatgaggcgtgatatatacccttcgttggatatataaactaaatttaatctagatagagaaaaatgttttacaattgtttaattcattgaattcattgaacttgtgttgtaattgttgatctaaaggttcttccgaatgatccagtctttcttgagcctcatgaagaaatgacactctgcaaatactatgagaaaaggttattggaattctgttcggtgtttaagccagcaatgccaagatctgttgtggtaagttacagtggtgatgaaatataatgtcctttagttggcttgtgaaatttgacctcttctaaattccctgtccactcaagtcttaaaaattcaccttagttacaattaattagtttttggcacattatatatttttcaatacaggccttaaatcatgagttgctgtatcatatcttcaaaagtatttcaagtctcactttgtggtcagaaaaaaatttgaggtcaggtaatgtcataaagaaagaaaaaaaataaattactttcctctaagttctcaactaatgagccataggactgggactagaacatagactactgcttttccaactctgtgacacccaataaatgtttgaaataatgcattcattcatcattggtaatcatatgccccagctgaaactgataccataagatttttttaagccttgattagtagaagctggagttttatctttggtgaaaaagattgccttattgtttcagatgtatggttctgaggacctatttgttttttgctggggtgggcaaccgtgaggagaaacaggtagctgagattaaaaagcagaaagataaaaaaggtagagtgggagggtgttcaaaatgttgttacgttattctctcactggtttgttgtgaagaccaaatataaaagtatatcttaagtaaaagtctgttaagttttaaagttatacagcgtgactagcttacgacccagtagagaataattttctaggaaattatctccatttttatagttgaaaaaaaaattgaagtatgttgaaaatattaagtccatagaatttacaattttttttcatctgagatgtcaaagattcagagagagttttaggtatacttgattagtttatatcttcagatttggcttgttcttacaaaagaactgtaaaatgaggcagtaaatttaagtgatcttatcaaatgaagaaaaaatcctttaatgaacttctttatggaatttatttttaaataacatgtttatcattggtgaataattttttgttttacataatgacaaaactaaacttttaaaatacttaaaaggaaatattcttttttctatcataaaatagataagtggttatttcattggttccagccaaatgatataatggttaaaagtacaggcaggtcttacttgaattcattcctgttccttattagctgtgtgacctagataagtcagttaacctcattgatactcagtttccttctctgtagagatagtaatacttcaccaagctgttgtaaggattaaaacatgatgatagtttcgtgtttagcacagagtctggcacatggtatacattcaataaatggtagtgctgcttctgccattcagttggcagcagtgatcacaaatcatggaatggatacatggttatatcacaaatatggagtggctttagagagaaggcttattgccttgcccatgtttttttgtcagtatttttataagattggttaatctgtgaacgtttgtatttttcttcctgaatttatctaattcagaacatttttgatagtctgatttctaatacacacacacacacacacacacacacacacacacgtatttttaaatccagtgaccataggaaggattagccagagtaggctggggatagacaagcaaaggatgggaaagaatcttttggctatggcatttctgtagtaattcatcacaatttgttttgattaaagaagaattaatgagtattagtatttttctgggtaatctctacaaagaaacctttccataaataagttctgtttcacaaaatttaacatttaacatttgtgactagatcctgatgatatattttttttaacccttagggtacggcttgtatgtatttcaaacgtttttatcttaataactcagtaatggaatatcaccccaggataataatgtgagtatgtctgtctaatatattgttttcatttaagaagacctttataatcttttgagtattttttgggaggagagaattgtgagagagagagagagagaactgacttcctaatacagggtaatttagacttgaattctatttttttttttttattcagaacttgagatctctgtttacctgtacttcagtaattctgatggtatgtgaacttcagcttgtccagattcaaattttgtttttctcaaattagctacttctctaacatctcttcctattagacacctttgttcttccagttgttcagactgagaatcatttatagtggcccctcccacatccagtcagtttacggatcctatagcttcatactcatttcagttgaacaaaggtctgttgttgctgctctctgctgagcgctgtgtctatcattaaaaatgaaattagtatgaaactcatcaaagagtttgctctcaatgacattgtacctgttttctcttttttgattcccatttccaccagtcaagattaggcccttgatctcactgccaactgttttttacagtagctttcttactgttttctcatactgaacagcatgaagtggccaggtgaatttcacaagtttgtcccttaaataatagtcccttattcagatgcccttagagacttctgccgatggccttccacaatgttcctttaacctacttttcttcccatacttacatggtacatatgtgggtactgctttatttttaactcttccatctacattatacaaagtactcttattcctcagttaatttgtttttccagatatttaggttgtactgcataacactgtcattgagtcagtgatgtttgaatgccatggcaatattggtttgacctaattttatagttgtcttacgtctcctaatgaagtgtgaacaggaagtgtcttttaaaaaacaattcttgcaatgtctagcagtcgcttttgaatattaggcaattatagaatatacttttagaaataaattatttagatacttctcaaagtatatgcatgttcttccaccccacccaccccctgcctcctgcctccttattttttcctctaggctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaaggtaaacttgatgtaaaataaactaatactacattctcctttcctattctttaacaaaagaatccaaaattttaaaactcataatcatcctcgttgttatagcatggatacaacctgtgggtctggcctggtcatctagggcagttgttttcaaacttcagtgggcatcatcagtcatctggagaaattgttaactgagattgttgggtgggacttacagagtttctgatttaagtgatctgcaatctcatttaagtgatcttcattacatccagggatgtaatgaagaccattgagagtttagaacggtgcttactataaaggcttaagataactcttctaactttgaattatattgtcatggatctgggcctgatttaaaccataaaaaattcttaaactagaagattgctaagtgacttatatttttagaggtttgtgaacttaagtcactatgtaggcatcaataatatacgtaaacaaacattgacaaaagcaacttttttaagttgttttgtttggctctaaaagagaagttggatagtctgagtcgaatcaaatcaggaattggttcattcatgttagatcagtggctcaatttgggtaccttctatgtgccaaactttgtgcttgaggatgtaaccagaaataggacaggaacagtctcaacttttgtgaaccttacaatctaaaggttttagacaatcatatatccagtgtgctcaatgatacagaggggaaaatatattttagagggagataacagattaaggggtaaggaaaacattctgagaacgtatcatttaaaataaaattcagagtaggaataggagagagaagaacattccaatcagagacttccctggtaaaaagctcaaattcaagaaaccattccgtgctgaagagcctgaacagagcctagcaatgcagggggaagagatcacagacagctgctgccagagtggaaggcagagtctagactgtggagacaatgttacagattttgaatacagcaaagagaagctagtgaaaggtttaaatttagagagtggcatgattagatttgcagctttaaaagatcatgttggcaaccttatggatcaggtatttatcgcgcatctgtatgtgtcaggcataacgtggagaatggattagaatagattaagtcaataacagggtaccgttaaaggagtccaagcaaaagatagtgctgggcttcactcgtatgaaggttgtggatacagaaagagcttcctgggcttcagagatacaggatgagtatcccttatctaaaaaatttgggactaaaagtacttgggattacactttttttttttttgattttgcaatatttgcattgtgcttactggttgagcatcccaaatccaaaatctgaaatgctccaatgagaatttcctgagtgtcatgtcagtgctcagaaactttcagattttggagcatttcggattttgaattttttggatttgtgatgcttagcctgtagttaggtagaatcaatagaacatgaggattgattgcatatagagatgaagacagaggaagaacccccaggtttctgactgggtgagagtttttttgttgttgtgttttgttttatggaagagactgatgcacatttaaatactgaggcaaagagctagtagtgagagcaagatgaaatacaaaatagtctctttggagtaagatggaagggggttggcatgggatttggaagcaaggtataagaactggccttagagggaataatagctctttctcttaacagtggaaaaggggaaatcatgggttaggatactgttatgcctcaggatttggtgttgacaggaaatagcgcctttctttggtaagagatagttttctgagagtgatggagtttctgagaattatcaaagacattaagacagatggaaaatatttatgcagtcactgaaaaataggagagtcaattgtctgtggaaatactatggttgcttggcagtgtttaagagccttgctgaggtcaatgaacatgagtttatagtaacattaccagacttctgcttgtatggttttctctggcagccctcagaaatcttggtatagttgcaaagcgaaagtttgttggattcaaccactgttcagtttctggttttgccagaaatttgttggcagcatattggggcagggaattcaggagagaaatgaggaccagaggacactggtgagtgggagcaagtagagggataagtgagcaaaggttcagaggagggagaacagctgtgaagtaaatgagtaaatatattagaaagggaggcattgtggtcagagtagtgggtctgaatttgtcatatcacaggtgaggcatttttgcataattgactctgaatattttgtttcagagtgtagaaaagctttcttagtgctttaggtgttgcatatggatatctgaggacttaggatttatagtttattttatagggtatgaagaactgtcaggaaataggaggtcttccacatctcttgggcatactctaaaactttttctgtgggaattcgaagtctagtgtgttctaatcaaatcgagattcatttttatttacttcttcctgaaagcaaattttaaatagaaggaatttcatataaaaataaggtgtattcctacatgtggccttacatttgaatcacctgggttgcctgagagaagcatttacctgggaatatgtatttcttggccctactttagactcaatggaatctctaagagcttcccttccctccccttcctactcaggtggaaaaggaccaagagaagggattaatgtaaattgaggacagtgtcaattactgtgctaggaactttagatatgttatagcatatatttcttaataggagttgtgtaatttttaaactgttgttatactccatttaaaccctcagaaatggtaacatttgcaaactttctttgtagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaaggtattaattagttttttaacttaggtcaaattcagtcactgggtttatttattcatagaatcatttctgactgtaatctttaatattctttgtggctgggatggttggtgagaagaagaaatgaaattgccttttgaggaaatctttaaacatcatgaaaaatactgttaaactaagaggatacatttaggattaaagtagaagtaaaccaggtgatccttgaaagactgatatagctatcagtatatgacaaatttagaagttcctgtgaactggtgagcaacttgagtgcagcaaatgtctgccttgttttatctttattccccttctgtagagcatgtatgacacgcggaagttaaatattgttaactaactgaagcacaagctagcagccaattagacatttttagtttctatattaagtttctcaatttatgacctttgaggttctgcttgatttcattcctagaaatagctgaggaagaaagatgataaaacttcctaaagttaattaaaactattttacatgattataatcccttatccataatttcagaatccattgataaggtggcagcaaatagagcagattgtatttagtttttatttcacttaataggaatatttgtgttcccttgcagaaatcttaatattcctgattacagacatcacttgggtatttcacatttcataatatatacaccagataacttttctaagacatgaatacttattaataagaatttcgcaacacatctgcatctaggataagggattgtaggtttatattttatttatgatatgcctgttctctgcaaacgcagctcaccaactgtatataaatgtatacgtttaatcccaaagtgatttatatctccacttatttactaagcaaacatttattagataccttctatgtactactatgcactgtactacactttaggagtatgaataagataaatctctgtgttaggaaagatagtcatgtaaattactgatgtatatggagttaagatgtggacttccattaattttgtgggggttgggtggttattttttttgagacagcatctcactctcacccaggctggaatgcagtggcacagtcaaagctcattgcagcctcaacctcccagcctcaagcgatcctcctacttcagcttgctgagtagctggaaccacaggcacacaccgccacaccttggctaatctttttgttttttttgtagagttggggtttccctatgctgcctaggctcatctcagtcactcctagactcgagtagtctcctgcctaggcctcccaaagtgctggggtgacaggtgcacaccaccatacctggcctgcagacttcattctgtaagggaacaaaagtcctcttttccacaattcaaataaccaaaagtttgattaatcttgaagcattgtatatagtgcatctataaattcttcagtgaaggtccaaatgaatttatttcatcttagaagtttagttcattataattccaggaaggcaaaattgaaattgccatacctttggctccttgcaaatttaataggctttcgtaacattcccagagactagacattgggccttttttttttttttttcctttagggaaatgctttccaaacgtttttaacttacagctgatttacaggcaaatttttgggatatgtggaaatgagctttacatttattgctgatttcaaaagggaaagcccctgtgctgttgtcatagtctggataatgcctcagattattaatcataggattattaccgttatttctggattttcttctctttcttgcagatttagagctttatttttcatctgctactttaggtattcttattgcctgtggattttattaaaacaccacaatattataagttcaaattcaaaattgaggttaagagttgctaacttcacagagataatgagtctagtcagccaactcttagcaccaaacctatgacccttatgcttaagaaatcaaaaggaaatgaagagtaaaaataaaggaagatgacaaaaatgggaggaattttaggtaggagagggaaaggaaaaaactagttattttgaattactggtagccagaaatggattagttgtcaggagatttcctgattttcagatccaaaatttattcccacagtagatgatgatgatgtaatatcaaacagttaccaaactttataataaaatttaaataaatctggataaagacagcaacaagagttcttaaagcattgctttctatttttctaactattacccccaagagaaaaataagttttttgcatttgtgtttgaaaaactatttaacattttgagaatctgttcatttcgccttttatcaatcataggtcaagttcaggtatgtaaaacttcagagtaactgaaattttaatatagaaattatattttcatactgtcagtggctctgagaaaaacaggtaatttgggttttatatcacattgataagtaagtttaacacctttgatttggacttgatgcaaataagatgcaatagatttataaagcattaggtggtagtcttgttggtttgaatgtctgttactccacagaagtgcaactatagataaaatggctttcatattaagggaatagagaatccttactagtgccagattccagttttgctgcttcctagctttattactttgggcaagttacaagatcatgacttgttcatccctgtaactcagattcctcatctgtaaaataaggttagccttattgggcttctatattaaaagatataaatgttataagtactggctattactgttgctttcatactattttccctctgaaaggttgtacctgaatgtcactaaacttaaaggaacaataaacatcttttaatgtaagtggtaataaatccttaaaatataggagttacagattatacattcataaatttaaaaattttttaattgcctttgatgaggatggaggaaaataatttatgatgtcatgttttctcaatgtgctgtatgttttcaatagatttttttttcttttctttactagttatttatcagagagtctgatgctgaaagagaacagaacttgcctgtcacagttactagatataatgaaaagtaagtaaaagagaacactttacaaaatgtttcttccaatacaaagctcctttctaaataaatctcttggtgtttaactagaaatataacagatttttgtttagatttcttttcattgaattactgtattatggaagcatgaaagacacattggtctagaacaaatagaaggtatatagaaggaagtagtgttcatttatatagaacttatgcaaagagtgaaaatagagtcagatttagaaaggatttagagattgacaacaggatccttttaaagaataaagaaacatactaggcactgaaaaagatgtaatgggaaataacttaaggataatgtttaaatttggaacttctattttgtagataaattatttttttaagagaaaggtagaaggagatttgacacactcagagaaggcactgttaagacagcagagaaagaattaaagatgcttgccttgaaaattggagtgatgtggctgcaagccaaaggaagctggcagccatcggaagctggaacaggcaaggaatggattcatccctggagcctccagagagagtatggcccttctagcaccttaattttggcacagtgaaacatttcagacttttgggctccagaactatgagagaatacacttccgttgttttaagccaccacttttgtgataattttaatagcaatgtcaggaaactaatacagccctgcgtaatcaagacttatccagcccaaaaagtcattagtgctggtgttgagaaaccctgtcattagtgccggtgttgagagttgagtagaatctctactttacttattggctggattagccagcattctccattcttgaccgtggcacacttggtcatggctgctaagctactctttggggttaaaagtcgatcatgtttgtttccaaaccttcttgtgtaaattgttcttgttaattaaatgtgtattgtaattaaatattaaaccagtagaatataagattgaaatcttgattttcgatgacagtaaatgggcatacattttatatattttgtgttttaaaatttaagatgcttcagggcatctatgtatcatttcctgattctctgctcgaagtgatcctgagggcttcctttgagaatgatggctgtgatttatgaattataaactgtaggtctttagttataccactagggggtacactttaaaagctaattgtgatttgactgtagctgttaggatcatagaatttagtaggtaaaggtcttattccactgtactcatttcatagcttagttttattactgatttcttctcaatacctttattttgctccacttgttttaaaatgaaataaaaacagctcttcataaaacactcagaagtttaatgctactaagatatttgtaatttttggaacatagatactgtcctaagggtgttgagttacaagtattaattcagttaaaaatactgctttgtttgcattatgaaataggtcagtagtgtagtcatttggatcacatggctggctaatagtaataataagcccattggatctctcatcattcccctaatcttgaaatttgtattctttggtttattatagttgaataacaagatcagctagaggatgtttttgcaattataaagttactgatacagtagtttgcttttaacctaaagtggacatttttgtatagggtttgcgttttgttaaagcaaaggattattaacaaatttttactgagcatcctccctttattgcatgttgtgtaataacagtttcctttgaaaacaggaagtatatgcttggcccactgtctatggaatagaatactacgaagatggttggtgatagagaacaaaacatgttcactaaatcatttagggattttttttttaagtcttaaaactgaacaagaagtgaccccagtaggatttgccaaaaattaatgctagattatagtgtgctttatgctgtatatgatatgggctaaacagcagagagccataattacttgaactaaacatacagtgcttattggattttaatgtagaatgaaatgcagaatgatgcaaatcctgagaataaccatgtcatttgaagagtgttgtttcctatgacaaaatggaaaagtaaccagctcccttactatgagaaggaggtttgcttattcagtttaaattctttttttgtatccacataggcatgagaaacttagtaaagaagtatgaaccacccagatctgaagaagttgctgttctgaaacagaagttggagcgatgtcattctgctgagcttgcacttaacgtaatcacgtaagttaatgtgacagtgttaatcaatagacataactgttatccagtccagctggttcgtaaatcattttattggtgtttgctcattagaggaaagctgactgatccataaaatcagattttctttattgaatggacatttctaatgagattaaggtaatagttcggcattcactgtgcagttctgatcctgctgtgactcatatgttctttggcttgcaggccctgtcctgttctgttacttctcatgggatttcaggggtcagggtcttcctaaggaatccttttaccttttcctgtccttttaatcttttgtctctttgaagttgtgatatctggtctgaggaacaaatatgctcttccagacttctgttagctagagtagagaaagttggcatacttcttttttttttttttctttgagatggagtctcgctctattgcccagactggagtgcagtggcgcgatctcagctcactgcaagctctgccttccaggttcaggtcattctcctgcctcagcctcctgagtagctgggactacaggcgccctccaccacgcccagctaattttttgtatttttagtagagacggggtttcatcgtgttagccaggatggtctcaatctcctgacctcatgatccgcccaccttggcctcccggcatacttctttcagtgacaaactttatagtgaccacaaagccaataggaaaagaggccatgtaatttcttcttgtggctagccataagaacacctttaatgtctcttaattgatttgtaagctgaatgtgaaaatcaccataaaattggcaatttgtgctttgcaaattgaaagatccactgaaactttcttttttaggtgtttaagcagttgggaatttggacaggtactaggattaatgaaactgccattttctatttcctgtgggatgcattttgttacttaaagttataccttatttgttaaaatttaatgggagttatctgtggcatcttatatttaagatgtatttgaggtattatttctgtaattggtgaatatgtgctgctggataactatgaaaagccagaacagcaattccaaggcctttatgtcaaatacacatgactcaaattccttacctatacagttgtagttggggaatatctacggacttaggaagtgtgcagaatatgaggttgttttattatagttataggtataacgacaaagcatgttttagcatagaacttgaaattggtggatttcattcactcctcggtttcagtggtaacaggaatttttcagagtggttacagagaagtaatgttgactttaatgaataaaagtattgcagcactgattatgtcctttttgcattgattttgaaatgggattagaccaggggttggcaaactgttacctaccaggcatatccagcccattagcgtttttagaacacagtttcttggaatgtagcacacctattcgtttatatatcacctatggctattttcatgatacagcagaaaagttaggtagttgcaacagaaactggttatagggcctgcaaggccgaaaatatttactgtctctttaaagaaaaagtttatccacccctggattagaccactgaactactaatcctaccctttctagctaagtaactgaatggaccataatccaaaattcttaactgccatagcttacattgtattccagattgccatctgccttgtactgggccaaattctgaatatctatgagtacttgaggggtgcttctcaaactgcgaaggacttttttaaaaaaaaatcactagatgtatacttttgtaaaattcaataaaaaatgaattactagaaaagtgaagacaaaaacataagctcaagttttattagattcagcagtcataaaattattatatcaaattgctattaaaaatttctagggccgggcacagtggctcatgcctgtaatctcagcagtttgggaggctaaggcgggcggatcacctgaggtcgggagttcgagaccagcctggccaacatggcgaaaccccgtctctactaaaaatacaataatcagctggacgtggtggtgggtgcctgtaatcccagctacttgtaagactgaggcagggagaactgcttgaaccctggaggggtcacagtgagccaagatcacgccattgcactccagcctgggcaacagagcaagactctgtctcaaaaaaaaaaacaaaaaaaaaattatgaaacacaattcctgtacttaactcactgcaaactggaaactgttcatggaccagctctggtacttgctaccatgagtagtgctactttaggactaaatatttgttttccttgatcttcaaaattattttacctttagttttcatgacacaaaaactgttttgtcattgtcagtcaatacaagtgaaaccaaagttccctttgatcaaaacccaaatctgtcatgacctcagaagttacttagcagttgtttacctttgccagccttttctctgcacgtatatccatatatttatgaaataagcagcgtttttttcttctttgcatttttcatacatattgtacaatgggtgattatcaatgcttagcttttgctagtctgggtgaaaaagtatcacattggtattttaatttgcattttcttgattatgggacattgaactttccatacttaacagtcacttatatttcatctgtattgcttatttatcccctttgcccaattttctggcttttttgtttgtttgtttgtttttgagatggagtcttgctgtgtcacccaggcttgagtgcagtggcgtgatctcactgcaacctctgcctcccgggttcaagcagttctcctgcctcagccttccaagtagctgggacgacaggtgcatgccaacatgcccagctaatttttttttgtatttttagtagagacgggattttaccgtgttagccaaggatggtctcaagctcctgacgtcgtgatccgcccgcctcagcctcccaaagtgctgggattacaggcgtgagccactgcacctggccacatttttgtggtttgtagtgctttatagattctatatacagtcatccttcagtatccatgggggattggtttcaggactttctgctcataaccacaatccacagatgccctaatacaaaatggcgtatttgcatataacctatacacatcctcccatatactttaaatcatctctagattacttataatacctaaatacaatgtaaatgttatgtaaatagttatactgtattcttgagggaataataagaaaaaattctgtacatgttcagtacagatagaatttttttccttattttcaatccgcagttggtttagtccacagatgtggaacccacaggatacagaaggctgattgtacttatttatatatgatatattatttatatatgatatattctattgtttttcacaacttttttccaaatactaatttttgccccagctcccacaccccgcttttttgagaaaaagtcttctctctgtcatccaggtgtgatggagtgcagtggcttgatcttggctcactgcaccctctgccttctgggctcaagtgatcttcctacctgagcctctcagcagctgggactacaggtgctcaaccacattggttaattttttaatttttttgtagagacgaggtttcgccacattgctcaggctggcctcaaactcttgggctcaggcgatctgacgcctcggcctcctaaagagctgggattacaattgtgagcccctgtgcccagcaggtcccagctcattttttatttcatgttttcctagttacttgaaacacttcttatcacacattaaattcatccttctgcatagtcattactttgcttatctagtctgatcattgatctgtttaatatctcacttttaattaccgtagcttttgtagtgtgctttaaagataactgggacaaggtcctccaacactgttcttttttatattcgctcctattttttcacactctttcctaggtcagtgttagatttgacaattccatgaaaaattttattagggttttaattagaattgcatttaatttaaagattgattgtaaaagtatcattttccctaccccatagctgtttatctttttccatttatcctggccttgttgttcagtagatacatgatattgcctatagccttgctagtttattttacattttatagtttctgtggctggtattggattgcttattgatagttgcttaattataggaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatttccaaatgggtttttaaaaaaaaccagatatatgattttgaatagctgtctacatcaaactcttacgctagtatagataagtaggtagcagcaaattgtatattcagttgtggttgttttttaattttgttttgatgtaaggtcttgctatgttgcccaggctgtctcagactcctaggctctagtgatcctctgcctcagttttctgagtaattgggactacaggcacacatcaccacagccttataattaacctattagatcctataagtgaatccgtgtaagtagattataacagttactaggaattttgcagattaaatatgttagagaaatgtaattcaaattgaaatgagtcaatataaaaatatgaaagcacagactattacagcaaattacttacatatgaatcatggccagctgtatttcactatgtgaccttggtaagttattaaacctctaagtgccagtttcccacactgaaaatggggaagataaaaatgcctactcttcataggattaattagaatagtacctgcatacactagtattcagtaagtgttaactattataattggaaccaaactgtggacgtctgtttaccaagccagatttttttcaggaaaactggcttgaaggaattccgagtaattcaagtgtcctgaatctaattaaattgcacaaatacacacacctcctcagtctcagtacatcccaggctgtactttccagaaaggtaggtaccattatagttacatctattttaaggcaatacttactatatgcatattcatctctctaacaataattctttacactgtaggcttgagttttgtgggttttttttttttctcattccagagtgaaaggaataaaattcgtgatgtgagatttttacaaaagcagagtggaagaagccaaaagttataaatcctccatcgcagtcctagttaaatatattgctgctaggctctagacagaattacaagatgttcacaatttgtctcattttccctttcagatcgccaaactttggcatcagagcaaggtccacacttatcactgaaaattttcccacccagccccattaaaaacgttaaagtgtgagagattttatttcaacactgacaagctagttactagagggcctacaaaggtaagtaacaagtttccatttcaacttgagagacaaatgatgttaaaatataagaagcagggtaagtcaggtttgtgattttaaataaaagggagaaggatttcagactgaggaatgacaggttagtatggctaaagattgaggtgtgataaatgggagccaaagtgcacagcaaaaatatcttgactaatccatatcctccctgtcttctatcatgtaaccaaggaaggagaccacctgggatactatgttggtccaagtccagctaaaaaacagaaggggtggaaaggagagtaatttgataaaagagccaagaagggagagaatggaatgaattgagctgatttcaaggaaaaggagcatgggacatgttgagatttttggtatcagtgttaaacggtgattgaagccacataggttagcagcccccatagaaataactgccttttgtagcttggaactactaagcagacatcttttaagcccttagcatttt

SEQ ID NO: 15985 - DNA, 6729 bp, Human
tgtgatctcggctcactgcacgctctgcctcccgggttcacaccattctcctgcccccgcctcccaagtagctgggactacaggcgcccgacaccacgcccggctaattttttgtatttttagtagagacggggtttcaccgtgttagccaggatggtctcaatctcctgacctcgtgatccgcctgccttggcctcccaaagtgctgggattacaggcgtgagccaccgcgcccggccaaacatattttttttttttgtatttaacttaccacaaagcccatgagaaggcagacagttctgaaaccatattctggaatctctgccctgcaggtccctaaagagttaactcaaagccagatacccaatggaggctcaattaatgtgaattagaagcaacaatgaaccaaatccacagataacattactcacactagattgaaaagtgtaatctagaaatattaagtgtgaaaaagtttctcaattatagttaaatcagaattctttaatatgtaaaggcagtgaacggaatgttaaaaaaaaatggaatgtcacataacttctataaattaggtggtagaggacaccagttatgatgcatttcatgaacccctactcaaaaagaagctacttgttgaaacaaaatatgaatttaagtgttttttttaagtgtttttttgggggggaggggcatggttgttctcttccaaaaactgaaaaaaaaaaaaaaaaaaaagacgaaaagagcatatatgttatgcccttttcaaagcaaaccttaggtcttattggaattgtttcctaatgctatataaatgagacacgtgaggcaatatacactcccccacagatgaataacataacatttaggttaccagggcctttcacaatctaacctaacaccactttcccaggttcatttatcactggtttcttctcaataccttctggtcaaagaccaccagaagcacacatgtaattgacaaacggggtttattattcattgcagtaagggttctctgtaaaatattagaaaatgcttattggatttgggatttttttctcctaatattggctaccttaccaaatcttaggaggaagaaaggctagatcaaggctaagattgtaattggtaaagaagcagaagtcatcaaattaaaccagatagggtgatgtccggtcattttcgtggcttggacaatgttttatctgtgttcagatgtgattacacagtgatcatattcttttcttaatgaacactgtcagagtggtcttgttggatgctaatgcttgctgaaattgtgtacgttcatcaggcggacaccagttcctagtccaggctagctccaggtgtcagaggccacttttcccttctactcctcacacatgctgtactcataccagacttgagttttccctgccctttgttcttccttcttttttattcgattcccattatctttagtgatcattcccttagcatttcagttttctctctgaagtcctttgtgctgcacgttgtttgattacttgtgtttatgctttgtttcttcagctaggatcattagcacatatctctcagcattggcaaaagtcctcgaaatcattgacacctagcatatactttatttttaaaaaagaaagaaagaagagaaaagggatgggtttattgtccttttcaacagactagagtatacggggtgaaactgcttcacttgattcaataaaatcgtttccggtaacaggccccaggaatcctagacctaagcctggcgcgaaactacatttcccacaatccttcgggggctgataaggctccgcaatggtctgaactacaattcccacaatccagggcgatttccgctttgtcgcgtttcctcaaggctccgccccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaaggttagtgtgtaaggggcacggcttcgttgggggagggggcgcttggctgtgactcgcgcacctgcaaggccgcctccgggctgtggcgtgggagatgatagccagaaaccaggctgagacgcagactagcattccacttagcccaaggaccagtgaggaagctgggcatcctagcgcgtagccgctaaaggaatgggcaggtagatccggaagccctgcctccatcagccacctgacgccccctcccccgccccgcagaaagccctgagatggctccgggaggccacggctgtaggtgtgttggttaaatccgagctggaggtcatcggacccgaaatgaaggtcattggaaaatcatgaggaaatcagggcctctggttatggaacaggctttttaaactagctgcctaagttagaagtactaacccttcacctcagttaaggctgggtttggcctcaggtgtaaataacttaaaccacatagcagtaacaatctcggagggtcacaccaggcctagtcataaaggccagagaaggtgcttggtaatgaaaaacaaacaaacaaaaaaaactgtgggccaggtgcggtggcgcacgcctgtaatcgggaggctgaggcgttcggatcacctgaggtcaggagttccagaccagcctggccaacatggcgaaaccctgtctctactaaaaagtacaaaaaaattagccggacgtggtggtgtgtgcctctaatcccagctactcgggaggctgaggcaggagaatcgcttgaacccgggaggtggaggttgcagtgagccgagatcgggccactgcactccagcctggacagagcgggactccgtctcaaaaaaaaaaaaaaagaaaaaaaaagagctgtattgcacttaacattgccatgtatcttctaaggtgactacttaggacagtagttttttcgattttctaaagtaagaaacttctcactatttgacgtttgagtcctcaagaccattcattgcctagtgcttagtaaagccagattatttcttgccatgtagtgttttgtgatgaaggtcataggatttgaaagataaatgtttaaaacgatgttatgatttatggcatatgttaacctgatgatgtaaaatataactagcatttcctgtatacttgtattttgattattaagcagatgatttgagattcaatttcgattactttttctctttttttccaacagaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccaggtaaaactgataaactgattaatgttactctatcttgaacactgttactagaacagtagctgagaatgtgtcttttaaaacactataaacatttccatttcttttagaaagtggtcactgtgctcctagtttttaaattggcttacaatacttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacagtggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcgatcttaggtttatttctatgatttttttttttatcgttaacttggaaaaaatacttttgctcttgccctttgacatagtaaattttttttcccatgattgattaatcatcaagaaaacttaatttattcaaattgaagttgtggttaatcagatatttaggagcttcatttttgttttttttcctctaggtctgtaacctaaaacagaagtgtttgcctcagtaagtgttttggtgaccagtattggtcttatttagaatgaataaaagaatatttgaaattgaatataataccatgaaatttgtagtataggaagtactcccaatttattctggtgctttgactatcatatagcctagcagaaatgggataaaaggtagttctgattagtaattgtatatgtgaatcgaatttattttgtaagtagtgaaatgctgcttgccatttaaaatgtaatgaggtcattacattttaggactttgtgtaagatgtgggacagtaactagctactgagtattttcctctgctcactgttggaataccagtgatgttaaaatgctgtaaaacactccaaactggtagtctgtttggcctctagactttggtgaaagggtgatgctctttttaaatcaacatttaaaaaacagtatttccataaaagtgtatttctggatttttgaaaaattgttctgagtggttctatatctcttcattgaagaaaatagctgtgtaggccactccccactatatcattagatttcttatatggcccttctgtacaactactgatttgctaaaaacttaacattttgatatttttgtttctcgactactgcctcactttaggctcttcaacagtcacctgacaactgcttaattatggtgcaaccttaatttatatgactttgctcatatatcccctgtacttgtatgtcattgttttttgattattcagtgataaatcaggtatcctgtattgagagagttccttgtatggaacataaaggttttttatctttggaaaaagttgaagcggccaggcatgatggctcatgcctgtaatcccagcactttgggaggccaaggcgcacggatcacgaggtcaagagatcaagaccatcctggccaacatggtgaaaccccgtctctactaaaaatacaaaaaaactagctgggaatggtggcatgtgcctgtagtaccagctactcaggaggctgaggcaggagaatcacttgaacctgggaggcggaggttgcattgggctgcgaacatgccatcgcactccagcctgggtgatggagcgatactccgtctcaaagtagaagcaagagtaagagtttaaggttcgttagatgattttggttttcctggaaattatggtaaggcttacctcactggattgtttttgagatccagtaagttatataaaaacttctcacaagtcctaaatgaatatgaattttttggagaggatgttcaaatatatattaggaatcaatagtaacagttatgggtagctaggtctagctagaaaagtatttgagggatatatgtgagtgagaaaaaaacctcctctgcctgtcttgtaatagtacagattgtgccatccccataaaaagccttcagcaggctggctgtaagtgcgtaagtttattgtaagtggtagagggtgtataactgcttagtttctgtgttagggttctctagacaagcagatcaagaggatgcacatagaaaaaattaaaattgtcatctgattctggaggcttgggttgaaaatatgggtatgcccgcgggctgga

SEQ ID NO: 15986 - DNA, 14545 bp, Human
  misc_feature (1)...(14545): n = A,T,C or G
cttatgaggaggattatactgaaggcttaagctaaataaaaggatttttcctatttattaaagcccttttttggtgtgctgattataggtttaacatgtcttgtctctgctgctagactgtgaactcctgcaaggcttttatgtcctcagcacctaatgatccctgataagcactcaaatatttattgaacaaatatgcagccaactataaaatgctgtgagtttctcagtatgtagtgcgggtacatttcccttaagttggtattttctgggtcaggcgcggcggctcacgcctgtaatcccagcactttgggaggccaaggtgaggcgggcgcatcacgaggtcaggagtttgagaccagcctggccaatatggtgaaaccctgtctccactaaaaatacaaaattagccgggcgtggtgacgcaggcctgtaatctcagctattcgggaggctgaggtaggagaattgcttgaacccggggggcggaggttgcagtgagccaagtcgcgccactgcactccagcctgggtgacagagtgagacttggtccccccccaaaaaaataaaaaaataggtatttccatggatacagaaacagatttaatttggtgcctgcatgtgagtgatcagcttggttgggatggggcctctggagggtccaaggctttggaggaaggagagtgggtaggcagttcagagagggacagaaagatcccttttgtgggtaagaaaacccctctgttcatcttcagctacaccaaaggtatgggggctctggtggaggtattctgcacgtgtatctagggtagttactgttaggtacactttggattcagtaccccaggctttgccctagggagggacagttgtcatttcaaggaagactgctttatactgtcagatacctggttcacaccggcttagcagcagtgtgccaccaccccaatcccatacgtaagcgttgaggggtcacagaggtagtgagaatgatgggatccaaggatctcgtctctccagatccactcacaccaggagttaatctctccaacgtcgagctctgagtccctccctctctcgcccgagctccgccccccttccctcttggcggtcctggcgggcttcccctggagggggcggccccagcccgagcgctaggccgggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctggtaagtcccgctccccgcaccaaacttttttttgctgccgagtttgagtcctacgatcggaccacgagctgcactgtagttggtgtatgggggaggaggagagggtgaattactgaatgccgactccacggcttccctaagacggatcagcgctcgcccatttcccgagttggaagacctctcgattttagttgattaaacttatgcagagatggagatgagggtttgcgctccaacttcgctaccccctcccccatttctctgagctctagcagttcccgatactttccctccatctttcaagtatctttggctccctaaaagcttgtcccctcccaactctgccgtggcaaagcccccctccaccaggcacttcgggcccgcctcctccccgttgccctagggaccccgcgatcttgggggccatacactccctccggggctacgcgtcctgccaaccggccgcagacgtgtagctgctgggtcggctgtggagggaggggctcaggctggggcttgtccgaagccaggcgggcggggccgggaaggggaggtatagggggccggactgggcggagcaggcggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggctactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccgtggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgaccctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcgggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaagtccttttgcttgcctctccctcagc

SEQ ID NO: 15987 - DNA, 38653 bp, Human
tggctcatacctataatcacagctctttggaagattgaggtgggacgattacttgaggtcaggagtacaagaccagcctaggaaacagcaaaacccccatctctacaaaaaataaaaaataaaaataacatttcggggggggctcctagcatgcactaaactgtaggaatataaacaatgaataaaagtaggtctccctctccaagaaggcacagtttaagggggaatactgacagaccaacagataattttaatatcatgcaaagctctctttggaacacatccagtggaatttgtagacaaatttcagatcaatttagtaacacctatcagagtttttaaaatttatttttatacaaggtcttgctcttttggcctccgaaagtgctgggattacaggcgtgacacaccgcaccgggctccatatatatcagcagcaaccatatatcacatgagagtatgagaggaataaatgagctactagtcactctatttatattaacataaataaatatatattaatatacacacacacacataggatctctgtcacccaggctggagtgcagtggcacaatcatagctcaccgcagcctcaaactcctgagctcaagtgattctcttgcctctacctcctaaagtgctgggatttcaggaaagagccaccttgcccaggcttcctatgccaccttaatggcaacagaaaccctaggctcagagaggttaagtcacttgtataatttcacacagctggtaagtggtcaggtctagagtccaccacagaccatgtgcttccagttgttttgctgtatacgtccactaaataataatcatagcaaaaatagtaatggtataataacagtggcagaggcatcaggaacagcagcaaccatcatttccaagtgccaggcccagtacgtaagactatccccattcatttatttttacttatttttgagacagggtctcgctctgtcacccaggctggagtgcagtggtgcaatctcggcttactgcagcctcaacttcccagggtcaagcgatcctcccacctcagcctccctagtagctgggactacaggtgcgaaccaccacgcttagctaatttttttttttttttttgagacagagtctcactctgttgcccaggctggtgtgcagtggcacaatcttggctcactgcaacctccgcctcctgggttcaagcgattctcctgcctcagcctcctgagtagctgggactacaggctcgtgccaccacgcctggctaattttttgtatttttagtggagacggggtttcaccatgttagccaggatggtctcgatctcctgacgtcatgatccacccgcctcggcctcccaaagtgctgggattacaggcgtgagccaccgcgctcggcctaatttttatattttttgtagagatggagtctcactctgtctcccaggctggtctcgaactcctgagttcaagcagttctcccgcctcagcctctgagtgttgggattacaggtgtgaccaccgcgccgagccccactccctttttaaaccaatgcacagggagcatctactatgtgcgaggcaccctccattttacagatggggaaactgagttccaagcagcttttgccaggagtgggagcgcaccgtccctgcccagtctctccagttgggcgttccgagaccacctatgtagggtattcggctagcgctcaattaaaccgaaacaccgtcgcagcgaccacaggtgcagaccaccaagtccacaccgccagccgcccgggcgtccccaattagcagttggggcgggaccaagtcctcgagctgccgccgcagcggcggttgaaagccccaccccctgcgcgtgcgcggtgcgcgtcccgtcttcctgctgggcaccaggcgcccgcgaagagcgcgcgcgcttccgccggcgtcgggctcgcgcacgcgcacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggtgagcggcacatggcggtgccggaagcccgggcccggcctcggcgcctgagacctgccccgaactcgcctcgggcccggcctgtgtttggccggagtcccccatcgcggccgggcctggggcgatctgccccgggtcccctactctggctcggcctgagcttacctgccccaggtcctgcaatctgcccgggcctggcctgatctgccccgggtcccccgctccggccgcgacctggctgagttccttcggcccccaactcctgggccgggcagacttgcctcgagtcctccacttcgttcgggaccgagctaacctgaccctgttcctttacgccagctgggtttgctccccctcctgggcccgggctgacctgccttgtgtcccacaatcagtctggcctggagtaacctgccccctgacttatctgagttcttccattccatccgggctagggtgacctgccctggtccctctttcgcaggtctcggtattctgcctcgagttctcctacgacctgggccgggtcttgctcaggccggagcttgagtgacttccctcagtccctttccgggagtatccagggtgacctgccctaatcctgtctctggcctggtccgggggtcctgcccggtctccccattggtgggtctggccgcctgtcccacctcccatctgtggtcgcagccatctgggcaccccacctttcacagtcacggagcgtaggttcgactttccccatgcataggggcgctggccagcggaaggttgaggcagagaagaatttttgcctcccatggaggagcacatattggctggctattaagatcattcaggaagcaggttgtattttgttttttcttgcatcgcctgttgctgaaaccgacctgttacataacttcacaactcttgccttggaaaagttgggtttgagttttgttcttccaataagacagcaataatggctttacataaacgagtctgccacgttggaaacttatttttaatgatgtggatgtttagagaaggttacttaggtattttaaatgggggcttgggttgggagaagtatcgggcatgcatttcctggtcctgggcgctgcttgcctggggtgggagaggggctgggggggtggcgcgtgttgcaccggggtcctggggaatgtcctcatcaccctctggatttcaggttgctttcaccttaggcttgctttgtgcctgacctctcgctcaggtttgttttcctgaatgctccgacaggaagaagctccgaggcttaccttggcacaggtgtcccttggcatatgctggtgtttcagaactgggggaaccactccttgctcatccagagtgagctcagaccctgtccttgcatggggggcttacgtggtagtcgattgagtcactctcgtgggtagaccacccacttgggctttcttttagcccctaatggaagcaaaaaacatttgactcattctaaccccatattccttaaaatagaaggtggggtgtgaggagaacaggtgtgcacgtatgggtgtttttttcagttttgtttacattttgcgaagggagggagggagagaggagagttctcctgaagaagggagtctgagctgcggaggccccacctccttgtagttttcatgccctgtagacctttctgcttccgcagctgtgaaatgggggtggcagttagatttttattccttttaaacataaaggaaacctagatccatgtgtgagtcgactgtatacgctgtctgtaatctgacgtccagcctgtcggggagactcggtaaagatctctgtggagcagtgagccatgagcgtgacagcgcggatcggggggttggctgggtgtgaaaggtaatcattttcttgtgaatccttttaactgtagcgagcataaaacagcaaacctggggcagcctttagttctgcttttgtttctggcattccgtttgggattaattgtggggcatgtccttctctttcagttgaaacaattgattttttttcctgcacctgaacacactgggctgtacaaaaggagagcattaaaacgctcccctggaggtaaacattgcagttgagctcactagaattctgacgacatcagagggtttgtcctgtgctacttgtaattgacccagatgccccacccacctgttacctgtaatttggatttgtttgtggggaatgggagtggtacccctttgcatcacaaggggaagaacggaatttgggggcaaggaagtctatgaatatcattcaagggaaagcggaagaaagttatctcttgtgtgaattgaaggcagtgtctgctaagatatttgggaagactttccctgtttgtcctcaggagttggccgtgtaaccagctgttaagttgggggctcctggaaactctcattctgcttttttaatttttattttactggggaagtggctatcagctgtcaagtgccctgcagtcacttttgcttagcggctttattgaaatagaattcacttgccacaacatacaatttacccatataaagtgtacagttcggcggcttttatttagtatattcagagttgtgcagccattaccacagtaaactttagaacatttttgtcaccccagagataaaccctgcaccccttagcccatccgtcctacctccacagcccctggcaaccactcacctgctttctgtctcaagatgtgcctgttctgggcatttcacatcaacggaatcatatcatatatggtgttttgtgtctggctcctttcactctgcgtgatgtgtgagaagtagctacaaggtgagcttcgtagctgttccctggccgagcattcaggaaaatgaacctgatcgaggtttatccacgctgtggtatgtgtcatcatttcattccttttttttttttgagacagagtctcgctctgttgcccaggctggggtgcagtggcgtgatcttggctcactgcaacctgtgcctcccaggttcaagcgattctcctgcctcagcctccccagtagctgggattacaggtgcacaccaccatgccccggctaatttttgtatttttagtagagacggggtttcaccatgttggccagatggtcttgatttcctgaccatgtggtccacttgcctcggcctcccaaagtgctgggattacaagcatgagccaccgcacctggccagcatttcattcctttttaaggctgagtaatattccatgggtggaatggtccagatggatggaccatgttttgtttatctcgtcatctgttgatggacatttgggttgtttccacctcttggcttttgtgaatagcactgctgtggccatgagtgtacaggtttctgcgtggatgtgtttatagacctgctgggccgcgtagtaaccttgggtttaatggtttcagtaactgcaagactgttttccagtgtgtagccactttccataccaaccctacctgaactggttttgcgcagttggttttcccttaatgtgtgttgaaagacagtgtgtccccaccgggatgggaaagtggcagcaggggtgactccctgcactcagagctggttcagataacactccttttcttgtttatgaaatgaaactgatatttatcaaagcccttgagatcctgggatgaaaagcgctgacacagtattgccaagtgtccttaagatacagggacagttttcgagcatctgaccttttcctgggcccttctctgctgccacttctcctgctcccaggacagtgaaggtaatttcagaagtcctttgcataatagctggtgttacaagccttttggtctgcctggttggaatatttcctcttgactgtagcttctgccctggatcctccaaacgggaactagagtgaaactcttaagagttggaaatactgctcagtattaagaaggaacaaactattgatacctgcaacaacatggatgtgtctcataataattacttttttgtatgtgtcattcatcatatgatttaattcataaaaaaattctagaaattgccagctagcctgcagcaatagaaagcagaccagtggtggctggacagaaaggtgggaaaggggaggcaggtgacaaagggcacaggaaacttgggggtaatggacgtttttattatcgtgattgtagtgatagttttatgggtgtttaagtacattgatgtatgtcagtttctaaaatggcacactaaacatttgcagcttatggtatgtcagttatgcctcaatgaaactggaaagaaaagtcagggagataccactatccacccatttttttttttttttttttttggagacggagtctcgctctgttgcctaggctggagtgcagtggcacaatcttggctcactgcaacctccacctcctgggttcaagcgattctcctgccctagcctctcgagtagctgggactacaggtgtgtgctaccatgcccggctaattttttgtatttttatagaggcagggtttcaccatgttagtcaggatggtcttgatctcctgacctcgtgttccgccctcctctacctcctaaagtgctgggattacagccgtgagccactgcgcccagcctgccatactttttttaaaaggctgaaagtgctacttgggttttttgtttttgttttaaggcaaagtctcattctgtcacccaggctgtagtgcagtggcgttatcatgggtcactgcagcctcgacctcctgggctcaagcgatccttccacctcagcctcccaagtagctgggactacaggtgtgtgccaccacgtctggctgatttttctttttttgtagagatggggttttgccatgttacccaggctggtcttgaactcctgggctcaagagatcctctcacctcaggcctcccaagtgttggaattacagagtgagccattgagcctggcaaaagtgctgcctggaactctcatgccatacacctacctgtgacctagcagagatgaaggtgtgtgtacgcagggctgcgccaaatgctgacagcatctcttcatgagaaccccaaaccggaagcagccccagtggccatcagcagatgaatgggtaaacaaagcagtgtgtacatccagtgggaaaaatgtgtgcctattggtttgagttgcttttcttagctcacctgaaagtatgaggtctgtgggtaggtacagaccttttaggcagcaacacgcatgtttttgtgcaggtgctctgggtgaccttgtagatagatgctgcttggtactggtcccactttgttccttcatcctcaggtcaggtctgcactgcctgttccgtctccactcctggtagcctgtgggagtcacagctgaatagtcatctcgtactgggattttactctgagtgcatgagttgtttccctaggaaaaacatgctgtctttctggatcgtaagggacaactagctaaagctcctagccgacctgtcgtccagccctcactctcctcctgccagacttctctgtattgcctccacttctctgagtgtgtaaacctgggctcacttttccttttgaagtggtaaaatactcaggatagaaagttgctactttgtcttcaaagccattgtcctgacctatccttgactgtccaggtgaacacaccatcttctgctgagccctgagattatgaccaaggcggggtgagttccatacagtcttgggttccgaaaagtggtgagtttaaaatctgcacatgtagctgggcacgatggcccatgcctgtaatcccagtactttgggaggctgaggcaggcagatcatttgagctcaggagtttgagaccagcctgggcaaaatgtccatgatcgcaccactgcactccagcctgggtgacagagtgagaccttgtcttaataaaaagaagaaaatccaggccgggcttggtggctcacgcctgtaatctcagcactttgagaggcagaggcaggtgaatcaccggaggtcaggagttccagaccagcttgaccaacatggagaaatcctgtctctactaaaaatacaaaattagctgggtatagtggcacatgcctgtaatcccagttacttgggaggctgaggcaggagaatcgcttgaacccgggaggtggaggttgcggtgagctgagattgtgccattgcactccagcctgggcaacaagagcaaaactccatcttaaaaaaaaaaaatgctcatgacttcattttggctttttgaatcctctggtagcccaggtgtggttttagggtgccagaacattggagataagatgccgtttacctggaggagtgttggcaagtgtttggtcagcacttaccccttagtagacttactgagtgtgttttcaaattgttaggagtttcccagtgattatgtgaaagtgacctgagctgacactttacagttagtggtgaatacacgaaacaatttctatttttatcacaattaattacccggattcaggatgacggggtgggggattatgactaatactataccaggactaactaaaaaaagagttccctctcagcctagctaccaccaccacaaaagcttaccaccatcagctaccaccacatttctctcattgcttgattgaagtctgatgacctaccagggaacccccttcttttctttttagacggagtctcgcactgtcgcccaggctggagtgcagtggcgcgatcttggctcactacaacctctgcctcccgggtttaagtgattttcctgcctcagcctcccgagtagctgggattacaggtgcgcaccaccatgcccaactaatttttttgtatttttagtagagacggggtttcaccatgttggccaggctggtctggagctcctgacctcaggtgatctgcccaccttggccttccaaggtgctgagattacaggcatgagccaccacacctggcccctttaagtatagaacttagtgctgttttagtaaatttacggaattgggcagccaccacagcagtgccttgctgtctctgatttctctttcgctcctttccgctccctccccaccaccccttgtcagaccctgtgctcatgcccaaggtcacccgttagggaggtgtgtccaccgcctcagactgagccctgccctggggaggtcagaaacatggccaagccctggccccatgctcccccgcctttaagccccgtgtctgttaacttttgcaccctctgcgagctgctgggcaacctcttcagcctggccctggacttcagccatcccctgctgttttcttacttcctggccttgctgtgcttgtgggactgagggcagtgaggccagcagagggagagtgaagcctttgacccccgcggttgcactgttagaagacagcacatgccgcctggccagggtgctgtgagggccccaggagtaggagtgggctcccctgctaagggaaagcctgtgggaatggcgcctctggagttgttcagaagctgtacctgccaggcagaggggtgggcacagcactttgcctagaaggagggagggtggatgtggggccagtggggccagggcaggggctgggctgtgtcctggagcctttaggagctgctggggtgccttgaccaaggctgggaggagggctctgagatggcagtggcgggggttaggggaggggctgtggtgttggaggttgggcattgtggcccaggttggaccccgaatggatggaggggccacagggcagtggagacggaggacaccgggatcagggctgtgtgtgtacatgtgtgtatgcatgagtaagtgtgtaagtgtgtgtgcctgtgggaactgccagggtaccggctgccccctcccagtcctcacagggagccacagacttaaaaagcagctccagctcctgcctgtggtctcatcagggtccataattccccaggctgagccggggctctctccgctggggaggcaccgtcctgagggccttgtgagagggagaggcctccccagagcggctgcaaggaagctaaagggcacatgctgggcagcagctcacaactgaggggcagtttgtgcttgtcatggtggtgagagtgctttcatggtggtcgggatagtctagcttggcagagaagggccgtgacacccagctgtgctctgtggcattcagggccgaggggcctggctggaggggctggtgggaggagtgggtccgggccctggcaccagtgctgttcggggctccggagggttcatggccttgagctctccttgctggagcacatacctatgagagcaaagttctgctttctctgatacatggagggctgctgggtcctggagtctggtggctggcagcaggtccttgtgcctttttctgtgttggtcgaatagcagcttaagagccgggtaacccagccgggcttctcaggtcccgtgggcctttgccaggatggtgtctagatgtgtaaaggtggctcgttgggctctagagagcccttgtgacagtgagcatggcatcttcctgaagcatcagctccttgcagagcgagtgcaggctcctggcggccctgggagagggggttgcagatcccaggcagaggtgtttggtcagagctgcgctgcctgcaccgtcctcacctctttttcagtacggggatccatgcgcatagcttgcagccctgctgcatcctccgtgtagaaacgtctacgatgaattctctaacatacaagagctggtgagccctgtgcctccgtctccctgatgagacagttgtgaaggttttcttctccctgttttctttttttttcttcactggtgtgtgtttttaaagcaagtcttttgtgtcctttcacctttgtgtctgaggtggagccctgtgaattggcgatactcagccattttgacctgcagtatgtagtatgcatttctagaagcagaaaagggcgcctgtcctgaatagctgcagcgccgttatcacacaagcagcgtcaacaatggcttttcacgattgtccgatatgtagggacagttggcctctctccacagcagattctttactgggatcctggaggtccgctgttgagatgatggctgtctctgggccctgcgttccgagcggcctctcccgctgcttttcatctcgccaagctgcagtctggcctgggttgttgtcctgtgaggtgtgcaccttctggactgaacccctcattgtcacacttcagcttcttgctgaaggtgtggagtggatttcatctcaggctgtgggctccagggagagtggctgatccccgggctgggaaggcaggggcggcctgaggtgagctggggatgccttgcacactcggcccgttgaaatgaacctcacgcggactctagcacacctggctggaacaagggtctgccggtccacacaggtgccattggtgagaggggaggcgagaggccctttctctttgggaagaacgaatgtgagcctaggcaacatattgaaaaattaaaaaactttctaggcattgtgcacacctgtagtctcagctacttgggacgctgaggcaagaggatctcttttaagttcaggagtttgaggatgcagtgagctatgattctaccactgcactccagcctgggtggcagagcaagaccctgtctcaaaaaaataaaggaatggagagcctggggaccgctgtgtcgggtggtgggactatgtgaaagatggtcaactcctagcagtttcacgtggttcaaactaatagattaaaggtggctaaagagacatcacaaatcacgtgcagtcattaactgggacttggattcttaaaaacctgtaaaagacgttatgaagacattggggtgatgggtgaatgtgtattaaccaacagtgtggcaggctgggtgcgctcatgagccagctgttttgtggggatgtggagaaagccctcccctggggccggccactctgaaatgggtcaggaagagataagtgtgtgagagcaaggggagtcggagtgcagggggatgtgatggagagtgtccagctggaggggtgtgggggtcggatttctgtagctttggaatttttcaaaataagaggaaatatcagggcagaatccttccagtttgggggccagacctcctggcaaccctctgccttgagagggctcagagaccctgcagcttcttggcagtcatcactctgagggtgtggtgaacttcctattccctcccctttttttcctttacaatttttttaattaaaaaaaatttgggggggtgctgggtgcagtggctcacacctgtaatcccagcattttgggaggccaaggtgggtggatcacctgaggttgggagttcgagaccagccagaccaacatggagaaaccctgtctctactaaaaataggcgtggtggcgcatgtctgtaatcccagctacttgggaggctgaggcaggagaatcgcttgaacccgggaggcagaggttgcggtgagccgagatcgcgccattgcactccagcgtaggcaacgagagtgaaactccgtctcaaaaaaaaaaaaaatttaaatagagatggggcctcactatcttgcccaggctattctcaaaccctgggctcaagatcctcctgccttggcctcccagagtgctgggattacaggtatgagccatcacgcctggcctcctgccctctcttttatttaagccttggaattagagaatcaggaatgagctgctttgccttttgagcttggcctttagccaacaatgttgagggcctcctggggtgcaggctccatctaggtgctgggctcatggcagggagcaggacagacaatgccccacgggggccttgaggtggggtcagaggatgcctgcctgagaggcaccctgtggacctcaccctgaggctgagggaacagcaggtgcaaggcctgggtgctggcaaatgcagacagtggtgcaaatgttggagtagatgtctgcggcctgagagtttatgatggcacatttggggggatttttgagtttttgaatttctgtggttttcgtctgtgggaatgaagtgactttctttgtttttttttttttttttttgagacagagtcttgctctgtgactcaggctggagtgcagtggtgtgatctcggctcactgcaacctccgcctcctgggttcaagcgattctcctgcacggggattacaggtgcgcatcaccatgcccagctaatcttttgtatttttagtagagatggggttttgccatgttggccaggcttgtgtgtgtgtgtgtgtgtgtgtgtgtgtgtgttgttgttgttaagagagacagggtcttggtctgttgctcaggctaaagttcagtggtaccatcatagctcacagcggccttgacctgctggggtcaagcaatcctccggcctcaacctcctgattagctgggactacaagtgtgcgccaccacacctggctcgtttgtgtatttttttgtggagacaggatcttggctgtgttgcccaggctggtcttgagaactcccgggctcaagcgatcctcccaaagtgttgggatgacaggtgtgagccaccattcctagccttgaagtgacctactgttgtgctgccctgatgcacggtctgagttctggagcatgtctctgggcagaaagcccctgtacagctcttagatggacttccaggatgtggttttagtcgtagctaggttcacatccagaactaaaggagttagagactccagctctggggcctcgtgtatgactaggaagtgggaattctaggatacgtctttaaatactgtgtccagagcagaggtgatgggaggagctgctttttttgggggccgggggggggtttgggtttttcttttttctttttttttttgagatggagttttgctcttgttgcccaaggtggagcgtgcagtggcacggtctcagctcactgcaacctgcgcctcctgggttcaagcaattctcctgtctcagcctcccaagtagctgagattacaggcacgtgccaccacgtccagctaatttttttttttttttgcctttttagtaaaaacgaggtttcaccatgttggccaggctggtctcgaactcctgacctcaggtgatccgccctgccgaggagctgcttcttggtgaatgcctgggatgggtacagggaggccttgcccctccagagcctccctggtgaggggataagttgacagcctcaaaggactttattggagtggcagctctgtgccagctgaagatgatgaccctcttgtccttcacccatcatgtcccctggcgtgggctgtggaacttctctgtgccaggcactgtcccctactgctgttttacctcatttcatgatagttcctagggtcaaatatatttttgaaattaatgttttatcttgaaacttttcagagagtgaagggagaagttaacccagaagtcagcttgtgttgtgaccagatcactgcagggcagcattgggcccagtgtgcatctgtgcgtgcaggtagcacgtgcccatgcaccccagccaggcgggctggaggggcctctgtggggtgctgctccccatgagcacctgtccctaggctcgcacaggtgctgcatcacacagcaagggcattaggccgaggggctgtctggggtgctgggactggcagtgggagatttggtgccgtccctaggggagctcccatcactcctccctggcccttaattttgtgccaccttgtgttctgccatgacacagtgctcccgctgcctgaccccgtggtggggttaggtggcctatgggggccatgccagggactgttggccatgtcatttgaggtgctggtacttgggagtggcatgaggagccccagtggctgtgtggtctccttgcaagtgtcctgtgcagttgtggcctgatgacttagagccatgcgctgtctgcctttgctgaacatagaagaggcgccttcagtgagggtgtggcctcggttgccaagggtatctcagtgttcagtttctacttcatcctcaggagagggctgccttgaagggatggggagggtgaggtggcagtggatgtggccagtgacatttccacatctgcatgggtggcagcttcgtagtgtttgatgagccttacactgtggtgggtctggcatcatgaagctgtcctcagggcacactgctgtcagtctgtaaaagtcaccctgctccttgtggtcctcagtcatgggaaagaagcatcttcctaagcatcctggttgtgggcatggacatggctctgtggctaggcgggggttagaccagctgtgtgggggaccggggggtgtagaaggccaccagtggcccttttttggccaggtaggtttgctagagaagagtgaaatccagtcagaacaagggaaactgtctcaaagcagagatgaggccagggtgtcacaccagagtcatcgaggctggttcttctgcactgagtcctggaagctgcagcctcactcaggtgacactgcgttctgctgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcaggtgagctgagctcagctgggcctgggcatgtgctggacaggtgggtgcctctggcatgggcctgggacactcacctcccaggtacagggtggcgcccttgtgctgtgactctgggtggcggtgtcctcgggagtaaggaaattgctcaggccatgtgcacagccaaggcctgttaccggtcaggaggtgggctcagcaacctccgacaccctgaattcaccagctggtgggaaaagttttccttcctttggcctcctcagaccctgggggcattgcctggtacctgcgcactcactcatagaaagaatttgtcatggcattgggtgagcatctggggtgggagggtgagtggagcagctgagataccctcacaaagcagttgctgcagggttctggggcatccctgcctcccgctgccttggccgtgcctggagaattggatgtgaagacagtagttagtggatagacctgcatgttgacaaatttagaattctcatctcgagtgggatcgtcccttgttgaggcttatttctgtatttttgtgacacacaagtgaggaaatgtagattagaagaggggagaaggttttggccaggcacggtggctcactcctgtaatcccagcactttgggaggccgaggtgggcagatcacgaggtcaggagatcgagaccatcctggctaacacggtgaaaccctgtctccactaaaaatacaaaaaattagccaagcatggtggcgggcgcctgtagtcccagctagctacttgggaggctgaggcaggagaatgacatgaacccgggaggcggaggttgtagtgagccgagatcgcaccactgcactccagcctgagcgacagtcacggcaggtttgggcctgagccctgcctctgtctgtgggcacccacttggggccctccctgcagctccttgcccgcgtgctgcccagcgctccgggactgaggctgctcttcgctaggcttggtgggcaggcactctttcctgcatctcagctcttcactcattctcatttacagatgttttcgtgtatgtaattgtgttctcttaacacacagagatggccataagtcctggtgcagctctggggagctagtatttttgggtttggtatgtggattttcagaaaaccacagccagtggtggggtgaggctctcccgaggctcctcgcttgggcttcggggcctgagcttcagggcgctgctgctgcagggtctgtgcccagctccctgggagcacagtgccctctgctggagcccagagttcaccatgaccactgggtctgaggctggattcctgaatttcaggccaaagaacggggactagaatggccctggaggagtgaggcctccttccagcaggactctccttggaggtggctttgctccttatcccctcggagcttctgccacataccccttccctgcattcttggatttgagaagccctggttaactggtttgatttggttactgggattgttggggttgagtatgtgtttaatgaagaacttaaaaatgttgtcagaggaaagaatttcacatcttgccaaatgaaaaccagagagcaagcttccagctgtaactgtcgctgttttgattttttagttactgtggaatacacgatcctgcctgcgtggtttactgtaataccagcaagaagtggttctgcaacggacgtggaaatacttctggcaggtagataatcagaccatgcatgtgtgtttaatcagtgctgtgctcagatttgtgtgtaaattatggaaatgttgaagcaaagcgtaatataaaatcacgctaacaaacctgggttttttcctcctctgtgactggtttaacttgaaacagatggtggtgtgtgaatgccttaatgtatttacccttgatttattctctgtggctctttttattatgcaagtagggttggcttaattctccttcccagtttttatttcgatttttctgcaagatgagctcttggcacacccgctgatcttcattaacgggaggatgttcccaaggcagtaacgggcatccaggggcgctggttcctgagcaagcttgctctggcctgagctcatcggagctgtccggaggctaattcaggccagatcctgaatcatcggcttcaattaagttcacttgaccgtcagcgctgggcttgccttcctgatgttgatcagctgcagctggactgtgtcgcttgttctgtgtttgggacaggacagtgttctcccagtgcccaaattccaaggggggagttcaatggtcttgcccgagtggtgggactctcgtcctggtgggtcccgtgctagcggctccccttcccctccaggttgctgtgtacaggtcactccactgctggagaggatggagcagagcctgggaggcagagctccgaggtgctagcaaggaagtgtggggtctttttctgaggttcacgttctggagaaagaaaatgaccaaagcccggaggcaggcttacttgtgctgacacaagcccctcctgtgcctttgacagctgtgggtctcggagggttacagatggagcagtcagatctcgtggcatctctgagttagtaacttgaaatatggtgttatgagcaaggccagaaaggggctgctgtttttaaaagattttaaagaagggtatcttctggataaccaaaagacattcttgtcccattttcagaatcttctgggtaatttaagtgttgctatgtttgcatttagttcctcttgttcaggaaaagcaactaaataaaacttctcttagctggcaaccccagcttccggtcagcatagccaagaacagggaagtgagcaaaagggcctctgagaaacaacaggcttgagccaagcaccactgagcattctgtgcgaggcccaggggaaggtgaggaagcagccgctggcccttagggatcttggctgtgacagggtgaggatgcatgagaagacacggagacagctgattctgcccacgtggccggcagggctccagagtggagtcgggctttggagatgctcagagtggccatggctggttagagaatcctgggcctcgtggcagggagaagggttagaagattagctgagctgaagcttttggcaagaatggttttccagaggggaagagagagggcgcggtgaggaaggctgggaggccctgcaggcgtgttcagagctgctggagacaccggaagagcccaaaggcagagcagctgggcatccttgttagatacggcagataggtgctggagggtggctggcttggcacagggcagggttcagcccagaccgcggtttaggtgagcagtgtcctggccacgtcgcagcaaggaaggagccgagccagccagggcttcacacacagccctgggcttctgtagaaccgcccccgcctctgctcaacctttttgctgctttttgcgggggtttccagtcgcctgcttatcagatttcccggcctgcagcaaagcaggagggactgttgctcctggaagtaggcacagggcctctgaggagtgatttcagaagaagccacagaagatggtggcgggggttgaccttggaaagaaggggctggggccttgtgggaaatgtctctgaccccacagcagccctgggccaacaatgggttaaattaggcctgataagttggatttaagaaagcaggatttttaaaaaaggcaggaactatgtgaaccgtgttaaggaagttttccttaaagtggttcaagttgggattgatttttgtgctcagtggggagctagtttgggggagggctggcccccagagatgccagatggatgaggtgtgactgcctctgctaatggaccgtgaacggtaccggaacttttaacaggggcccgaaaattggaagtggtgaaaagccaaattttgggtgttaaccgtttatcatttcctggtttcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggtgagtggtccccagatgtctcctgggggtgacctttaagctccagccgtctcctcacaagccttggcccagcccagcccagccgtggctctaactccagggagttgtcctccaaagatggtttttgctgaagggtgaggcatgagagcgtttaggcgctgaggcttgttaaggagtcggcagtgccgtgtaactcttttggggcgttctggctaagtcataaaaacaattctgtaaaaacaaagtctgttctgagttttaagagttcagagctcaagtgcacagggagatgcgatttattactaacagtttgaaggtaatgtgatcacataataaaatgcagggcatgcccctttgggtgaaaggtcagcatgggagggggccctccctgctccggggcttcagggacgggagctggtcctcacggccccctcccgctctgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggtggggctgcccagcgggccgacccgtgccttcgtgtggtttctggttgcggggaggggagtgtcttcagagacggcttgacccagtgagaccgctggagattctctgaaaggaattcaggcagacctctgccacctctacgtggaatgacctcagggcaccttggtcaccttccatccaggcagccttacctgaccgagaagatcctggccttggggaaaggaaagctctggctgctggaatttttcttgtcttgccggggtgaggatgggtggtgggaggggaagaatggggctggctgtgggcagacttgtcctgcagagcctgaacctgcccagacaggtgggctgcgagaatgtcctggggaaataggttggtgtcgaggtcggcacagtcagctgagacagaggggagaggagagggtgccgggtcaagtagtgggtgcctggccctccttccacagacagccctcacttttccccacggaagcctttctgtgcttccagctgtttaggattttgtgataaagtagttctaataactaggctagaagttttcatttgcctcccattcagtcagaaatctcacataggaaatgaagtgcaagttaaaatatttttttaagcattgttcagccgggtacctttccacttggattttccggttgccagatgatttcatgattcccgtttatatctgaacagcccagaaaatgtcctgtccccaccagcatggcactcactgagggagctggcccccaggggaagagctgcgggcccatgttggtctggctcagggttagcagacgtgggagacaggcctcccgggctgtggacacagcgagagaaaccggtggtctttgtggcagcctgcgaggcgggttagctgctctcgttcacaagctgggcatacttggaggaagcagctggctctgaaggtgccctctgctgtggacagtgtgtcaggctggtgcctggggctttgtaggcaggttcacccaagtaccggaaccccgctggggtgcggagcagcagctgaggcccaggcatgggccaggccggtgtgcagctccctgtgtggcatggagttcccgttcccagggttctccttgcaggtggggctgcgccagaacccctccatgccacccaccgtggcccattctgagaagcggcatgtgtgctccatccctctggtgcctctgcgccctcgttcatttgcatgtagggaaaaacaggacgagtgtggcgcggtgttgttgtcttctaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccaggtgatgtgtgcgagagggcttggcctggggtgggctctggctctcacagctctctcctcaggcttccagagggaggttttctctccaggctgtgggagctgatgtgggctgcagccgcgacacctgagagttggaacttgcggatccgggcctggcagcccggtggtctgagcccccgccctcagatctgacatcagcctcagtgttttctgtttaaatccaacacatctttcccagtggggtccacagctttgcccacagttgcgagagttagactcgggcgtgatccctgtgaagaccacatttaggcaacgggagccctggagcgctgacctcccctccctccctcccctcctctttctgtccctccctcccctcctctttctgtccctccctcccctcctctctctcttcctccctcccacagcagctgctccctggccacggaggcctctggtgtgcggtgaagcctccagacgggattggcctgtgtgtgttccggggactcctaatggcttctctttcagatgtgcccttggtggcatttggggctgcaggtgccactcacggcgcctgctctcacggcagaggcttgctgtagggcccgcctcatggggcctcgggcatgtggaggccaggcccgggcctgtgctggaggctaaccggggctcttgtttttcatgtgctcagactcaagataacatcactgtcaggtgggacctgggccttaacaagaagagaatcgcctacttcactttgcccaagactgactctggtaatgaggatttagtcataatttggttaagaggtgattttaagttttaaaatatttgtgaccataagtagcataaattcctagttccacccttgtaaagtgccccttaatttgaactctccctggtggaagcgacggcgtgggttaaaatggccacctctctcacttttttacctcaagacatgcggctcatgcagggggatgagatatgcctgcggtacaaaggggaccttgcgcccctgtggaaagggatcggccacgtcatcaaggtccctgatagtatccttcatgtgaagagggtgtggccggctggtgggagaggaaagtgggggcatcaggtggaggccactgtggatttgatgctcactgctgggccagcatctcatgctctgtggtgggtgctggttggcatcgccctccactgctcttaggagaatcacagggccttcaccttcaggggacagctggttgtatggttgcttcccctctgcccgaatggtgatgttggtgatgccacttgtgtggcgcgtccctgggctgactctggaagttaatgtatgccgcttgtgtggcacgtccctggactgactctggaggttaatgtggctgcaggagcgccttacctggacgctgactctgcacacggaggttccagaagccagtggtcacatgcagaccctctgagcacacacttgctcccaggccatgtttgggaatgtgcagtgacctcatggtgatgcagcctgccggccagagtggggcagctgtaaggcacaggtgcagtcagaggcttgggtggggaggagtcctgggagaagacaccgcgggtcagactcaggctgcctcttggtgactggccaatgctgctggggcctgaccattcagcggtggcctccacaggggtagggagagttgtctcccacacccaccctgggcctgacaagctcatcctgaacacgtgagaccggttttggggctcggggtcgagggaagggtgttgcctaccggccacagcctcctggagggcagtttgcttgtgtatgtggagccttttgcttggccgtactgggagggttgttgtttctgtggaactgtgagaagagctgctgtggccaaagctgggttctgcgagctctgcctgcccctgctggccacatgtgcaggagctcccggcgaggtcctggggcccaggatgtggctgctccctgctggtgagcgctgctggcttcgctgccgccctctgcgtctctgaaaggggcctagatgggtggctgggagtggcaaggaggaactccaggctggctgggggtgggacaccggctcatggtgaggtagagtctttcttcaaggatgctgtccttctggtctctggtctggtgttggctgcacgtttttagcgtttggtgcagagccagcggtgtcttaagtaactaaattttaaaaacgctgtttaaagagcgtgtaccaagggtggcccagaaaggtcagcccggcttttgacaaggatgcaaacttaactcagcacacagattatggcgatgagatcgccattgagctgcggagcagcgtgggtgcacctgtggaggtgactcacaacttccaggtggattttgtgtggaagtcgacctcctttgacaggtacgtcttctcccatcactgccccctgttccctggttgccacctgtggcatctttatgagccctccccgtcactgtggagtggggttccccacccagctctgcaaactcaggatgtcggagaggcggccacagctgtgcgtgtcgccaaccccaaaccctcctcacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtgcgcgccgtcctcagcgcgcggggcctcgcccatgggccgggacgcaagcggaggctgcccctaacggccgcttgtattgaaggtttatgccgtgaagactgtgctgcaaagaccactgagcctgatccagggcccgccaggcacggggaagacggtgacgtcggccaccatcgtctaccacctggcccggcaaggcaacgggtagggctgacacggcccttgcgggcaagacccgggagggctttagggtggccagatggaaggcctggtgctgggagccttgggctctgtcacaccgaagagagcacgtggcgggtagtgtcgccatggtgcctaccgctctctatgtgacattattcgtgtcagctccaaccttaggattgcattttagtaaccaggtctgctactggtttagaaaactgggggcagggggggcatggctgcagcagcgtgagttccgtgtgcggcactttatagtgtggcgggatggtgcaagttccagccttggcattgcttgcggtgggtagagctgtgaagcctgggctgtctggatctgagctccttcggcatcgtgtcattactgcctgttaaaaatgtcaggagtttaaggccagcctgaacagggtgagacgtctctacaaaaaaaaaattcagaaattagctgggggtagtggcgtgcacctgtggtcccagctactcaggaggctgaggtgggaggattgcttgagcccaggatgttgaggctgcaattagctgagatcacaccactgcactccagcctgggcaacagagcaagaccctgtctcaaaaaacagagtcttggcttactacgttcaccgagcttcctctgggtaagcactgagctgccccaatggtgttgcaggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacaggtgtgtgtcgagtccatccctcccagttggtccctgagcttctgcgggtgacatgtacagaactcaggcaccctgctgacctgcatgtgcttccagcatgcctgagctgcagaagctgcagcagctgaaagacgagactggggagctgtcgtctgccgacgagaagcggtaccgggccttgaagcgcaccgcagagagagagctgctgatggtgagtgcccctcctgcctgcaaaagggcctgtgggctggcggcctgatggtttttgtttgggccaaagcacctatttgaattgttgctttgcttctggaaagagaacttagatgctctctacttggcctctctgcgctcagttgtacagtaaattagggacatctcgctgcctggaacacggtcttctagggagtctccactccctgccagcctccactgggatccggcagtggatctagaacactcctgctctttcataaccaaccagcctgaactggaatcagcctgagtgcaggttccagcagctcagcactgccccttggaggctgtcgtgaggcgcagagctcttggtgtggagaggttgccttctgtgaaacatgaccgtttaaggatcttaaaagtttgtaatcaccacagcctggaccatgtatcttgtctgggagggacagcttgttttttatagtgtcagggagggtgagaaacaggagagcttctgtgttctgtcccacctgccctccggggtctggtggcgtttacagtgcaggtgccctgatgcctctgcacccttccccagaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcaggtgggctgcctcccctgccctcctgtgtgaaaactcgtgtgtgtgattcttggtgtttgtcttttaaaacaccttgtattgacgtaggatgcccagcagagtgtgcgcacactgggggctccctgaggggtttatagagggtgggttctgccagctgcacgtccagtgtgcgtggtgagcaatgcccctgtggccaggtggtgtcctgtgcatcctggggcccctacttccttgctagtgtgtgttgaggctgattcacacctgagcttcttgacttgtgggggcccctgttcctacagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcaggtaacggggctctgcccagggcaggggcttctacagagaagcggcatcaagggaatgtggactggggagaaggaactggcccatcagcttcccctgagcggcttcacatagccactgcttgaggtcagggcactttgtgcccaaggtcttgatggtatggtcttggatcaagtggtgtctctggggcatgtggggagcctgtgtcctctgtaaaactcagtcattgcctgagaattcatccaagcctcatgtggcagcatgcacagcagccaggacaggctgttaggggagctgagcccgggccttaacgtgggccgtgcattcagtgcttcatgaagaacagctgttctcagggcctgggcccctggggcccgcaagaccgtgtccggcttccctggataacacagaggcctcacctgccctttttcactctgctgacgctcacactgctggtgaccccctggtgcttctgcaagagtcagcccagagcagccagactgtgcccggatcacagtaagaaacgccctggatgaggaagtgaacagtacatcttactaagcctcgagtgtttcactgtgaccagataaaatttctcgtgacacctttgggtatgccggcgcttgaaggaagtccttgtggacacaccctgggtattcaccccaaggtgttgggcagactttttccaaaaatgatcgaacctgtcgcttcatggagaactagtggcaacatctgttacagtagtaaaattcaagtgaaaaccagaattttggaaaacttaacgtcgcttgccatgagcttggtgtcttcccaacacctagagacttttctggtgaggtctgtgggggtgacagatggaatgtttccaccattgccagtgaaatgtgtcagcctttggaagacctacttgactcggtgggagatccttcctgaatgaccagcagagtgtcacgaagtcacatggggatggagtggcaaagagttgtcacaggcctgcagaaacccacctttgtccagcttgatgtggcctcagggctggagactcccagccatgcagaaaggctgtaaaaacaaacccatctccctttccagcctcaggcatccatgaggcctggcttccccacagcgtccccagagcccaggagggtggactgagcagaggtggaccccagggcccagctgcctccgattcagccagatagtaaggagatttgcagaaatgggagacaggaccactcttcttacttagtttatttttggagaaataactaacacgtaatgggttatttttaaatgaattaatatattttttaaatttccaagtttagagaatacagttatccaataaacaaaagctgtttggactccctaacttttgagagtgtaaagggtcctgaaagctgccgacacagcgcctcatgaactccaaacctgtgaggttggtattgtcaggcctagttacaggagaaagtgaggctcagagcccaccccccgggttgggccacaccactctttgcctagcggtaggtcttgggagttgatgccactattgacatcgcagggacaccgctgttcccagcgcatggcaaggctgaaaacacaaggccacagagacctagcttgtgctctggggtgtctgagcactggctgggaaaggcgtggctcggcgcaggctcagacccctcatggtccccagggcatcggcccagagggcagacgctggtgcacactgctctctaattgatgcacagcacgtagttcacacccaggaagtacattttaggaaattctctattgaagtgtaaacatgtggccacattacaagtgtctggctcaatgagtggttactaagtgagcatatttggatagccagcacctgaacccagaaccacctgaccagctgtgagaagccgcctcatccctgcaggtggccactgtccaggggtgcgcatccacagcagcccctgggctgagggacttctgagctcatccggcggcccctgtgctcgctgtaacaacagtgatccacttggcctcattttcagctcgacgtgggatcatatgatgtgtcctggcgtgtctggcttcctctgtccatgtcaggctggtgctgtgcaaaaacaccggttttctccactgatggaagctcccagtagagtgaggagggcacctgtgaattgagaaactggttttacagttttaaggaaacgcaacagggcccagaaaagccaagatgagcatgaagagcccgaagaaagtggctgctcacatggcaggacgccccggcccccaagctgcagtgttgggccccggcccaggagggagcccagaggcagagccaccggtcaacaggccctcagcaggaatggacaaggctgcagggcagggggacactgttggctcaacagtgtcacacacaagtcagttgtaggggctgtggcgcctttaaggcaagcttctggaaggaagcaggagaatatcctgtatcctggggttggcagagatccaggctgcaagaaagccctggctgagaccctgttccctgttcaggggctgagccagctctgtgctggccatggtgctctcggtggcctctcctcagccttgcccaatcctgggcatctctggccaggggaccggctcaggtgacctcaccagggcctcacagatcgaagtctcctgccccaggacctgcagcactgtagcgtagcaactacattgccctgtgtctgaactcatttgaggcgggctagggcttttgaagtgttacttctttccctcccctcacagcggatcgtgtgaagaagggatttgacttccagtggccccaacccgataaaccgatgttcttctacgtgacccagggccaagaggagattgccagctcgggcacctcctacctgaacaggtgagcagggacaggcccaccggcgtctgcaggtcttggggacagcttgagaggttgttgacccattctacttatttttaacatgggactgaaactttttttgccttcatttcctgtttagcctgtttagactctaaaccgtgttgtttctgcctccttttccattgtacttgttttttattgggcagatacttgctaatcccacatggcagccgtttctgcccctcgagactcccctggtgaaggctggggaagctcagctgtgcaaacgccagtgatggcagctgccttcccgcagggtgttgtgtctgcacccctcacggcctccagcctcagggctcgggatcccacaggtggagcccagcactgacagcctgggtttcttaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggtgcgctgcgccctcgggcacacttggtctcctgggccatgcaagggtattgacccttgacctttaagttaccccccaagaggggcccgtcctggctggagctcagaatggcccaggaagcaccagctggcccaccctctggggagggcacagacagcacatccccacagaccctgcgaaattccacatgatcaggacagagactttgagaaatacatcacagggatcagaaacatgggctgagattggcacatcaaggtgttttctcgggatggttgaaacaagtccaaggtggaacggcagtggtctgtgcctgccacacactggatgttgtgctgtggagaccgtggtgttcacacctttattgacacccggatgaaacacccactgcgggtgtgtggggaggaggcacagctctgcctccatgaggaaatgagcccaagtgctgagtctgagtggccacatggcagtggtttctgttctgtttttgagcacggctcaggttctctgggatgagcacgtgtgctcttagtgctgagaaacaaatctccgtggctaaaagagaacaggctaggtgtcatggcccacacctggagtcccagcactttgggaggctgaggcagggaagtcgcttgaggctaggagttccagaccaacctgggcaacgtagggagaccctgcctccaccaaaaaaaaataataactgggtatggtggcatgtgtctatggtcccagctactcaggagactgaggtgggatcagctgagcctgggaggtcaaggctgcagcgagctgagatcgtaccactgtactctagcctgggtgacagagcaagatcctgtctctaaaaaaagaaaacaaaacgaaatggcagcagagccaggacagcccctaggtgcggtgagcaggcgccaggccccaagctcccgggtgggatttgagggtgggtcttggtgtgtttcctgcattttggggggactgggaaggcagcctgctggctgatagtgaccacaaagctcccttccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtagggaggctgcctgctgcatgctgcccagccgctcatcggtcctcacttcccagggaatttggggctagggttgggggttgccagggccagaggtcagaggactctgagcagcagttgagaaacgatgtctcactggagagatctttgtttccgtgtcctgggggtttgctgtggcccctgtgcctcagcccagcaggacgtatttttccaggcccttctggtctgattcaaaataaatcttgtgtgtgtctgtcaagttgtttaatctgagaggctgtaagttttggtcctgtccactatttttggttctaaaatacaacttttgtgaactgatgatagcagaagggaccccgagaacaaggtgtccattctgtcatcccacataaaactagacatcaggccaggcatggtgtctcacacatgtaatcccagcactttgggaggccgaggcaggtggatcacctgaggtcaggagttctcgaccagcctaacatggtgaaacctcctctctactaaatacaaaaaaatgagccgggcgtggtggcacatgcctgtaatctgagctacttgggaggctgaaacaggagaatcgcttgtacctgggaggaggaggttgtggtgagccgagattgcgccattacactccagccactgggcaacaagagcaaaactctgtctccaaaggaaaaaaaaaaacactagacagcaaggacccattcaccagctggaagtcggggggacctggcctgtggctccacccagcacagggagagagcctggtgctccttccggctcatatgcgcggtggttctcctctaggtcaccatggctttgtcattggttactccctctttctaaggcgccctcttgtttggtgggcagtattgggtgggtccccccacagcttcgtgaggtgggctagaggagctgggcatcgggtcagtgccccggcctgctgggggccctgtggggccgcgtgtgccccggtgcctggaaggccgactctcttgacagcaggtcttctctccaaacgtatccacccagccaggtgtctgccatggggctgcttagagtcggccacaaaatcaacccgtgtgcagggtcagtggcttggcattgggctttggggcctgtccctgtggctggcagcctgcctgctgcccggtccacgcctctgttgccttggatttgggttctgagtgaatgcagccttgcctcttggaccgtcctgtgaggcgggcagctctccacctgcgtcctcagcactgcgcccttgttgcaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccggtgagcgcctgcacaggacagcagggcagcacggagaaacccgggcccaaaacactgctgggaacgtgccagcttggcccgtgtgcccgtgagctgagggagggctctcctaggggagggtgggctctcctaggggagggtgggccagcccacttcttgtctcccgagccgtgtgtggcatttttggcttggggccgctaagtcctgggtggcctctgggaattgggctcagggctgctgtgctgcatgcagcagcctgggaccttggacacgggcagttggaagctttgcaagcccggggtgatctggtagtgagggggtgtgaagcttcctgagctgaggcccaagggtcagcatcagagcccaggtctgccgaggagggcaggcgagacccagaggccatgagacagcagctccctcctgtctccagggagagcccctggcacagtgtcaacacctcacagctgcatacctgccacctcccaggccaccgggcccgtgggaagttgttccttctgttgagatgacaaattcctcacctatctaaaccttcgcagggagcccgcttcatgaccacagccatgtatgatgcccgggaggccatcatcccaggctccgtctatgatcggagcagccagggtgagtcgctcagcaggggacctggccgaccccttgtcctcacaccgggatgctggccgttcccatggctgcagctttaggtgcccccatctttccttcccctcaagggcggtgcctggctcccttggcctccccgcccctagggcatctctagccccggaacactcctggggtgtttgtctttaaccagagtttattcatttgtgtttcctggtgatcaagctagttagctttttcttgccttttggtagggcagggactgcatgtagtacaaatagaacattttcataaaaaggattttttttttcctttggtaaatgcagggtgattttcatttattttcttttttttgtttagagacagggtctccctatgttgtccaggctggtctcaaactcctgcctcaagcagtccttctgctcagcctcccaaagtgctgggattacaggcgtgagtcactgcacctggccaatttgcaggtgtttttttttttttttttttttttttggagaccgagtctcgctctgttgcccaagctggagtacagtggtgtgatcttggctcactgcaacctccccctctgggttcaagcgattctcctgccttggcctcccgagtagctgggattacaagcacccaccaccatgcccggctagtttttgtgtttttagtagaaacgaggtttcgccatgttggcctggctggtctcaaactcctgatctcaggtggtccacctcggcttcccagagtgctgggattataggcttgagccaacacgcccggccccaattttcagtttttaagatctgtgtaggccaatgattcccagcagactctcctcggggaaggtgcctgcccaagcacccagccccaggcaggctgctgtagttaacatggagtcctgcgaatccgcatcttcagcctgggcagagccaggacagatgtgcagctccggctgactggctggtggggtgggtggggtatcgctggggtttgaccgaggcaggtgacacctgccgtgttccactgtgatttgcaggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcaggtgagcatctgtggctgcggctgggtgtggccctcctgagagctcttgagggtgtgcttgtctgcgaggccctggcctccttcggatcaccctggactgctgtctttcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggtgagcccgcccctgggacgggacttacctgagtgagggtggggctatgcacctgaaacattccctctgaagagccccagagagctggcctggcccatgtccactgtctgaattacctgtccctgggctggggtcatcagagtgggtctcctgggtcttagtttggggacgggttttccattcttttctctggggctgctgagggctgggtggatgtgagcacccttggcctgtggcttgcttacctcctgaccttgtctttcaggacagttaccttggtgacgagtttaaatcacaaatcgacgtggcgctctcacaggactccacgtaccagggagagcgggcttaccagcatggcggggtgacggggctgtcccagtattaaaaggcaagcccccctggagcaggcctggccccaccccagcctcaaggagaaggatgggagggggctctccccagggagctgcactggaggggtggtatctggaaatgtgtgctgtgcctggtgggggtcataggccctcagggccagcttggcctgtgcccttcactgctagtcagggtggctcctcaccccaccctaccccatcctgtctgctccggggaccaccgcgggacctcagtttcctcatcagagtcggggagggcagctcgggctctccctcactgtcctgtgtgctgggtacctgtggggctcaggtcgcagcctctcaccgcctcctgcccttctccctcctgacaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctctaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttcacaccaaggttggataaactgcagggggtggagggtgctggggttttgccttggctgagtgacgggttggggtgtgaaggaggccagagggagacaggcaaagcccagaagggacaggtctgccttgcaggactgaagggcgacccctgcccctgggcccttcccgtaggcagcacctgggcctgtccgggcggctccccggagtggcgcgttaggcctctggcaggtggcctggaggtggaaaggcctatccgatcaccaagactgaggggcgccctccccaccccccaggcaaggagtccaaggagaccagcggagcagaccacgcggcatttattgttgggcccgcgtccctgcccgccccgggttagcggcagccgcactcgtccaccaccat

SEQ ID NO: 15988 - DNA, 12521 bp, Human
gtttcctctacctggaatgactttctgctacctctgcctggctgtgtcctcctcatcatccggtcctcagcttggtggtccctcctcctccagaagcccgccctgacccatcccctttcaaacagatcaatttcctggggactcctaccattgtctgtgtgtcccgtcacagccatgagcccactgggctccccatttgaaggagagactgggtctggcttcttcaccctgtgtgcccatcacccagcacaggagacatgacacacaacagtccttgatgtttgtgaaataattaatgtgtctagaaatgtccccacctccaagcttcacatgcttccctccaccaaaactgccctcaccttttccctctgctgatccaagtcctccttttcttttatgtctgtctccttgctacctcctccaggaagccctcggtgacttctctgtaggctccccagaaaacatatctggctctgagtctagattcacccctgccctcgggcagtggccttaggccagtcactttttctctctgggcctcagtttctctgtctatagaatagacgctgtgagtactggaaggtgggagtggagagtgttaactgattccaggaggttaaggggttttgtaactccagagtgtggctggccagttagcggtaacttttatttttattacaggctgttcccacagcagctggagcacagtttggaaggtatggcacagcctggacaaacagaagccccggacctccccttgctagagccctttaacttgctcccctccagatgggggcctcacaccccattgcgcagattggaaaaccaagtgggcctgtccccttggacaggggttggggcaagatcctgaacgctgtcccctcctccaccagccgagggaccatggggaggggagggaacaccagcaatgagttgggttggggggagtcatttgcagccctccagcgttggggccagaagcggcctccttggacagaggcaggaaaattgagagtcccaggtctcaactgcccctcccctattttccattcatcatcataatcatcattactattaatcattaattaataattattaacttattacctccattgtgcaagggaggaattacgcctgggtaatttttgtacttttagtagagatggggtttcaccatgttagccaggctggtctcaaactcctgacctcaggtgatctgcccgccttggcttcccaaagtgctgggattacaggtgtgagccaccgcacccagcaacttacccagttttgaagcacttcaggaggagtggagggccagtcagtctgatccatagtgggtggacctattttttcagacgctggtgactctgtttcccgaagtgtgagctgagagcgtggccatggagcctgccttgtttggaactggaactcaggtttggcatacagcaagcactcaatcaatcaatcaatcaatgagctgaatgctatggctggatcctgtaatcccagttctgtggggagtatcgcttgaggccgggagtttgagactactagcctgcaggacatagccagacccggtctctaaaaataaaaataaaaataaaaataaattagctggacttggtggtgcagggcttgtagtcccagctacatgggagactgaagcaagaggatgcgatacagccacaccccgtcacacacacacacacacacacacacagacgcacacacacagtgaatgaaagtgggggcagtaccccctgactccctgccccaccagctctctccacagaccccgggactcagtttccccaccatgtcggattcagccgcgggcgacttcgcggggcattccgggcggggacttgaacgcaggggccagcgccatctgtttaccttgaggctggacgttgggcagggctgtggtgggccgtccctggggccggccgtgccttggggataaataggccccgcgggcctcgtgggcggtagaaagcgagcagccacccagctccccgccaccgccatggtccccgacaccgcctgcgttcttctgctcaccctggctgccctcggcgcgtccggacagggccagagcccgttgggtaagccgcgttagcacccgcgccgtgcccacggccccacaacggactgtaggacccgtgagaggcccgggatccaggctgtttggggctcacggactgttcgtaggggacgtgccgggcgcagaaagcaggtggcgggaccgagactagaggagcgcagtggggcctcggaggtccgggttcgctgcaacggtgggagttggtggtgggattccccggccccatgacgcctcaccaggtcccctgccgccgcaggctcagacctgggcccgcagatgcttcgggaactgcaggaaaccaacgcggcgctgcaggacgtgcgggagctgctgcggcagcaggtgcggggcccgggtgcggggcagggagtgccagggaacggaagggggtctcagttcccagcgaggagagaggaagtacccgagaaggtggagaggagatggggagggaagggggtcggcgggtagggagtccttggcgaaaagaggctgtagaaagggaccccggggtagagagaggggagacccgagggatgaggagaggttgggaccccgctgattccatcccacccctgcaggtcagggagatcacgttcctgaaaaacacggtgatggagtgtgacgcgtgcggtgagcgcggcggggcggtcgggagagagaagagacgggagacagagacacagagacagagacagagagccagggaaagctggggaggaaaagagacggaaggagatggaggctgacggagaggtggacggacgaacgggaatgggatggggtgtgtagaaacagagacaaaaagagacagaagcggtgagagagttttggggaagtgagagacgccacggggcagaaaagcgggacagagactcagagaagagaccggggagaccccgcggtcagagcgcgcagcctctggggcgggatcgcggacagcgcaggatttcgggccgccccggggcggggggtgggggggaaggggaagcctccagccccggggcgtggccatgataggctctgcccccgggcgagccaccgatcagccccgccgcttctcccccctcccccccgcagggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgaggtgcgctagccccgacactccaccgccctgacgactccctctaccgccccccaatctctcgccgcccgggagaccccttcctccactgggagtgttcgccccgaagagcctctcacctccgggggcgcacggccagactacctccttaccgcggggggacgcccaacccaaggaccatccccgtcaccacccgggacgcccgcccccacaaccccctacatagctagtgacgcccgccccgacgactccctcaccgccaggggtggtccgccccagctaccctcctcgccgcaggggatcgccagtcccaacgacccttccacagccagggaacgcacgcccagaccccccgccaccgccgggcacgcacgccccgacgacccctgcccccctctgctggggatgcccgccctcatccttcctcccctcgcccatgagggaacagctctcctctcctctcccggttgcgcccttgccgtcatcaaggcaaagtcgtgcctgacccctgcgacaattgcttccatctcagagctccaagcactggcatatggcccttgaactttccacatccgagacactacgaggtgcggcccccagggcccagctcgaagccctctgaccctctgtggcccctcctcccccagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtgagaggtgtgggggccccatttttggagcagaagggaagggggcgtccattttgtttaccagtaaactcctcttccagcctccttccagcgggaggggtggggagaggaggggtccgctgcgccagggctgatcggtttggggcaggatggaggggagaggcaggatgcggaggaagtgtggaggaggtgggaggtccggaggtgtctgcgtggggtggtgacctctgagttcccctcccctaggtttgcacggacatcaacgagtgtgagaccgggcaacataactgcgtccccaactccgtgtgcatcaacacccgggtaaggcccgctggggaggaagaaaggatcgcgggaggtggggcgagcggcgggcggcctgcgctgacctccggcggctccggcgcagggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtggtgagtgcgggcgggctgggcttgaggcggggttgggtggcggccactccagggcacccacttacactctcccacagtgtgccgttggctgggccggcaacgggatcctctgtggtcgcgacactgacctagacggcttcccggacgagaagctgcgctgcccggagcgccagtgccgtaaggtgggtgggggcggagcggggcgggcttgggcaggagggagggcgggacttcatgaccgcgcccctcacaccttctgtgcccgcccccaggacaactgcgtgactgtgcccaactcagggcaggaggatgtggaccgcgatggcatcggagacgcctgcgatccggatgccgacggggacggggtccccaatgaaaaggtagatctacggctcggcacggtggttcactcctgtaatcccagcactttgggaggccgaggcgggcggatcacgaggtcaagagatggagaccatcctggccatcatggtgaaacccctcctctactaaaaatacaaaaattagcggggcgtggtggtgcacgcctgtaatcccagctactcaggaggctgaggcaggagaatcgcttgaacccgggaggcggaggttgcagtcagccgagatcgcgccactgcactccagcctagcgacagagcaagactctgtctcaaaaaaaagaaagaaagaaagaaagaaagaaagaaagaaagaaagaaagaaagaaagagaaaaagaaaaagaaaaaagaaaagacagagctgtgagcggggcctagggaagtgggatggggcgtggcttggatgaggggcgtggcctccgtggtctaggaggggcgaaaggttccttgaggaggagacgcgtcctcggagatttgggaatctgaggagtgtgacctttgccttctcgacctgatctcacccttaacccaccctgtcatccaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccgtgagctcgatgggggttggggggcgaggagaggcggcgggcaccgaagggcgggattcggctccggggcggggcttggctggttttggaagccggatggggtaagctggactagggcgccctggaccaaagaccatggtggggcgccagaaaaatgcaagctgggctgcaaggccaggaaaaacgcagggatatttggaagggaaggtggtccctgtgtcaatgccgcaggcaggaattaagaggacaagagattcgagcctggggtttaggacctgggaggtgacaactttacagatggggacataggggctcagggtggcacacacgggcacccagctgagccaccctgggagtgagagcccgtccccctcactagccttcccttggatgggaccattcattcttaaagttcctgtgggccggacggggtggctcatgcctataattccagaactttgggaagctgaggcaggtggatcacgaggtcaggagttcgagaccagactgaccaacatggtgaaactccgtctgtactaaaaatacaaaaatttgctgggcgtggtggcgcacacctgtaatcccagctactcgggaggctgaggcaggagaatcatttgaacccgggaggtggaagttgcagtgagccgagatcatgccactgcactccagcctgagtgacacaatgagactgtctcaaaaaaaaaaaaaaaaaaaaaaaaaaagcttccatgaagttgggactctgttccaggccagcctcaggctggcctcatcctaatgaagtcattctggcctggtcccaatcttggggctctggtcccgtggatttctgcagggatccgcaaccaggccgacaactgccctagggtacccaactcagaccagaaggacagtgatggcgatggtataggggatgcctgtgacaactgtccccagaagagcaacccggatcaggtgagggcaggccagactccagctgggtaagccctctgggtgaactgcaagttggattacccagcccacagcccagcttagagcattttacactgccagagaaatgacctctcggtccgagcagcctgcggtgggggtttccttggggtcaggaggaccttggctgtgcggctgggttgggtgggaggctttctgatttcctctgtctgattatggacccccgcatgctgccctccgcaggcggatgtggaccacgactttgtgggagatgcttgtgacagcgatcaagaccagtaaggaggccacctggggtgggcgtccgggtagcctttgacaaaacgctctggagagctcattgtctctggatcccacctatccactctagggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagtacggcgggggcggggcctgcggtgggggcggggccagtgggggctcctggcgcggggtctacggtgggcgggccctgactttagcccaccgaggggtctcccacctctcaggggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccaggtgggagcggggtccacgtggggggtgatgggaccctagaacccccacagtgaggcctatgctgaggacagggtgcctagggctgtcacggccagcctgaggccctcctttctttgaccccatcagggaagggagatcgtgcagacaatgaacagcgacccaggcctggctgtgggtgagaagcggggagcagcgctatcctgccacggagcgggctcagggagaggggccagagaaggggcaggcccgggctgagaatgggcggggccagaagggggctggcccgggctcaggaagggcggggacagaggggcggggttatatgggcgggcccgggaggagaaggcgcggggccagaggaggggcgggctcgggaagggcggggccaagtggaggtggactctggaggggcgtggccaatggtagatggggggcgtggctgagtccgggctctgcgagtgggaatggtgcaggtctgcaggcagatcgggacccagggggcaggtttgggttctgggtgccaggttccgggggctggggctggcgttcggaaaggccactgctctctttccatccctaggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggtgccagggccgtccgtgcctgacctctgcggtcctcatgccctcccatgaccctccgtaaaaccctttacagcccttagagccccccagccccctagcctcatactatggacctcaaagctgtcccagccctcctctgggctcccgcagtccccaaatcctcccagttccttgcacaaattctcaaacattctcagggccccccagtcttcctatggaccctaaaccctctcacacagccctaaacttttccttagtttccaagtccttctgcagagccccccatcctcccagaccctgaatctgtccacggactcccaaatcctctcatgaacctgcagaccactgctgccccctgtgacctatccccaagctgccatttggcccctgaagaaggcttccttgtgggtctctcatccggatccccctggccgcccaccacctgctgctcccaactgtctctccaggaaggtgtctaggggggctccggtggcccacgaggtctctgaccacctttcctgggtattggcaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcaggtggggactccaccctctgtggtgggctgggctggggacacacaggcccaggtgggagtgccctggccaggcaggggctgtgtgaccctggtcccctcatctgtacgataggaaagatacagggcagttagaatgagcctatgctggtccaggcgtggtggctcacacctgtaaccccatcactttggaaagccaagatgggaggatcgcttgagcccaggagttcgaggcagcctgggtaacatagtaagaccctgtctctacaaaaaagaaaaaaattaggccaggcgcagtggctcatgcctgtaatcccagtactttgggaggccgaggcgggtggatcacctgaggtccggagtttgagaccagcctggccaacatgttgaaaccccatctctactaaaaatacaaaaattagccaggtgtggtggcggggccctgtcatcccggctactcaggaggctgaggcagaagaatcgcttgaactcgggaagcggaagttgcagtgagtggagatcgtgccattgcactccagcatgggtgacaagagtgagactctgtctcaaaaaaaaaaaaaaatgccaggcatggtggcacgtgcccatggtcccagctactagggaggctgaggtcagttgagtctgggaattaaggtggcagtaattgcaccactgcactccagcctgggtgacagagcgagaccctggccaggacacagcacacagtgtgtatccagctagaaatggggcctcacccagtccctgtttctcagcctccattccatgctgctagcaagcccaggtgctctgtttagcaccaactatgtccagggcccttgatgtccaccacaccaggaaactgaggcccaaggcagaggcctcacttgctcccagtgcagcccagtcaggggtacccatcttccagggctggccactgaagctctgagagggaagggtctggcccaggtcccccaggcctcaccatgtctgaccctcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatggtgagccgagggccagcgggccgtgggcggggagtctgcacacaggccctgctggccttctcagccctcacccgcctgccctctccctgcagacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcagggagtggcggctgtggtttttgctgcatggagacagtagggacgggcctctgagggagggtcgggccagggaaccccaaaccaaggcctcagtgctgcagctgctgctgagtgccagtggcctgccagggactgtccaactgtgatttgggatttggggaggcccctgggtccacctccacgacccaccacctcatggtcacaggcctggatgccagccatggaagagctgagaccccgatacagtgtccgccccaggattctggggggcaggttcccagttgtcccagctttggggaccccttcccttgcctggtctggggtgtgtgtgtgtgtgtgtgtgtgtgttcggaagggttgaggcacctgccagtgcacctgccacgcccatgtgtcacccctgagggaggagggaggggctcagaaaaaagaggaagagccagtgacgaaaacgttggatttttattacgtttcattacaaaggatgcaaaggtacaaagacaaaagcagccctgccagaggatggggcagggacggccgagtgtgccctgagccgcctgcccccgcccgctgcggccgcccacaatcatggcccacgggacgtccgtggcagagtatacatgctagggttgggggagagccagcctgggcacagaggagcacaggcaggaacagggctcggaccggcgggtttgcatatatcagtggggccacccagcccctaggggacagtttcctactcaggggcacggcagggccagtggactttggctgccaaagccctccctccccaggcctactggccaagtccatggctaagtcccctcctggtgggcaggagatcagaagttcttgatggctgggctgggcaagggttgcccccaaattccagaacacttcgagatgggggccatcccccgaccccaacacatgccacctgtccctggctcctgggggtggggtgctggccaggagcccagaaggtggatacaggctctggaatcatcagagccagcaccaccccaaggcccagcccctgccccccatcctgcccaggaggagcccggggccctgagacctgcaggtttgagaaagtgacaagagagaaactgaggctgggatcacgaggcactcactcctgccccacccatgccctcaggaactccccagcacccaggcctgggggtacaacttactccacctcctgctcccagggggagaatggtgtctgtggccagtgggggtgggtggacacctgtgccacacggaagagtatggggtgcctgacccctgcctggccaggaccctggaaggccaagggccgcagggaacaggacacttggctcaggtggagctgacgggagaatgtcccagggacccccaaatcacatgccgcaagagcccccaggaaatggaggcccctggtccatggtgaatgggggtagaaagagacccaggtgtccatgtagcccaggcaggcctcccagggtgagtgaggggccgagtcttgcccctgctcttaggctgtgtagggaaggctctggcgcccgcacgccctggcccagggcaccacatgtgggtgacgggccaggcccaggggcacatctgtgccatcggctttgtggcccttgctctgagagcccctgcgtcccacccccacacagagggcccctcggcctctgagacggctccatcgggacccagtgaaggtgatgggagctgctgttttcagggcgaggtgacagaggacccccgaataccgctggaccttactccaccagcctctccctggtcggagggctccttggaaatacagaaaactcaggaagcaggtcgcagcccgagtttggaaggatgtttggttaaaaaccagctcaaggcccacctaagggaggcaccagagccccctctagggacgggtcctgccaaggctgttcaggcctgggatgctgggcagaagtggctcacacctgtagccccagaactttgggaggccgaggaggg

SEQ ID NO: 15989 - DNA, 7007 bp, Human; identical to SEQ ID NO: 12430

SEQ ID NO: 15990 - DNA, 48039 bp, Human
  misc_feature (1)...(48039): n = A,T,C or G
attagatttttccacgaatggcctacaatttgataaacactttcaggactaaacggctagcaaaaatattcgttaaagtcgttatgcagcattttaattcccttcactgataacacgcaccctgagtatggcttcaaagacccactcctacgcgagaaacgacccgaaatgctctatatgccttccttttaaggggcggggggatcctttgatgtaactcaacaaaagcatacagcaatttcgtcacgtcacaaacatctgaactcgtttaccgaaatctaatctgaggcgtttatcagaagcaaagaaaaaataaaatacggcccacggaggcctaaggagtgaggcatccaccattaatgactctaccgggaagcagatatggccttacgttatttcgctaaaaatcccaaggccaaccctgccaaagaatcaacaacccattttacaaacgaaataccagattcagaaagactaagcaggttgccaagctggagagctggatctgccgacctctctccacccccccccgcccccccccggagcctcaggccaacggaattaacgttccgcgtcccctccctcgcctcccgcaacgcccgcgagggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccggtgagcaggatgttcggaagcaacatggtccccgccgcgacggcttcgggcgcctcgctcacgtgccctttgctctacagggaggagccggaaggggcgggcggcagcaaaagcccacggccccaaaggccccgaagcccaccgcggcgcccctagcctgccccggcggcccagccgcggcccactggttacctggctttcgatgacacatttccgtcgcaaagttggagggtgggcataactcgggtcggtacttcgggtcaggcagtgcgctggatgcctaagtcacacactccttcggtggtccccgcccttcgcttgcgccgaccagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaaggtaagtacatagtatgtgtggtttttttgtttttttttttctaatacatcattgagttcatgtgaaaaactcttaacaccacaagtagattatttgatacagttatagtcattaaaattattttagaattttgatttcttgtatcacttaaatttactgttctttttcactagttcttgagcctttattgtattgttgattatatcagtatacatttattactataattgggcatttacagtttttcttcatttgagggcttcttccccccccccccaggtgaattatagtttaatgtactgcaagtcctaaactacggatgggaactattacagtttataatgtcaaaaacttttcttagaccaaaggtatcttccacaaaggtatgatacactggaatggccatgtaataattgccttaaaataattataaatttttatatatattcttaataacttattactgctatcaaagtaatagagccgagtatctattgtaattaatgatttaagcaagtctggtaataagttgtgaaacaagtgttctctaaaagcacaaccttaattttgaaaaagtgttttacagtcccagtcacaaaggctgaaaacatttgaatgaaagaacatagaagagagaaatatgagtggtagttggtgttatagcttaaccaaaagcactgcttcttagaagtaatgtaattcagtgtgtgagttctcagcaagataggggttaaggtgggatgggggtcagacagtttcatgcatgcagggtagctatttccctaagtggtagctctaaattttctttgatgttaagtaagttacttaactttgctgtttatctttctctttttttcagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtagctatgactaaaattttttccagtggtcttccttttttaatccactgccgataatattcctaactctgtcttaaaagaagagtgaagtgtgacttagcattcgtaaagtatttataagccccaaattgtctcccctaagcctactttcagctccaacttctggttcattttcttcaagagaggaacattgtctaataaatagctcaactgtggctgagtattcttgaaagaaatatataacttggtttctttttgttagccaggcagtagattctacaaccagatctgaagctatatttttctagatttatgctattagagtgttaaaaaatctagtaaaaatttctaatttctaattatttgtaattattagctaataatttctaattattagcaaaattttttttttgagacagggtctcactctgttgcccgggctggagtgcagtggggtgatcatggttcactgcaaccttgacctcccgcgctcaagtgattctcccaccttagccccccaagtagctgggaatacaggcgtgcgccaccatgcctggctaattttttattttttgtagagttggggtctccctatgttatgctagctgttctcaaactcctgggctcagcaatcctactgcctctgcctctgaatgtgctggaattataggtgtgagctaccacacccaaccattcccaggcatttctgagtgacagttccccctctggaaagcctgcctcaattataaaaatattagttgcttcatacactgaagaaaaatataatccagtcataattacagattacgttatgatctttggcctatatcttcactaagtcttcaagctgatacggattatttggatgtatgaaatggttcttagtttgtgaatgtattaacctggccaaggcagatatattactcttattgctgtttctgttaaaatattatcatttgtttattttgttttgctttttttaataggtaattttaatatttatgtttcaatcctacagagagtttaaaaaaatcattctagtgtttatgctgggaaggttacaattaataaaaataagtttgtgttctttactcctttaaggtcaagtagacaagtatgcacttgcacttactgtaaagtagaaaaacaactattacagacagagttttatttaaaaagagttaatttgtaagatttttaggccgggtatggtggcttatacctttaatcccagctctttgggaggctgatgtgagaggatcacttgagcccaagaattgtttgagaccagcctgggcaacatggcaaaaacccatctctacaaaaaatacaaaaaaattagttgggcatggtggtgcatgcctgtagtcccagttactcaagaggctgaggctggaggattgcttgagctgagattataccactgcagtccagcctgggtgacaaagtgagacccggtctcaaaaaattttttttttttttttttttttttttagttttaaaggttataaatatatgaatatgttgtttccagagtagttcagttatttgggggaatagatgggagaaaatgtgattatatttacatgatttctttttttttcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcaggtactgaaaagcatgcagacatatctacataatttaatttcagggtgcataagggtagatgggaagcagagggatttacattttcagattttttactcataagaatctttctaagtgttagaaaaaattctggatttttttattttccaaggcttagatttttctcaatagttattctaaagttgtgtgattagttgtcttagatttaatttaatcccaacatagaattgatctttttaaaaatttttgtactaaatgtaatactcctctctactgtcttctcaaaatgtatttctgaattttaaaaaatgttataactgcaaacttgccaaaattatcatacagaggtatcaacttaagaatataatttttccataatagtataaaaattcaagtataatcaaaaggatcattttattatatagattgttactgatttgctacttcttttcgttaataatgcttaggttcatatgtgctgatgtaccaaaaaatcttcagttaagaagttttgttttaaatttgaaatttttgttgtagcatgaacttgctgtgcataaaaagaaaattgaagaagtcgaaacctggttaaaagctcaagttttagaaaggcaaccaaaacaggtaactaagaaatgtgtttttaaatatttaacatcaaatatttttctgacttacagtgtgttgttagaagttaaagttttatgatgattttgttcaaaataagtctagatctcctgcagtagaaagctccctagtggggcatggtgactcatgcctgtaatcccagcactttgggaggccaaggcaggaggatcacttgagcccaggagttcgagagcagcctgggcaacatagggagactgtctctacagctaattagctgggcattgtggtgcatgcctctggtctcagctacttgggaagctgaggtgggaggatcgcctgagcccagaaggtggaagctgcagtgagctgtgatcacactagtacactctagcctgggcaacagagcaataccaaaaaccgtaaaaagcaaaacaaaacaaaaagcgaaaaagaaagcttcatgactttactacttccaacttgactaaaagactcagagactttgagttttcccctttatttgtaactctttttctttatgtcttattgttagcataaagaatcagtaaaccaattagggtgctagtgtatttagcacatcagattatctcaggctgaggaaagcaggcaaattacatgttagtttctctactaaatatagccaaaaacagtcattatttattttagactgatattttttgtttcacttccttactgcacaattaccttgaacccccaaggtagaatattctctccttccatcagtctccctttttaaatgttttttattttgagatttttcaagcataaaagaaaatagaataataaaaaaatatatatagaatatactcattgtttcccccttaagtattttaaagtaaattataaacattgtgacatttcagttagacttttagatacttcagtatgtctctgtttttttaaaaaaatgattttcctaattaattatgcataccattattctctctaacaaagttaaccaggatgccgtaatgctgtctaatgatgaattcatattcacgtttctgcatttgtccccaaaatgtcttttgtagctggtttgtttcaaacaggataggatcacacgttgcatttggctgttatatatcttaggcctttttttttttccctgaatctaataatagtttactaaccctttcttttctccaaggcactgacttatgaaggagaccaggccggttgacttgtagaagtctcacactggatttgttaggttgtttcctcctaataatgattaacttattcgtctatcctgcatttcctataacctgaaattttgaatcaagggcttgattagactcaagttgaacatttttgcaagaataaaggtcatgttgtatgttgtatagggcgtcaaattggaaagtatttgtggttctcctgctgtcttaagtttggtcactagatcaaagagatgaaagtcaaaaatcttcattgtagagtaactttccctcacaactgacacataatccatggggagataccgtggcagcatgtgagtgcccagttctccatcagtcgtccacctaagtgctgtagcttcagtttttcaatccttgcctgaatcacttattttattagagttgtacagtagtaactttcttatagttctgttatttctacagttattactggcatttttctacaaagaaaagtttgccatcactagctagggttgtttagttaccttgaaatacatttccaactagaaaggcaggataagttttgtatcttttccttttttaaaaaatagacttatttttggagcagttttaggttcacagccaaattgggtagaaggtacagagatgtacctcatatcccctgccccaacacatgcatagccttctcccgttactaaccttccctcaccagagtagtacatttgttaaaactgataaacctacattgacacatcactaacacccagagtccattgtttacattaggtctttcctttagttttcaaccttgagatgaaggagttggtgttttagttgctttgatggtaacagatccttctctctttttttttttctcgagagtcttgctttgtcacacaggctagagtgcagtggcatgatcttggctcactgcaacctctgcctcctgggttcaagcgattctcctacctcagcctcccgagtagctggaattacaggcatgcgccaccacacgcagctaatttttgtatttttaatagagacagggtttcaccgtgttggccaggctggtcttgaactcctgacctcaggtgatttacccgcctcggcttccctaagtgctgggattgcaggtgtgagtcatcacgcccagccaatcctcctctcttgaaccaagctcctttctctctggcctgtggatctaaaccttttggtttagggctaagatcatgaattcaagttggattttcagtgtcagcattggtattcctctgatgtttcatagaaatctcgtctcttgtctccgaatacagatttttgggcagtctatctgacacacctcttacatccaggctttttctcattgatttgtttttggtcagcttagctaatagtttttatttttcagtgtccattgtgttttctcacttagcaatactccgtcagtataaacattgtcacatcataaacctacattggtgttactattattattctaccagttggataaacttaggtatatatgtgtgtgtgtgtgtgtgtgtatgatatatatatacacacacatatatatacgtatatatatgcatatatatgtatatatgcatacatatatgcatgcatatatatatgtatacatatatgtatgcatatatatatgtatacatatatgtatgcatatatatatgtatacatatatatatgtattgggaaaagtatttatggtttcaaaagttttccccctaaggagttggactttaatcatatactctgtttatttgtttattaattttttagagacagggtcttgctagagacggttgcctacactggattgcagaggtgctgtcatagctcactgcagccttgaactcctgggctcaagcagtcctcccacctcagcttcctgagtagctggggactgcaagtgtgtgccaccgcatctggctaattaaaaaaaaatttttttgtagagatggggtcttatggtgttgcccacgctggtcttgaattcctggcctcaagtagacctcccacattggcatcccacagtgtcagaatcaataggcatgagccacaccatgcctggcccaaatcacttaccatttattttacagaagtttcagggatgtcagtaattagaaaatgtttttattcaaaaaaattggtaagatctagatttatcaatgggcaaacgaaatttacttttcaaaatttattttaaatacgatataccaaatatttgcagagtttaatttttcaggacagcttctttccttcaaaattcagtaaaactctgttacagtgtagacaaatgggattaacaagattcttcacattataatgtcctgataagaaactacctcctagttctcttactggaagggaaacttgctatgtggctgtacccactctgtcagaaaacaggcacttaagtatattattacatgagaaaaatgtataatgcctgtgcataggcttctttttctttgtaaagaagtgatctgtctggtattgtagttctcattattcaaggtagttatgttctgtaaagttgctgaattagcaaatactgaaccattattctaagaaaaacactaaattaggtttttgcaaacctctggtaacaacatttttgtcaacccatcaatatatagccttgttgtatatgtgtttttatttaaagttatttaatgttcagtcatgcttcaattaatgatggggatacattctgggaaatgtgtcattaggtgacttcattgttgtgagaatatcatagagtgtacttacacaaacctccacctaggctatatggtatagcctcttgctcctatgctacaaacctgtatagcttgttactgtattgaatactgtaggcaattataacacagtgggaactatatgtgtaaataaacatacctaaagcataccattaaaaagtacagtaaaaaggccgggcttggtggctcaggcctataatcccagcactttgggaggtcgaggtgggtggattacctgatgtcaggaattcgagaccagcctggccaacatggtgaaaccccatctctactaaaaatgcaaaaattagccaggcatggtggtgtgtgcctgtagtcccagctatatgggaggcacaagaatcacttgaaagcgggtggcggaagttgcagtgagctgagacagtgccactgtgccccagcctgggcaacagaacagagactttgtctcaaaaaaaaaatattttttggtaaaaacatggttataaaagataaaaaaaatgctagtatacatttatatagggaacttaccatgaatggagcttggactggaaaatggttaagtcagtgactgtgagtggttagtgacagtctaaggacattactgtgcactattgtagacttttataaacattgtacacttaggctacactaaacttaaacagttttttatttaataaattaaccttcacttactggaactttttgtaaaggccatgtgaaggactttatgtagcttttttactttataaacttttagattctttgataataacacttagcttaaaacacaaataaatggtacggctgtacaaaaatattttgtctttatatctttattctataaattttttttgtatttaaaaaaaaatttttaagcttcttttaaaattagaaatgaagacacaaacacaccaattagcctaggtctacacaggattaggatcattaatagcactgtcttccacctctatgtcttgtccactggaaggtcttcagaggcaacaacacgtaaggagctgtcatctcttatgacaacagtgccttcttctgcagtacctcctgaaggacttgcctgaggctgttttatagttaacttcttttttttttttttgacagagtttcactcttgttgcccaggctggagtgcagtggtgcaattttggctcactgcaacctctgcctcccgggttcaagcgattttcttgcctcagcctcctgagtagctgggattacaggagtgcaccaccacgcccgggtagttcttgtatttttagtagagatggggtttctccatgttggccaggctggtcttgaactcctgacctcagatgatctgcctgcttcggcctcccaaagtgctgggattataggcgtgagccactgtgcccggccaacttttttttttaaaaaacaagtagattctaataataaagatgggcactgtaaatacataaaccagtaagatagttgtttattataattatcaagcattatgtgttacacataatgagatatacgtgttacacttttatacagcacagtaggtgtgtgtacaccagcattaccacaaacatgagtgatgttttgcattattgttactaggaatttttcagctccattataattttatgagactactgtttatatgtggttcatcattgactgaaagttgattatctggcacatgactgtatattgttgatccatatagtttgaactcatggtgaacagcgctataactcatgcactgcccctttcaaaagtggagcaggctctctttgtccaagtacataggttcttattaaaggaaaataaacaagaattatagcctaccattgtatgtaggaaatcttttgatatttctgtagcttcaacttttttttttttaatcaaatttacggtatgagggaatgttactgggatccacaacctctagtctctcgttagagtcctatctctggtaaatatgtttcttttttttccttttttttttttctgagacaggatcttactctaatgtgcaggatggagtgcagcggcaatcttggctcattgcagcctccacctcccaggctcaagtgattcttccacctcagcctcctgaccagctgggactataggcgcacaccaccatgcccagctaattttttgtattttttttgtagagacagggttttgccatgttgactaggctggtctcagactcctgggctcaaggaatccgtctgcctcagcctcccaaaatgctgggattacaggtgtgagccgccgtgctcttcccaaatatgtgtcttaatatgcatttcttaaagaatctaataaccaaactgaggtctttccataagaatattgtatttgtataacagtaacttatatcatccaatgagatgtctatattaagaataaattttgctgggagcggtggctcacatctgtaatcccagcactttgggagaccatggcgggcaaatcacgaggtcaggagattgagaccatcctggctaacacggtgaaaccctgtctctactaaaaatacaaaaaaattagccgggcgtggtggcgggcgcctgtagtcccagctactcgggtggctgaggcaggagaatggcgtgaacccgggaggcggagcttgcagtgagccgagattatgccactgcactccagcctgggtgaaagagcaagactcgtctcaaaaaaaaaaaaagaataaattttatgagttcaggtaacctctaaaaatctttgtttcagacatcacctccctaatttagccaaagtttagtatttggctactaaatagtccttgagagggacataatgcaaaaattgagaaattatcagaagcggaattgagagttgaagaattaagattctcttatttccatatttgcagatgtttttgtatggaaaaggggggaaaaaggcaatttttaaaaaagaaaaaaataaagctggtttattccagcaagcattattatgaaatttaatgtgcttatatgagacattcagcaaatatttatagaagtaaatatatttagaatgaaaagtcagaaataatattctagcattccagtgattttggtttttaattcatatttgtatttgattttagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactggtaagatttgctgtgaaggtagtagaagtagtggggcaaacctgtgcttaagggagctttcagataaagttctatgagtgcattttttcccatacttcttgctttcagagggatggaatttcacaggccaggtgcgatggctgtcacatgggaggctgaggcaggaggattgcttcaggccaggagttaaagaccaggctgggcaacatacaaagaacctgtctacaaaaataaaaaaatcagctaggtatagtgttgtgtacctgtagttctaactactcaagggctgaggtgtgaggatcacttgagcccatgagttcaaggttgcagtgagctatagtgttaccatcgtgctccagcctgggcaacagaatgagacattgtctcaaaaaataaataaataaaagttatttcaggagaaggaaagaaagcatgtctccaatggaagacaatggaattttttgaagattaagtcttaactgttttgttaacatattcttctgtttgcattatttatctgcttttttctaagatctggctaggaggttagacagtattaactaagatattttatttgttaaatcaagccttaagatgtgttaaaaagaacttgccccccaacaagatagcttagatcagtaagtacctgttagaacaatatcaaatgaaagcaaaagacaaagatgtctttggaatttggaaggaggccttaagataacgatttaaaaattgataatagtaacaattttatttatttttattttttttgagacagagtctcactctgtcgcccaggctggagtacaacctctgcctcccagactcaagctattctcatgcctcagcctcctgagtagctgggattagaggcatgtgccaccacacccagctagtttttgtatttttagtagagatggggttttgccatgttagccagtctggtctcgaactcctggcctcaagtgatccacctgcctctgcctcccaaagtgctgggattataggcgtgagctaccatgcgtggcaatagtaccaatttaaagatgtaatacgttataagttcatgcatatgcttatgtaccttagcactatcatttttatctttcatagtttttcatattgcaactccaggtggtgaaactagggatagccaaatctcctaggccattttgaagggaaaagggttctgtagaaggataattttaatgtggagtgttcctcaaaatcccttctctggactcttctttaatgtactcccttgtgctactagtatcccatcctgctggggcttttactgttttcttttctttattattattattactattattattattttttttttgagatggagtcttgctctgtcacccaggctggagtgcagtggtttgtctcactgcaagctccgcctcctgggttcaagcaattctcctgactcagcctcccaagtagctgggattacaggcgtccaccaccatgcccggcttatttttgtattttttagtagagatggggtttcaccacgttggtcaggttgttttcgaacccctgacctcaggtgatccaaccacctcggcctccaaaagtgctgggattacaggcgtgagccaccacgcccggcccattattattatcatttttttaagagagaaagtctcactatattgtctagaatgaacttcttaagcatttaagggattctcacgactcaacctctggggtagctgggactacagacgtgtgttcctgcatctggcttttactgctttctaaatagtagcattacttttgacagtctgataagctttaacttaaacagtcttcaatatgaaacatgccttcagagagcttccctcattctcaagttcactaatcagttattctgtttttgttgttaaactttatcactccagcctgaccaacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtctcaaaacaaacaaaccaaacccttatcactgaaggtaattcatttataggcttgaactcatttagagattcttcattgggtaggccacagtcatagatatttttaccaattatatgaatgttataccgacagctgtgttcttaggtcagttaactccatattacacagggtctcactctgtcacccaggctggagtgcagtgacacaatcttggctcactgcaacctccacctcctgggctcaagctattacccccaccctctgcctcagccctgcaagtagccagaactacaggcacaagcctccacacctggctaatttgtgtatttttttgtagagaccgggtttcaccatgttgcccaggttgctcttgaattcctgaggtcaagcgatccacctgcctcggcctcccaaagtgctgggattacaggcgtgagccactgtgcctggctacatgttgactcttgtcctttgaaaggaatatcctattttaaatttaaatgatttttcctaattgggaaatagtctacagtattgtgagatgcatcaagtatgtgtgtgtgtacatacagatgtataatattaatgtatatcatttgttgaaaataaaagtggttatgtgtttcctttcagaatcaagcttccatatgtttccctatcagtctcagatagcagttttcaaagagtttctactaagagcgacaaagtataacaagttacaaatgcttggagatgatctgagaactgataagaagataattctggttgaagtaaggacaacttttaaaatctttttttttttttttttgaaatggagtcttgctgtgtcactgtcacccaggctggagtgcagtggcgcgatctcagctcattgcaagctctgcctcccaggttcacgccattctcctgcctcagcctccggagtagctgggactacaggcgcccgccaccacgcccggctaattttttgtattttttagtagagacggggtttcactgtgttagccaggatggtctcgatctcctgacctcatgatatgcccaccgtggcctcccaaagtgctgggattacaggcgtgagccaccatgcctggcctaaaatctttttttttttttttttttttgagacagagtctctctttaacccctaggctggagtgcagtggtgcagtcttggctcactgccacctccgcctcctgggttgaaacaattctcatgcctcagcctcccccgagtagtggggattacaggaacctgccaccatgccggcctaatttttgtatatttagtagagatggagttttgccacgttggccaggctggtctcaaactcctgacctcaaggtaatcctcccgccttggcctcccgagtgctgggattacacatgtgagccaccacacccagccaacttttaaaattttgctgtagctattgactaaacaattgtgagatatatcttacatgataatgttaacttgtctctatagtagtgatattggtaaaatacaacacaaaggctttgtaatagtagaaacctaaagtctcttctagtaaacttgaatggaatagctgtaggataaggaatgttataaattttaatggtttaagtatagaaaaacaaaagaaaagttgggaaaattacttcctagtgaaaatactgtaactggaaagcaacccaaagaaatttgatctaaaaattgggatccccattgatgtatattactgtttcggatatcatctatttcatgtttcctgtgaaagttctgtttaaaatacattgaataaatatatttttgcctacctcaataaatataaatttgaaaaataaatttgcaatggaataaaactatactattatttattttttattttcaataggatttacctaaccagttttatcgggattctcatactttacatgaagttctaaggtaggtttcagtgaagtattctaaaactccaaattaaatgagaagtggcttaaatttcaacattgctgtattttgttattttaggaagtatgtgaggattggtcgatgtcctcttatatttataatctcggacagtctcagtggagataataatcaaaggttattgtttcccaaagaaattcaggaagagtgttctatctcaaatattaggtaagaaagaaatttctgcttataaaggtcacatacatattatatttttaaattaatcatttaactgctatctttctttataaaacttagtttcaaccctgtggcaccaacaattatgatgaaatttcttaatcgaatagtgactatagaagctaacaaggtaagtctctgattaattaaaccttactcgataactatagaaagcctagcttaaatagtattatgtaaactgaaggagtgttattttaattttttagaattaaaacattttattatactcataaggcatgtcattttagcaaatgtaggaaatactgattttaaaaatctttaacatttttctactattaaactttcactttcacattgaggtaaatttttcctttgcttggtttactgttctaaattgtgtctgtcatcaagaaaatgttttctggcatgtaggtatggtagttatcaacaattcaactcttcctattgtcctgttgtcacttttttattttcacattttttttaattatggtgaaaaacatgtatcataaaatttatcatcttaaccattttcaaagatacacttcagtattgtaaagtctatttacattcatatacagctgttgtcacttttttttttttttttggagacagggtctcactctgttgctcaggctggactgcagtggcataatcatggctcactgcagcctcgacctcttgggctcaagtgttcctcccacctcagcctcccaagcagctgggactacaggctggtaccaccacgcctggctaattttttaattttttttagagacagggtctctctgtgttgcccaggctggtctcgaattcctggctcaagtgatcctccctcctcggcctctgaaagtgctgagatttcaggcatgagcctctgtgcccggcttcttttcacttttagtacgtcattttttctgtatttcaaatcaagatgatgttaaaaaaaaattgatggaccttctgctcccagcgtcatggttttagggaatcctattggtataaatcaaccaaatcttgcatgaaacataatttttgttgcactgctaggaccacaggaactgagggaaatatccaagggagaggttgttttgaggattaaatacgttagtgtagagcacctaactgaataaataacagatattaatagtgaaaaatgagaaacaaactgagtccaataatacaggaagcaattactgtgatgaattattatgctattagtgttttgaaaatatttaatgggtcaggtgcggtggctcacgcctgtaatcttaacactttgggaggccgaggtgggtgtatcacctgaggtcaggagttcatgaccagcctggccaacaggtgaaaccccatctctaataaaaatacaaaaattagccggatgtggtggcgggtacctataatcccagctactcaggaagctgaggcaggagaatagcttgaacccagggggtggaggttgcagtgagccgagattgcgctacttcactccagcctgggcagcaagagcaaaactctgtatcccaaaaaaaagaaaaaaaattacctgggcatggtggtgtgctcctgtattcccagctactcagaagcctgagacaggatgatcgctggagcctaggagtttgaggctgcagtgatctagatgaaatgactgtagtctgtcatggacagagctagaccctgtctctaaaaaaacatctacattctctactataagcatgagaactgcaaattgagccatggtgcatgcctgtagtcccagctacaaaggctgacagtggtgggaggatttgttgagcctgggagctcaagaccagcccaggtgtgatatagtaagaccttgtgtcaaaacaaaaattttttttttagtgaattgattagttcaagtggctctggtttaaaaaagaagaagaagaaataattggtgtaattatggctttttcatcctcaccagactgtataatgtataaccccagtaaaggaattttcatgtaaatttcataaattagttagattattttgtgtatatttaattttatcacagtctgttgcattttgagggtttttttgtgtgtacacatatatgttgttatatatctgtgtgtatgtagtgagaaagagtaaaaacttcaaaatacaacctggtcaaagtgaaaaagtaaaataatacagtatttaatatttcctgaaagtataccttaaactgtaataagtcattgaagcttgtatcattcatagaccagtgtttagcatgaaggctttttagttttttattattattttaagataattttttttttctggctctattgcccaggctggagtgcagtggcaagatcatagctcactgcagccttcatctccaggtctcaagtgatcctcccatttcagcctcccaagtagcagggactacaggcgcatgccaccatgcccagctaattgttttgattttttgtagagataaggtcttactaccttgcctaggctggtctcagactcctgagctcaagtgatcctcctgcctcagtctcccaaattgctgagattataggaatgtgccaccgtgcccagccctttttagtatttaagtttaaaagaatctaatttacgttaattaagtttagaaaataggttggggttttttgttgttgttatttttaagaaaatacttttttttaaatttaattttcttattttagaatggaggaaaaattactgtccctgacaaaacttctctagagttgctctgtcagggatgttctggtgatatcagaagtgcaataaacagcctccagttttcttcttcaaaaggtaactatggaagatacagtcatgtggcattatataggtgactgactttctcttaattcattcaatgaaatcaaacattttaacttacatttggtctatacctatttatccttctttattactgagacagtggcttaaaattaaatatatacacatgcatacatacccttctatgaatatgtcgtagtatatatccttgtttctgtttgagatagtttacctttcaaagttaacttagaaccagatttcctggataaaaattctgcctctgccacttaccagttatataggcctatgcaggtgactcttatctttctgtgcctctgttttctcaccttttatgtgagcacttacctcttagggttctatgaagaatatgtgaggtgacactattatagagtgcttcttacagtacttgattcatattaagtgttcaataaatggccagccattaatcagtttaataatactgtgcagaggtaggtttacttttggaattattattatttattttgagacggagtctcgctctgccgcccgggctggagtgcagtggcatgatcttggctcactgcaagctccgcctcccaggttcacagcattctcctgcctcagccttctgagtagctgggactacaggcagctgccaccacgcccagctaattgtatttttaatagagatggggtttcactgtcttagccaggatggttgctatctcctgacctcgtgatccgcccgccttggcctcccaaagtgctgggattataggtgtgagccacctcatctggcctgaaattatttttataataatttatgagatatgtttaataaatttatttcctgttaatgttaaaaagtataaatttatgagatatgtttaataaatttcctgttaatatgtagaaagatgtagtaaaaagatagtttcactaatggcagtgagttacatttttactgtaatggtcatcgtttactgcatagtcctccttcagaaggcatttagcagactacttaatgcttaacgttgataattgacatcaaagagtgggccaggaactgtgttagcaattatgtttttttcatttaattctcatatcaacctgatgagatagacagtattttgattcaaatccagatcctgtgctctttctgctgttcaaggtagcttttaagccatgcactcttgagttctaaatattagacttaaaaatgaaacttgggtcaggcatggtgactcatgcctgaagccaaggtgggtggatcacttgagcctaggagtttgaaaccagcctgggcaacatagcaagaccttgtctctacaaaaaaattaaggaaaaaaaataaaaacccaagaaatgtgatcacatgcatattcataaattggatactctcaacatcaatagagaggttgttaaacatagattgcagaaccaggctgcctggattccagtcattcactcactgatgaccttgagccaatgactttacctctttgtatctcatttcattaactgtctaataataattggtcaggtgcagtggctctcgcctgttatcccaacactataggagactgaggtggaagaaagcttcaacctcaagagtctgataccagcctgggcaacatagcgaggcctcgtctctaattaaaaatatatatatatatagccagcatggtggtgcatgtagtcccggctacttgagaggctgaggtgggaggatcacttgagcctggaggttgaggcttcagtgagctatgattgtgccactgtactccagcctgggtgatagagccagaccctgtgtcaaaaaaaaaaaaaggccgggcatggtggctcatgcctgtaatcccagcacttggggaggccaatttgtgtggttgggaggttgtgaccagcctggccaacatggtgaaacctcatctctgctaaaaatacaaaaatttagccgggcatacacctgtaattctagctgctcgggaggctgaggcaggagaatcgcttgaacccaggaggcagaggttgtggtgagccgagatcacaccactgcactccagcctgggcaacagagcgagactccatctcaaaaaaaaaaaaaaaaaattctcccttcacagggttgttatgaagattaaattcctatgtattacatgccaagaacagtatcttgcacataacacgatgagaaaccaaggcgatgtgactgtacaggttgaatatcctttatttgcaatttttgggaatagaaggattgcagatttttttaagattttggaatatttgcattatacgaattgaaaatcccttgtctgaaaatctgaaatacaaagtgctccaatgagcatttcctttgagcatcatgttggcactgcaagtttcatattttggagtattttggagtttgaattttttggatcaggaatgtcagcctatattagagattgtgctattgtgcatgtgaaagtttgaaatctgcattatgaaataactttcagataatactttattccattttaatgttagtaacccaaagaggattccaactcagttaatgtcatttataatttttgtttattaggaaaacaaattgtaattagaatatttagtgtaactatatctgaagtgttcttagttttaattttcatattttaatttaaatattgtcacttggatgtatattattcaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagtaagaaatttttacacttttaaaatctgttggatatcacatagtcttaaaatggaaataaaatgtcacttttaaaaaaatgtcatgtattttggttctgctctaagagttagagctaggtcagatactgtttgcctaggcctaagacatagtaggaaatcagaatattttctgaccgtaagcaggattaaaagtaaaaacatgcaattgcaggccatatccatgtgtgtaaatctttaaaattatagtttgctgaaggtaagagagcagatcatctagacttgtagtggcaagtgttggtagcctaaagccctcttaacactgggctccagccaacagagccttatacaaattaccaggtagtttaaggtttctttcaatcgtcttgtatttctctaatttacaagcgttctgtctccccaaccagagatgtttatcgccttttctgtcttttttgatgactgctccccctcagttctttcactccctattgcccattttagtgtcccaaataatccctccttttgatagcaaatgcctgttttcagtctgatgaccctaaaggaaagaaattaggatttctaaatggaaaccttcataccatctgaggaaaatgggcatcacttaggtggcagtgaggacactcctctgtcactggatcctcttactttgaacctgagtgactattcccacctgattcttttctttctctcctttcttttcctccccaacatacgtttatcgtctcttgcattagtgaatggaattcgtattctttcatgtagagagcaacatcttcctacatagtaaataaaagagtaaagaccactgtattgagatgagaaatcaagggaagaaagcaacccaaagctgaaaaaggtgaaatgggagtgcattaggaaatggaatattttaagtctagagaagccataatctaagcatcagaattgttaatttagttcttgctaatgtggaaaaaataggtgcttgcttccagttgttttttatttatttattattttttaacagtttgttactatgttggtattgtatgtctaaaattttcaaactcttcaaatgagaggtgctatataattataaagaaggtattatctttaataattccagaaattttttataggagcatctttaacagaattagactcacctcggttgccctctcatttatcagaatatgaacgggatacattacttgttgaacctgaggtaagttctttgatgacacttagtataggttacaaaggatatattattcgtgtgcatatatatttgaccattgcatttttaccaaatttatgtatatatgcttctttttataggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatgtaagaccatttgacttaaaatgtttatgtttatagtatttccttagaattaagaaaagaaagtttacttttatccctaattgcctgacattattttatgtgacttttcttcataactatgctaaagttaatgtaaccaactcagtgtttataatgaagcttcagtagcaaatctgatttttctgctgataatatagcaccaattgtttctaaagttattttctttttttcttttttttctgtgtgtgtgtgtagagacagggtcttactgtgttgctcaggctggtctcaaactcctgggctcagacagtcctctcacctgagcctccgaaagtgctgggattacaagcgtgagccaccacactcctgtctctaaattttctgattttgtgttttgtgttatggtggtttttttttttttttttttttttgagaagaggctctatctacagctatgttacccagtctggtcttgaactactgggtttagggaatcctgtcctctctgccttcgaagtagctagaaatacaggcacacaccaccatgcccagcttatttttttttttttttcgagacagcgtcttacttttttgcccacgctggagtccagtggtacaaacatggttcactgcaaccttgaccttctgggctcaagcgatcctccaacctcaggcactccccatctagtagctgggactacaggcaagcaccactatccttagctaatttttttttctttgttttagagacagggttcaccatgttacccatgctggtctccaactcctgagctcaagcgatctgcctgccctggcctctcaaaagtgctgggattacaggagtgagccaccatgcccagccccagcttattttctgattttaaaattaatacatactcaaaatatgacaaccattaagaagtagatacaagagaaagaactgtacatgttgctacactttctgctagtttttaaaatttatttcttttacatatttgaaactatttaccataaaatttgtattttgttcttaacatcttaacactgcccttaccagtacaacagccaccaaccacatgtagctatttacatttaaatttaattaaaaattcagttcctcagtcatactagccacatctccagtacttgataactgcatgtggctgatggctactttattgaacagcccagatacaaaacatttccatcattgcagggcgttctgttggacgacactattttgatacgttaatatttctgtgtgctataaatattaaaataaggccgggctcagtgggtcacacctgtaaacccagcacttaaggaggccgaggcaggtggatcacttgagctcatgagtatgagaccagctggggcaatgtgatgaaaccccatctctacaaaaaaataccaagaaaattgtttgggtgtagtggtcccagctactcaggaggctgaggtgggaggatggcttgagcctgggaggcagaggttgcagtgagctgagatcacaccactgcactccagcctgggcaatagagctggaccttgtctcaaaaaattaaaaaattgaaatagcagtaataagtaaaattaggaaagacacagaaaaaccatttatgttatagagcttcattactcagcagttgaatttgcttaacttttaaaataattgtttctttcttattttgaaattttccatcctataaataaattaaaaggatagtacaatgagccaggagtggtggttcctgccagtaattctgcactttgggagtccaaggcaggaagatcacttgaggccagaagtttgagaacagcctgggaaacacagcgagaccccatctctagaagagattttaaaaattagctgggtatggtggcatgcacctgtagtcgtagctacttgggaggctgtggtgggagaatcacttgagcccaggagtttgaggtggtagtgagctgtgatcgtgccaccacattccaggctgggcaacagactgagaccctattttaaataataatacaaaataacgaaaagagtataattgacttgtttgtgacaccaaggataaatgcttgaggtaatggataccccatttaacttgaggtaattattacacattgtatgctggtatcaaaatgacccctgtacctcataaatatatacagctactaagtacccacacaaattaaaaattaaaaaaaaatgatagtacaatgaatagctgcatatccttaacttttgtttagcagtttgcatattttgccactttttcttaatctctctatatatttacgtatttgtttctggctgaataattggaaagtattagtaattgcgaacatcgtgacacttaagcagcataaggacattgttctattacaactaccatagcattatcataccccattgaaactaaaatataactagttgatataactggcctctcaaagtgctgggattacaggcgtgagccactgcgcccagctgcatagtcatattttagtttcaattatattttagttatattaactaattagttacattaactaattagttatataattaagttaactttccagagaaacttgacactaatctagcaatatattgtccctattcagatttcctcatttgcctcaaaaatgtattcaaagttgtttcctccacccctgtccaagatccagtcagggtttacacatttaatttgatggctatgtcccagtggaatttgctttagataagtttatagtgctgttatttatagggctgtagtgatgttgaagaaagtgaacacatagaaactaaatacggttagtatttttgtatatatcaggaataccagtaatgctcttttataaatctattttctttcacatcttgtctcatttgttagacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaaggtaaaaaaaaaaaaaaaaaattctgtactttcaatatgtgaactttatggtacgtgaattataactcaaagcagttattttctttaaaacataacaaaggaaaaaatatttcatttttaataaaatagttgctaaggtccacaattagattctgagtttttataaaacataaaaaggtgactcttaaatgcttgtacaattttttaagggaaaaaagaccatcacaatttgaaaatattagttcagttttattggaatcaaagcgtagttacattttattttattttttatttttttattttttgagacggagtttcgctctttttgcccaggctggaatgcaatggcatgatctcggctcactgcaacctccgcctcccgggttcaagcagttctcctgcctcagcctcccaggtagctgggattacaggcgccagccaccacgcctggctaattttttgtatttttagtagagacagggtttcaccatgttggccaggttggtctcgatctttggacctcatgatcctcttgccttggcctctcaaagtgctgggattacaaatgtgagacaccatgctcggccatattttattttttattttttatttttattcagacagagtcgttctcttgcctaggctggagtgcagtggtgccatctctgctcactgcaacctcttcctcctaggttcaagcaattctcccacctcagcctcctgagtagctgggattacaggcatctacctccatgcccagctaatttttgtatttttagtagagatggggttttgccatgttggccaggctgttcttgaactcctgaccttaagtgatctgcccgccttggcctctcaaagtgctgggattacaggcatgagccactgtgcccagctgcatagttatatttcagtttcaattaaaaacaaactttagggccaggcatggtggctcacacctgtaatcccagcactgtggaaggccaaaacaagaggatcacttgagcccaggagtttgagaccagcctggtcaacatagtgagatcccatatctacaagaaaaagaaaaaaattgtaaataaataaaccctagttcaacctgagaatgctgattggaaaatagaaatccctagtatataaaatttcagttaggcaggaggaataagttttttttgtttttggtttttgagacggagcctcgctggccaggaggaataagttttaagttcaagagatatgttgtataacatggtgactattaacaacaatgtgtcatgtatttgaaaatcatggccgggcatggtggctcacgcctgtaatcccagcactttgggaggctgaggcgggcagatcacgaggtcaggagatggagaccatcctggctaacacgatgaaaccctgtctgtactaaaaataaaaaaacttagccgggtgtggcggcgtgcgcctgtagtcccaactactctggaggctgaggcaggagaatggcgtgaacccaggaggcggagcttgcagtgagctgacatggtgccactgcactccagcctgagagacagagcgagactccatctaaaaaaaaaaaaagaaaatcactaaaacggtagattttaagtgttctcaccacacacaaaaaatatatgtatgtaaggtaatgcatatgttaattggctcaatttagccattctaccatatatacatatttcagaacatcatgttgtatacctataaatacatacagagcttatttgtcaatttaaattaatcaaagaaaggagaagaaatcttggccttgcctctatatggacaaggtattcacctaatgtgttcttactctccacagctaaaaatgtagatgattgaattatttagaggtaaaaaatgggaggcacacaagttgaaaacaaaatacacaacagttttcaaaatgaattgccaatctttaaaaatcagactaatgattaaaagtcagatatgaatttcggctgggcgctgtgactcacacctgtaatcccagcacttttgggaggctgaggcgggcagaacacaaggtcaggagttcgagaccagcctgactaacatggtgaaaccccatcgctactaaaaatacaaaagtttgccaggtgtggtggtgcgctcctgtaatcccagctactcaggaggccgaagcaggagaatcgcgtgaacccgggaggcagaagttgcagtgagccgagatcatgccactgcactccagcctaggcgacagaaaaagactctgtctcagaaagaaaaaaaaaaagttagatatgaatttctagcttcagaatttctggaatctcctggttaaaaaaaaaaaaaaaaaaaaaagaggccaggtgcagtggctcacacctgtaatccgagcactttggaaagctgaggtggaaggatcactagagcccaggagtttgagacctgcctgggcaatatggtgaaaccccatctgtataaaaaaaaaaataataaaaaaattagctgggtgtggtggcaaacaccaggaatttgagaccagcaatatagtgagatcccatatctacaggaaaaaggaaaaattttttttgtttttcctacctagtcccagctacttgggaggctgaattgggaggattgcataagcctgggaggcagagtttgcagtgaacaatgattgtgccactgcactccagcctgggcaacagagtgagacccccatctctcaaaaaaatgaaagtgaagtataacactggctcatatttctgcgtagcaacaatcacctcgccatgtagcatctgcccctttgagatgagagtagtaggcaccactgtccccagctggttcattcacttatattgcctgcttgacttctgtaatatctgaattcgtgacccctggactgggtcgtctctgagatgtcttccagttctaaaatcatacagctgaaaattaccctataatttattacctaggacattttttccaacagatttcttggagaatttaatgacttttaagcaatttatatctcattgacttgctttgtcttttatagcatatatattaattttgcattgttgctgcatataaattatctaagactgttagcttcttgaaggcagggattgtgcttttctcttgctcagcataacgtgttgactaaagaaaacaaattatttcattgaaaactattttcgtgtaatttatgatgtgtgtgtgctcataaacaattcctttgagttttaaatttggttttcttatacattcaatgtcttttaaaaattgttgtttattaaatgtggaatagttgtgtaggtaaaatactttattaaacgatgctaaaaaaactataaaggactacttaaataagctattaaaagtatatttgtgatatataaacccacaagttaatataaacttattgtgtaagtttatataataaacttagtttgtctaggaatacatatttttaatttcatttttcctttcatcttttttttttcttttctatacagtatcgggaaaattgcctggcagcaaaagcactttttcctgacttctgcctaccagctttatgcctccaaactcagctattgccataccttgctctactaaccattccaatgagaaatcaaggtaataacataggtttttcttttcttttaagaagtagggtttatttatttatttatttatttatttattttatttttttagggggagtctctactgtccaggctggattgcggtggcacgatctcggctcactgcaacctctgcctcctgggttcaagcaattctgttccctcagccttctgagtagctgggaccacaggcacgcgcccccacacctggctaatttttgtatttttagtagagatggggtttcactgtattagccaggatggtctcgatctcctgaccttgtgatctgcctgcctcggccccccagagtgctgggattacaggtgtgagccaccgcacgcggccagaagtagggttttatagcaatatctttttgtgggccaatttattgctatatgcagtgagatactttttttccttttattttttgatccagataattctggatcctttatgtttttttttttaaaacgcatcaaacaggccaggtgcagtggctcatgcctgtaatctcagcactttggaaggtcaagacagggagatcactggaggttaggagttcgagaccagcctggccaacatggtgaaaccctgtctctactaaaaataaaaaaattagccaggtgtggtggcatgcgcttgtaatcccagctactcgggaggctgaggcaggagaatcacttgaacccaggaggtggaggctgcagtgagccaagatcgcacacctgcactccaggctgggtgacaaagtgaggtctgtctcaaaaaaacaaaaagcatcagatgatacagaaatatataaagagccgaacgtggtggcttatgcctgtaatcccagcactttgggaggccaaggctgggaaaccccatttctactaaaaatacaaaaaattagccaggcgtggtggcacgcgtctgtaatcccagccactcgggaggctgaggcaggagaaccttcaaccccggaggcggaggttgcagtgagccaagatcaggccattgcactccagcctgggcgacagagcaagactgtctcagaaaaaagaaaaaagtttctaaagtaaaaattgaaagtacttcccctacaaccacaggttgctttgacagattaatgtaaattcttccagatactcttctgtggatgtagaaacatgcagaatgaggcaagctttaatttgcttatgtcacttactgtggatagcctttcatatcttataagttaatgtcagagcagcaatctcatttttttccaatttgtaaacattttatttaaccttatgatggatattttggtggatttcagtattacaaaaatgcctattaatagtatttttcattatatttctgttacgaaattataatgctacaaacattactatgcctgtggcagtatacatctgcacaagttttgaaaatgttatgcattcataggcaaaaatgggataacttttgggcagtggtcatgattaatctgttgatcagaatccagagattgcccttctccttgccaattgctttaagagtacactagtttttggccgggtgcagtggctcatgcctgtaatcccagcactttgggaggccaagacgggcggatcacaaggtcaggagatcgagaccatcctggctaacatggtgaaaccccatctctactaaaaatacaaaaaaaacccacaaaaaacaaaaaaaccaggcctggtggtgggtgcctgtagtcccagctacttgggaggctgaggcgggagaatggcatgaacctgggaggcggagcttgcagtgagccgagattgcaccactgccctccagcctgggcaacagagcaagactctgtctcaaaaaaaaaaaaaaaaaaaaaaaagattacactagtttttaaacttttggtttttttttttgagatggagtttcactcttgttgctgaggctggagtgcagtggcatgatctcggctcactgcaacctccacctcccaggttcaagcgattctcctgcctcagcctccaaagtagctgggattacaggcatgtgtcaccacacccagctaattttttttgtatttttagtagaggtggggtgtcaccatgttggccaggctgatctcgaactcctgacctcaggtgatccacccgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggccactggtttttaaactttattttgaaattatttcaggctgggcgcagtggttcacgcctgtaatcccaacactttgggaggccgaggcgggcggatcacgaggtcaggagatcaagaccatcctggctaaccccgtctctactaaaaatataaaaaatcagccgggcacggtggcaggtgcctgtagtcccagctactcagtgggctgaggcaggagaatggtatgaacccgggaggcggagcttgcagtgagctgagatcacgccactgcactccagcctgggagacagagtgagactctgtctcaaaaaaaaaaaaaaaattattttaaatgtaaggatgcaagaatagtacaaaaaattcttgtatatccttcactaagtttcctgattattacattttttaccatatttgcctgattatattctctctctttataagcatgcacatatatgtattattttgctaaactagtcttgagtaaattgcaggcatgatatcccattattcttaaaaacttaagtctgcacttgccaaaaacaaggacattttcctgcataaccacagtgtgcaatcaaatcaggaaattaacattaataccgtttattttatagtccccattcaaatttttccaattgtcctaataatatccttttttaattatttttaattaatagagatgggatctcgctttgttggccaggttggtcttgaactgctggcctcaagcaatcctcttgcctcagcctcccaaagggctaggattataggcacaggccactgcacccagccctaataatctcctttgtaaaatgataactccccatttcttgtccagaatccaatgaaagataacctgatgcatttagtgatttagtttccgtgtgtttttagtctcccttgatctggaacagttttgtagtctttctttgtccatgacattttagagggatataggacagttactgtacgatccctcaatttgggtttgtctggtgattcctcattattggattcaggatatgtatttttttggcagaaataccacagaagtgatcttaaaaaaaattggcaaggagaggaaagatatctggattctgaccaacagattcatcatgtccactgcataaacgttatttttgcctatgaatacacaacattttaaacactttaagtatcagtacttacaaaagctgtaagataaaacacttcattgtatcaaagtagatatttagtctttaatcctttcttctgatcactgataaggtcaactctatctttaaaatttctgggccaggcatggcggctcatgcctataatcccagaactttgggcggccaaggtgggaagatcgcttgagcccaggagtttgagaccagcctaggcaacacggtgataccttgtctctacaaaaaaatttaaaaattagctgggtgttgtggcttgcacctgtagtcccagctactcgggaggctgaagtaaggggatcacttgagcccgggaagtgaagggtgtagtgagctgtgatcaccccactgcactctagcctgtctagcttgggtgacagggtgaggatgagaccctctccaaaaaaataaaatttctgagatgttttgataagttatatggtagattactaacatttttaatatgacacaaattctgttttgaagattagcaccacagacaggtgatcattaatgaaatatggcccttaaaatacacattacaaaagagaaactgatggtaaaattgctggtgaagttaacttttatcatttctccactaattaaaagttcagattctgggatcacatctctaagctgttcatatcaaagagctattttttaaagatcctgattataggcaacaaaagcaaaaataaacaaataggattacatcaaaactgaaaagcctctgcacagcaaaggaaacaacagaatgaagagccaacctacataatgggagaaaatatttgtaaattatacatctgataaggggttaataatcaaaatatataaggaactcaaagaatgcaatagtaagaaaacaacccaattaaaaaacaggcaattccagcctgggcaacatggtgaaaccctgtctctacaaaaaatagataaaattggccgggcacggtggctcacgcctgtaaccccagcactttggttggccgaggtgggtggatcgcctgaggtcaggagatcgagaccagcctggccaacatggcaaaaccccacctgtactgaaaatacaaaaaattagccgggtgcagtggtgggcgcctgtaatcccagctactcgggaggctaaggcaggagaattgcttgaacccgggaggcggaggttgccatgagccgagtttgcaccattgcactccagcctgggcaacaagagcaaaattctgtttcaaaaaaaaaaaaatagataaaattagccgggtgtagtggcacacacctgtagtcccagctacttggaggctgagtgggaggatggtttgagcctgggaagggaaggttgcagtgagccgagatcacgctgctacattctagcctgggggacagagtgagatgctgtctcaaaaggcaaaggaccagatagacatttcttaaaagaagactggccaaaaggtatatgaaaaactgcttaacattaaggcttaacactaatgatcagggaaacacacttaaaaccacaatgagatatcatattacaccagttagaatggccgttaccaaaagataaatgataacaaacgttggctagggtgtggagaaaagggaatcacagagttagtaagaatgtaaattagtacagctgttttgaggaacagtatggaggttccttaaaaaactgaaaataggccgggcgcagtggctcacgcctgtaatcccagcactctgggaggctgaggcgggcggatcacgaggtcatgagtttgagagcagcctggcaacatagtgaaaacccatctctactaaaaacacacacacacaaaaaaaaaacaccaaaaaaactaaaaataggccaggcgtggtggctcacgcttgtaatcccagcactttgggaggccgaggtgggtggatcacctgaggtcgggagttcgagactagcctgaccaacatgatgaaactctgcctctactaaaaatacaaaaattagctgggcgtggtggcacatgcctgtaatcccagctacttgggaggccgaggcaggagaattgcttgaacttgggaggcagaggttgcagtgagccacgatcacgccattgcaccccagcctggcaacaagagcaaaactctgtctcaaaaaacaaacaaaaaaaaaactctaaaaatagaactaccatatgatccagcagtcccactactggacatatatccaaagaatatgaagtcaaggccaggtgcagtggctcatgcctgtaatcccagcactttgggaggcgaggcaggcggatcacttgaggccaggagtttgagaccagcctggcaaacatggtgaaaccccgtctctaccaaaaatataaaaaattagccagatgtggtggtgtactcctgtaatcccagctaccgtggagtctgaggcaggagaattgcttgaatccaggaggtggaggttactgtgagctgagattgtgttgctgcactccagcctaggtgacagagccagactccatctcaaaaaaaaaaaaaaagaatatgaagtcagtatgttgaagagatatctgccctccctcccagttttattgcagcattattcacaataaccaagatatagcgtcagtctaattgtccattggatgaggaaaacatggtatatatacacagtggaatactattcagccataaaaaagaacaaaatcttgtcatttgcagtaacatggatgaacctggaagaccttatttgaaatgaaataagccaggcacagaaagacaaatattgcatattctcacttatataggagctaaaaaagttgatctcataatagtagagcacagaatgggattaccatgggcttgggtggtaggggagttgttgatcaaagaatacaaaattttgttatgtaggaggaataaattcaagaattctattttacaacatggtgactataattaatagtattttgtgtgtgtgtgtggttttgtttctttttttgagtcagagtatcactcttgtcacccaagctggattgtggtggtatgatcacggctcactgcagcctaaacctccttggcccaagtgatcctcctacctcagtctactgagtagctggtaaccacaggtgcgcaccaccacacttggctaatttttgtattttttttttgtaaggatggggttttgccatgttgcacaggctggtcttgaactcctgggttcaagcaatcctcccacctcagcctcccaaagtgctgggactacaggtgtgagctaccacacccaaccaatatattgtattcttgaaaaatgctgagagtgaatgtaaagtgtctttgccacaaaaataataactctgtgaggtaatatatatgttaattagctatagtcattctactatatatatattaaaacaatatgttgcccacagtaaatatatacaattttgtttgttaattaaaataactctgtttgtagtagattttttttttttttttttttgagatggagtcttgctgtatctcccaggctgcagtgcagtggcaccatcttggctcactgcaacctccaattcccaggttcaagcgattctcctacctcagcctcctgagtagcttgaattacaggcgcataccaccacacccagctaatttttgtatttttagtaaagatggggttttactatgttggccagtctggtctcaaactcctaacctcaggtgatccgcctgcttcggcctgtgtagtagaatttttaacaggttaagtatccaaaggtcctcatagtgttagatgtgcaaactttaaaaggttcataaaaattagtaaaagtaagatgttttcgtttttcttatcaatttttatactgtttcttccgcttttatttactatgtcattttcagccattatttctttaaatatttttctgctgctttctgtccttctagtctttcattagggtatgttcacttgaaagtgttccacatttttctgagattttgtttatatttcttctgtcttctatatgtcaatctatgtccaagttttttttttttttttttttttttttttttttttggagacagagtcgccctctgttgtccaggctggagtgcggtagcaccatctcagctcactgcaatctccacctcctgagttcaagcaattctcctgcctcaaccccctgagtagctgggaatacaggcatgtgccgctatgcccggcggggtttcgccatgttggccaggctggccttgaactcctgacctcaggtgatctgcctgcctcggcctcccaaagtgctgggattacaagcatgagctaccacgcctggcctatgtccaagtttgatgatacttctggttcaaatctactgttgagcccctttagtgaatttttcattttagttattgtaccttttgactgcagaattttcatttggttctttttataatttttgtctttttgttgatgctctttttcatgagacattgtcattacagctttgtttactactttgagcatgatttccttttctactttgaaaatatttataatggtttatctgaagtctttttctgttaaatttaatgtgtgagccctcgcaaaggcagtttcttttacccacctttttcttgtgtgtaggtcacactttcctgtttctttacagtcataattttttgttgaaaactagatgttttagggaatatattgtagcaattttggagaatattgattctcctcctctggggcttgtttttattgttgtgtgcttgtttatttgtttagtgacttggctaaactcatgtaatgaagtctgtcttttgcaacatgaagccttcctccctcttcagagagcttatccttggctgtgcccacagtttacttgggatgatggtggttttagcagagctcactttgtctctttccctgatatgtctgtatagctctttgcttcctttgttatcacactgttggctaccctaattacttttttttttttttttttttttttttgaggaaagagtctcgctctgtcacccagactggagtgcagtggtacgatggctgactgcaacctccgcctcctgggctcaagcaattcttatgcttcagcctcctgagtagctgggactacaggcatgtgccaccatccccagctaatttttctatttttagtagagatggcgtttcaccatgttagccaggttggtcttgaactcctgacctcaagtgatccacccaccttggcctcccaaagtgctgggattacagacgtgagccactgtgcctgactactccctaattactatctaattgctctgttttcagcagtgctctaggacaaaaatttctccacaggctgatccaatttaatttgggcaggtgtaggctttcaagccagtttctgagggttgttctgaaaccaggagggcccttcttagttgtctctttccctggtttcttatgaactagttggcttatgtttagcttgttcttatttaagaggagctggtttccagggtgccctttaggcttgaacttccccacactatgtttcaaataaagtgagttcctttggggaaggcttcggagctttttcctacggactgcctctcctctgggcaaaatctctaagccacttattctgggtgggtgcccagctgcagaggtagcctctgattattttggcttgcctctcccagtgtggaccctctgctatgtaacaagctggggtaagggagactgcagctgggacaggggacagtgcctttgggttagaacctcttatcctatgagtagggccgggtggggaaaggaagccccaaacaccctgctgcactccagtaggaaggagtccttagttcttggctgtacccacctggaatgaaatgttcatcaagctgagccctctcagctcagggttgggaatgggagggaggagatagtggctcagatgcctcagattcttcctgtttggttttcttgaatagatcttttctcatttgctgtatgctattaggacaatttccagagacttcaaatgattgatttttaaaagttttcaccgattttgcttatctttgggagtgggtacacaagagcttatgctgtcatcctgaaagtttactatgtcattctttttctttttgcatttttaattgtgataaagtatacaaagcataaagtttatcatcttaaccattttgaattctacagtgcagtagtgttaagtatatccaccttgttctgcaaccagtttccgaaacttttgcttcttgcaaaactgaaattctataactattagcattaattccccattttcccttccccctggcagccaccattctactttctgtctctatgaatttatgactctaaatacttcatataggtggaatcatacaatatttgttcttttgtgactagttgcacttagaatgatgtcatcgcagttcatttgtgttggagcatgtgtcctttttaaagctgagtaatattccatgagatgtatataccatatttggttatccattcatctgttgatggacacttgggttgcttccacccattgattattgttgatgctgatatgaacatgggcatacaaatatctttttgagactctgtttttaattattttgggtatatacccagaagtggaattgttagatcatacaataattccatttttaattttttgaggatgcactatactgttttccacagcagctacaccattttacattcccatgagcaatgcacaagggttccagcttctccacatccttacccacacttcttgttttctggttttttgtaacagtcatcctaatagatgtgaattggtatctcactatggcttggatttgcatttctctaaagattagtgatgttcagcatcttttcatgtgcttattggccatttgtatattttctttggaaaattgtttacaacttttaaaaaatctgtttcagctcagatttcttttatccaagatattggaaggctccctctgaagcgacactttggaaggtaagctgatcatctcaatttccaaaaagctgataatgaaatgtctactgaatatgttcaatatgaatcaataactgttacctgtaacatccaagaaagacatactgtacctagtaatttataaacataattgtattgtagacccttccttttcttaaatataacagcatatcttcacccactcccaatggactataccagattaaatggaagcatggaatcacaaaggcagaggaatctttaaaatcctccaactcaacaaatctagaaaccccttgccagctttcctgttgagagatgttcttagcctatgcttgaagacctgcagtgactaggaactgcctcagaaagtagaagagtccttcatattttcttattttagaaaatttaaacaagcaaaaaatagatgtctatctgtccatatatatatatatatatatatatatatatatatatatattgttcattttattggaaagtagcttctgtgccattatcagtgattaacacaaaacttatatttcagtttgacttagcttatttgtaagatcgaattaagcacttaggaattgtttaaagattttaaaaatggccgggcgtggtggcttatgcttgtaatcccagcactttgggagcccgaggcaggtggatcacctgagataaggagttcaagaccagcctggacaacatggtgaaaccgtgtctctactaaaaatacaaaatttagccgggtgtggtggcacatgcctgtaatcccagctactcaggaggctgaggcaggagaatcgcttcaacccgggaggtggaggttgcagtgagccaagatcacaccattgcaccccagcctgggcaacaaaagcaaaactccatctcaaaaaaaagatttaaaaaaatcttgcttactgaatgcatggacaaaagtaagtgatagaaatggcacctctgactcctcctaccttttctcctatttctggtcccaaatggaaaactcctgtgatgtgagcttattccccctctttaccctccaagattcattaaggcctttgtagtgttaatgtttttttctgtatactggcttagctatgtggggcccatctttcctatcgcagaaagaccatgatggatggatcttgaagcatcgtcccactgggatgtgatcagggcttacacatttcataaacactgcttttcttctcacatccctctgaatgaaagcaggaccaagtctctttgatggcttctctccccaaccccctaagattatggcatcaaaataaagacaagtatgttctattgtatttttgctcctgagatgtattgagttgctgcaatttacacaaggctaaattgaatgagaatcttcactattttattattggttcaactacctacttgatgtgacttgagaggcagtattttcttttcttttttttttgtagacggagtctagctttatcgcccaggctggagtgcagtagcacgatctcggctcactgcaagctccaccttctgggctcacaccattctcctgcctcagcctgccgagtagctgggactacaggcgcccgccaccacgcccagctaattttttgtatttttagtagagacagggtttcactgtgttagccaggatggtcttgatctcctgacctcgtgatccgcccacttcggcctcccaaagtgctgggattacaggcgtgagccaccacgcctggccacgagaggcagtattttcagtgctatatattacaatgactggtactatcttttatttatgttgaccatatttaaaaccattgttcatatgtttagtatttagtattaaatattaatacttaatatttaataggtgtttaatttcctgtaattcaacctacacgttatttttgcccatttagctttttttcagcttttactatcccagccttatagataagtcatcatgcacttcaaatactatttacttagggtgaattcctacaaatgaaattgctggatcaataggtatataccttttggggcttttcctctttattgccaaattgttggcaagaatattttgccagttttgtatccacttacagtgtatcagtatgttcttttctcctaacccttgccaccactgggttttaaaagtatctttgccagtttagaagatgacagtaataggccaggcgcagtggctcatgcttgtaatcccagcactttgggaggctgaggtgggtggatcatctaaggtcaggagctcgagaccagcctggccaacatggtgaaaccctatctctgctaaaaatacaaaaactagctgggtgtggtggtgcccgcgtgtaatccctgctactccagaggctgagacaggagaatcgcttgaacctgaagtggaggttgcagtgagccaagatcgtgctactgccctgtagcctgggtgacagagcaagactgtctcaaaaaaaaaaaagatgacagtagtagctcattatgttaattttcatttttaaaattacaaattagatttaacaatttaggaaccatttgtatttgttttataagttgtccatgtttgtgcccatttttctatttcattttttcctttttaatttgtaaaaattctttactgaaggctgggtgtggtggctcacacttgtaatccccgcactttgggaggcggaggcagatggatcacctgagttcgggagttcaagattaccctggccaacatggtgaaaccccatctctactaaaaatacaaattagttgggcatgatggcatgtgcctgtaatcccagctacttgggaggctgaggcaggagaatcgcttgaacctgggaggcagaggttgcagtaaactgagattgcaccactgcactcctgcctgggcgatagagaaagacagtctcaatgaaaaaaaagaaaaaagaaaaattctttactgaagacattatttctttttatttttaggtgtttttgttgttgtggtttggtttggtttttttgtttgtttgttttttgtttggagacagagtcttgctctgtcgtacaggctggagttcagtggcacgagcttggctcactgcagcttctgcctcctgggttcaaacaattctcctgcctcagcctcctgagtagctgggattacagatgcatgccaccacgcctggctaatttttctattttcaatagagatgggtttttgccatgttggccaggctggtcttgaactcctggcctcaagtgatctgcctgccttggcctcccacagtgcagatagtacaggcatgagccaccgtgttcagctcctttttgtattttaagttgtaggaacttattcagtttgtcatttaccttgtagttttgtttttatagttaaagggactagctaaacagcacaatgtaggtaaatgaaagatggcttcataatcatcacactcatggtgtaatttaaaaatcttctcctttggttcttattaatgcctgcactgtgaatctgacagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaattttgtttctcctgtcttttaacattatctagcacgcactctctgccatgggtccttaagcacagtgcaccaatctccctcccccagtgtcaaacttttcaaaagatagggaagaggatggcaacgttgcgatgagaactgtaaactctttccaaaagagcccagtgtgtggtcattgccgcgacgtgccggctggtggcaccgagcagcctgggcccagagcggttgtcgggccgacagatccgggcggggcaaagccgggcggggaaagctgggctcgtcccgtcccggccccgcccccaccccgggagcccgataccggtttcagagtcctgggcagcgtgcgcgctcttcctggcggctgcgcaggtaagtgggaccggggtggggccacgtgaccgggagaggagggcccggcggcccccggcccaggtgtgctgcgacggacggctgcccgcgctcggcgctcagcctgccatagcccgcgggggaggccggagccagggatccggggaggcccgcgtcccgccaggtttcgctctgcggacgcaggtgcggccgagccgccgtccttccgggcgcggggcggggcgcgcacctcggggcgatctcggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtaaaccggtggttctgtttgtgtaaaggtgaccaggcatgattcctgtgacactttgctggggcagccatttctcctgccattgccgcggctttccaagatgagtgtccaagagtggagtaagggtccggggcctgagcaggacaaagacacacgctgccgcgacctgcgggaccagaacgaactctcagtgacatcttgaaagacattaggggtatccagatatttaagatgtaatgaaatacagctaaccattcccttctaaaaatcacattatcttgcttttccacaactctttaataattgcttgttttttctttaaaaatggatagggtggtttgattcaaataagccacttcacaggtgaagagttaaatccattacagtgaatcgtatttttaccagtgagttgaattaagcatagcgtatcctgtaaatgctgtgtaaaacttgctaaaatcatttgttgtgcttttgcttctacatttcttaggaatgtgtttcaaaaactagagtcgtaatagcatttctagaacttacacttttttagagaaagaaagagaaaggtacaaaaataactgattgttataatatacagagccgctttgcattgggcaccctgctggggccatcacagttaatcctctaaggtcggagtgccctattagaagaccctgggtttccaccgcattcccttgtctccagtctgtacataccctgtgtgccttgcttgccctcttaacgtctctacctggatttttaacgcatctgaaacactcttcagtctgctgctccccaaggctaagctggaggggtggagaatgaggtatagatagataaaatgatcagatgtctggggtttacttcagaggactctattggcagaggaaatagtatggggagtataaatgaaacaagtttggccataaatcgataagtgtagaagctggatgtgggtacacaagggttcataatgctattctttctactttttattatgtttgaaaaattctataataaaaattttaaatacctgtctagcatttgacctcttctcaagatctcagtgatccattgg

SEQ ID NO: 15991 - DNA, 13535 bp, Human
  misc_feature (1)...(13535): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggctcactgcacctccgcctcctgggctcaagcaattctcctgcctcagcctcccaggtggctgggattataggtgtgcactatcaagctcagcaattttttttttttttttttgagactgagtcttgctctgtcgcccaggctggagtgcagtggcacaatctcggctcactgcaacctctgcctcccgggttcaagcaattctcctgcctcagcctcccgagtagctgggactacagacgtgcaccaccacgcccagctaatttttgtatttttagtagagacggggtttcaccatattggccaggctggtatcgaattcctgacctcgtgatccacccacctcggcgcccaaagtaagtgctgggattacaggcgtcagccaccccacccagccaaatttttgtattttttagtaaagacggggtttcgccatgttggccaggctggtctagaactcctgacctcaggtgatctgcccgactcggtgtcccaaagtgctaggattacaggcgtgagccacagtgcccagcctaacattgtaattttttaaaagtaccttagtctgttcgtaaagtgttgagtggaatatttacattcctcctgtgattggtgtttgtaaacgtgtatatatacacacatacacacaagggctctttttgaacaaagcgcgcacccacagaagcctattgaaaagtttatgctgctacaataaatctgtattcctatgaggttccataatgaaatcagttaagactgcgtatgtttgaaatcggtaagattttacttctctactttcattgagttggcacgaggtagggtagacagcaggcactcaatttctgattttgaatcggaaaacatctgtttttctgggcaaggatatcagtagattgctcctagggacaatcaagaaagaaaagagacctccaacgcttctctgcaggagcggatagagccctggttatttgctcgcaagtgaaaattgccctggcatacccattcaaatttctcctagcaaatcatagtggcctacagccaacgccttcttcgctcactggccaactggaaacttcagtccccccatgcctcccgcctctcacccaggggccaataggaatgatcagaggttcgcaacttagtgtcatcaagcatagtaattgcaattggctattggagctgtcgatcgtggagtaggcggggccgtgccagctggcctatataagacgaggacaaaggcggcgcgccgcctgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgcgccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggtgagtgtctatgggagcgacgcgtcggctcccctaagatggcggcggccccctcctcgcccccgcccccgcgctgggcttccattttgtcggctgccggaaggggcgcttgcgcgcgccgctgcgggggcggggcggcctgcggggccgtcggtcggcgggggattggccgccgccgggccttgctctcccggcgggcggaaggctaggggaggtttcctttcggaaggaagcgcggggccgcggtggtcggccctgcagaaggtatcctgtccctgggactggcgtaatgcagagcatgcggcgtaggtttggagagaaccgggaagttccataaaagcgcaggcgcagatcgtgtaggttacagtggcatttggatttgtgttattttcctattttaattttcatactatttagatttttttagggacactcaacatatgtgggtgacagttgctgatggacgtctactctttggggaagtgtgtctattctcgaacattctggatgatggggctcctttttcaatgttaagatagtgctcatgttagaaatctcacatagtaaaaccttgattttgaccaaacggaacagaaaggcaactgataggtttcagataagcaaatactatcttggggattttcacttgcagaggtctctggtgtttgaaaacttctttcctttttcattaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgtgagtgtaattgtttgattttacgtagaattaaaaagggtgggggatttttttgtcactacaaacgctgaaggcttggtttttaaactggggaggataaattgatcttttagatttttcaccattcttacaggaaaaatgcttgcggtataatgcataattgttgctacctaagagaaaagaggggtggggtgggtaaactaagtggtgttagtgggtgctgcctaaaggtaatggtcgaactgagctgaaggaagaaagggagtaggaagtaggcctatgacaatttaagagtagacatcatccaattttgaggtcattaacatgagtgtctctgatacacaggaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacgtaagttgtcttgtttattctaataatttctatcaacttatatgagaatggtggcaataaaactggaacaaagctaagatggaaccatttttgttattagaactcctcgtccagtcattgtggaaccacttgaacaactagatgatgaagatggtcttcctgaaaaacttgcccagaagaatccaatgtatcaaaagtaagattgattaaacttttttggcagtttttaaatcaagtgtaaaggttaaatttattttagtgattttccaattttgcttaaaatatgcaaaattatttgatgtggatatgcttattagtaaaaaatctcaggctgagaaagatttgaagctgttattcagatagctgtttgcttctaaggtggatacattcacatgcagtcctgttttgtccctgcaataatggcataaagtcacgtgtgtgactgagtctctgttgcccaggccagagtgcagtggcatgacctcagctctctgcaacctctgcctcccaggttcaagcgattctcctgcctcagcctcccaggtagctgggattacaggcatgtgccaccatgcctggctcgttttctatttttagtagagatgggctttcaccatgttgactaggctgatctcgaactcctgacctcaggtgagtcgcccacctcggcctctcaaagtgctgggatacaggcatgatgcaccgtgcctggctgaagtacgtttttttttgttttgtttttgagctggagtttcgctgttgtttcccaggctggagtgcagtggtgtgatttcagctcactgcaatctttgcctcccgggttcaagtgattctcctgcctcagggttccagaatagctgggattacaggtgcctgccaccatgcccagctaattttttgtatatttagtggagacggggtttcatcatgttggccagatgggtcttaaactcatgacctcaggtgatccacctgccttggcctctcaaagtgcagggattacaggggtgagccaccgcgtgtggcctacagtacatttttatgggtggaaaaaataagcctcggtaaggaatttggctagaggaaaacaattagaaaacgaggaaggtaggatttatctccagtgcctgcattcttttactgagtgttctgagtatttttgctgtgaagatatttatagatgaatcaggaaaatttttgccttttgtactctttacaagaaatagaacaggaaaaagatcagtactagggcaagtattttctggtatgcattcacaaatcggttcatgttaaaattttgtgtattgttagggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaaggtaaaaagacctgtgcgtgaacatcattgctaaggtcaattgtttttcaccttattagaaccttgttaatgtgaatccaaatattttccaatgttcagatctgatgagacgacaggaagaattaagacgcatggaagaacttcacaatcaagaaatgcagaaacgtaaagaaatgcaattgaggtaaaattgtgtttaaggtttaagccttcatttatttttttctttgaaacgtatcattctgttgcccgggctggagtgcagtggtgcagtctcagctcaccacaacctccgcttcctgggttcaagcgattctcttgcctcagcctcccgatcagctgggattacaggcatgcgccacgacacctggctaattcttcctgtatttgtagtagataacggggtttcgccatgttggccaggctggccttgaactcctgagctcaagtgatccacctgtctctgcctcccaaagtgctaggattacaggcatgagccgccacgcttggccattttttttcttccttttttgagatgggcccaggctgaagtgcagtggcatgatcatagctcactgcagtctcaaactcctcagctctagcagtcctcctgagtagctgggactagaggcacaggccaccacccccagctaattttttaattttttttgtatttgtggagatggagtcttcctatattgcctaggctggtgtcaaactcctggcctcctaaagtactgagattacaggcatgaactaccaaccctggccttaatccttgacttatgcactaacatttatattctgacatttagggaaaagatgtacttagtttttcaggtcagtcaggcaaaatacaaaggttaaatatgtcagtgttggtttaacacttaaaatcgaatacagtgtaagattatccttaataaagcctacattatttgccagaatgtctttagtactatgcccctaggctcactctaagcctttgtgttttttagtgctaacctagttcttaggtcaactgctaggtttcttcacattgaattctaaaagatgtggataacacttcagttatgtacctgatgggtatttctaggcaagaggaggaacgacgtagaagagaggaagagatgatgattcgtcaacgtgagatggaagaacaaatgaggcgccaaagagaggaaagttacagccgaatgggctacatggatccagtaagtcagcctttactgccttccaattggagttgtctatagaacttgcaggtacctagaaggaattacaggaaattttaatatcaaattacagttattttctgctttttttctaacaaagtatattatgtttgatttccttgtatgggtcagaggatttaattgaataggaagtttttttgtgttttgtttcttggtttttttgttttgttttgtttttttgtttgtttggttttttttttggagagagttttgctcttgtcacccaggctggagtgcagtggcttgatcttggctcactgcagcatctgccttctgggttcaagtgattctcctgcctcagcctcttgagtaggtgggattacaagtgcctgccatcaggctcggctaatttttgtatttttagtagaaatggcgtttcgccttgttggccaggctggtcttgaactcctgacctcaggtgatctgcctgcctcggccttccaaagtgctgtgattacaggcgtgagccactgctcccggccttgaataggaagttttgtaggtctttggataattgagtctaacttagttttcagaatattgatttcaaaaataattcacatgatgaacttttgaactttaccatgttttttatttaactcttgaaaatttctcagttcttaagaatgcttgctgtgggtatagtgcaggtatattgaaaggaatttttttcttgcagcgggaaagagacatgcgaatgggtggcggaggagcaatgaacatgggaggtaagtgtgaaatttaaattaatgatataagtagagagtagtatcctggtggagttgtaaccactatttttgttttctagatccctatggttcaggaggccagaaatttccacctctaggaggtggtggtggcataggttatgaagctaatcctggcgttccaccagcaaccatgagtggttccatgatgggaagtgacatggtaatgtatcctgtgggacgtagtaccaaggaaattctcattttcacaacttaggtgtgtttgttttgttttgttttgtttttttaagtaggtgactggacctcttttagtttcccctaccaatttcatacataaatatgtaatattgaggaatactttggcaacatagaagaactcggtgtgtggtaacctaaacagataacggttgccaacaaggagtcaatgctgttagtattatgtggaattacctttggcaataagtagatttaggtgcttttgaactctagtgcatggcaaatccaaattctagatgctagataatgtatctgattattctacatccaagtgagaataatcaaatggcaaactcattctttaagctggtatttgccataagtaggaatcagacttgtagtttgaagctttaggcacgttttagtgatgtgtaggactttgacctatatttggtgtggcttctatcctatgaaaagggaattgagtgttttgactcgtcgtttcccacctgttgggcctgtctgtaggtataccttctaaaatcaactgacatctccattttgctacagagtagcaaaaatcaacaatttttaagcatactaatggtgtgcatttgatctgaaccttcttgatgctatcatgtttcagctgtgaatatagcctgtcagatgcttagaacaatcagttgaactggtatgagtggctgcattagggctttacaaatcgttaggactgaattttggtgggtttagagagtgcatttttatagctgagttgaatgtgatgagttcactacaggcttttggcaaaggaggggagctgcagtgagtagctcataagattcattttataaatagaaacataaggattttgtataaggcctcacctgtttataatctacctaagactttttgggaattaaagttagaattataaatggctggttgggtaaaatgtaatactatgggctttctttagatttttcagagtatgtgggtaacattttggtttatattcttcctaaagacagattgttaggtaatgtgtaaaatctaatttgaccttatgttctcacaattaaaggtttatattctagataacaggtagctgatagctcctgggttctcagctggtgtaattaacataattatgaaagccccaactttttcttttttttaagttcttagaggtagaacacagaacaatgagccaaaaaccctgtaatttataagattttgaaaaacaaaggataaaagtttagtcatgttgagtagctcaatagtattttgtttaaaagaatgttgaaattgtgtataggaacagttaaaccctgatgcccttttagttttttatttggagtaatactcttagtaactggtctattataaatggaatgagaaaaagtgtaggctgctgtgtttgcatacctgaggggtctgctatttaggcacatatgtttctattgaaaacttctatctccagaattacctaaaactagatgggaatagtgaagtcactcactgctttattgcagttactttagcttcgtgtttcactgttcgggaagtgtctaaaacatggaattacagcaaagtgtctgcacttttcaaagacctaagggaaaagatggactgatgaaggtgggtggggtttgttcatttagtttgcaacaatatagaatagtactgagaacgtaattgtctctggttatatagtgatggctcggaaggtagtgtgcctgtgagaatttggcaacataagtttttttgatcaagttactgtgccggttaagtgactaaatctatagtcttatgctttttctttttgtagtctggtagcattttattaaaactttcaaccttttaagatttctgcaacttagcagatgtgtcttaagatcttgaaaagcacaaggtttcttaagcagcacatgccactaactggtgagtaggtctttgtcacttcattgagtgaattgaatctctggttgggcttgttaggcttacttggaaattaaatttccgttcagacgttgaaagtgagagtttgcaagtttttcagtgggttaatctgatgtgaaatttcttagaactcattttggaatggattttcacatctgcactaattcttaaattttttagcactacagggaagatctgttctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactacttataatgaactgttaattactgttccaatagcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttccatggtgttgtcagttaattgtcaacttcattgaacccccttccattagaacaagagactttgactattaaagtagattgtttattgttgcctgttagtataatgggagcctgatttcccagtgtaaatatgttagaggaacagcttcctaacagtaggtaaagtaattgaatggtttggctttgttctgagttacgttccattcaaatctgtacattgtagaattcttactatggaatgtgtcttcctccttttcacctcttttcttggtgctaattggcaaaagaaaaattctaagtcaaacctttattaacatgctgaagtttagtattgtgcctgtgtacaaaaggagacctattgttggaacaatctgagcactttctgcataggaaacaggataatgctgaaagtaaacactagtgtataaaagcatctcaccaaatactggttgtatgactgacaggtacatggtgtgctaagggagagaatctcattagaaagtaatgctcattatatcattcaccagcacactcggaaatatgagtagttttaccatgattatatcagtgaggaagttttgtccccaaacaggttattaattggtgatacataagagattttctgtacggaaacaagggtcttgattagaaaggaatccattacagtttggttgaattatatagtagggactctactaaagacaagaaaataaggggtgttccatgggacacccacagagggtgaactttgaatgtgtgtgggtgggggctggtcgggaaatgggaaaatctgcctataaaattaatgtttcagtttatttttcagattacatgcctttctttataagggatgctggcacagaccccctaaaataagcttttggtagtactgtacctttgaagagtggtgaaggatgctaatggataatctcctgaaagttgtggcttttgatacccttactgtggactgtagagttgctaaacgttgtttagcaaataatgttgcttagtttcaaatgacatttgactttcatcactaaaacagcaatgtactcagggttgtaagcttactcaaatagactttcaataagtcttcaatgtatatatgatagtttttagcctaatgtgaatttaaataatcttaatagtttcctaaaagtcgatctgaaacttggggtgggaaaggggaggtagcaatttttgaagtattttagccatttttttcatttaaagaaaccacttgtccccatttcctcttctccactttctcataattttgttttaagaggaacactggttgttttttatacttctcctaatctttaaaaactgcat

SEQ ID NO: 15992 - DNA, 11828 bp, Human
agctgaaggaacatttggtcccaccctgaaggtcatgggggtctgtaaggtgcactccagcatctgatatggcaggcaaaggtgtgtgatgcacctgggtggtttcagatagtgctccacaagtcccagggcccgtgtctagttctgagagcttcagaagacaagctgctacaccttgcatcacaggaccaacctttcctaggcaagtgggtttgaagcattggcagccaggttccaagtagaaggtgaatgtctacaacacaggagaaaggcaagacccagaatggggagtcaagctaaatcatttgtagagtatgacttccaacaacttcagaaagcattcttttgaagtgcttatggcatttccaccaacatagaccataggctggaccataaaacaaatctcaatatatatcaaagaatcaaaatcatacagagtatatgctctggccacaataatatttaattagaaatacataacaataagaaaatccccagttttagaaaacatgcaacatgcttctcaataacacttgggtcaaagaagacatcacaagaaaaaattcaaaacgtcagtaactgaataatgataacccaatgcatcaaaatgttggatacagctaacatagtgtttagagagaaatttacaactttaaatgcctatggtggaaatgagcaaagaagtaaagtcaattatctacgcttttatcataagaaccctgaaaaagaagagtaaaataaacccaaagttaataaacatttaagccaataataaaaataatgaaaatcatgaaatagaaaaatgaacaaacaatagagacaatcagtggtcaatttttctgtactccatgaacaaaacttcagttcagaatgattttatatttaaatatatatccagaatcacaaagatcttagaagaaaaaattaggaaaatataggaataaagtgggaactctgtgggaataaaaatcagaaagtaattgcctaccaggtaaactcgggggagggcaggcaattgactaagaacaggcagataaaactttctggagtgaaggaaatggtggtcttcttttcgttggtacttacatggacatatataactgtcaaggttcattgacaatgaacacttaagtgtacactgaacgcttaagatctgggccttgtaatgcccagattacatctacttaaaaaaactacatctctatttttttaagtagagaaaagtgtcttggggagtttatggcagtgatgtttgggcagactggggcataggtttcagaagcattcatagcatcttcagttcaacaatttgctaagaatggttttgcagccaaaaatgtaagatgagtgcaaatatctatgattagagtcattgggcatacaactacaaatccccacacttgtattacaggccatatgattaattcgttatcactagatacctttccttcaatgaggttcttccattaggaacccagagctctccagggaaaaattgcaattgaggttttggatatattgggtggaaaagaaagtcacctcacataaaacttagtgattggagctgtcaccattgaaaatttctaaactttgcaagacagcagtgacgtttcaaatgacactctcagagagttgataatgggctaaaatagatctccctccaggtggatttactgtacaaggacaacatttacattgcacttggagacttctcccagtttggtttaagttcacagattgcagatcccagacagctggtatcaactgaccagtgttctgttaaggctaaagccaagactctttatcacactgtggccttaagattggatttctcttcctgttcctgggaagaattagagatataacctaaaggtcactattattctgagaaaagggattctggaggaggagggagcaatgagtatgtggcaggagttcaaggtaataagggctgagacacaagccacagagcataaagctccagtccttcctccagggatgaggcagtaaggacttggactcctctgtccagcttttaacaatctaagttacggttagagctttctccttttctttcaactactcctggcagttgtggggtcatggaatttttgtaaaaaatggggtggaggaaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctagtaagtaaacttgagtcatgggtctgtggctccatcttaaactctgcatgggtgtggggaggttgaccttgtctagcaagttaaggaaagttgtagccaaatgaaagccagtcacacatctaaagtcatcagaaaggaaatagaataaaatggtatagtgtgaaagatactggatggggtgtccagagactggattctggccctgacgcagaacttgagaggcagccatgtcagcctcaaggccccttttcttctcttctagagagtcacacatgagttctccttcttgtctacaactcttatgttctgaagctttttgtcttggcgattgctgtgcgacattcacaaaggacatcatttacctggagacctcaccagtgggtcctgcctgtctagactgccccaggcttcatttcattttatagcttccttagtatctttagtgagggcaaaataaaaggaagtgaaggtacggatgtgtgtgtaattgtgtgtgtgtgtcagacagagaaagaaaatgagggggaaagaaggtcagagacagagaatgagaaagacagagaatgaatgagaaagatagtgtgagggagagcatcagcaagagagagagagtgaaagtgagagagatcatcagtgagagagagagaaagagagaaagagagcatgcacaagtgcacggcacagagcagagacagagtaaaaggcagtatgaggccaacatgcctcatttatatttctcatatatagcctttttaaaaaaaaaccatttgtatctgttgttcaatactccaaataaattgactgcagaatttgctgtagtaactctttgtgcaaataaccctgtgaggaaggtagaaaaggggtcacctccaactggacaatgaacccatcaagttccagaaacataaagttacttgccaagaacagctgattaatgtgtagcagagctcagaccagagcttcattccagaagcttcatcacttgacccccgggctaatccttggtgggtcttcagtctctccctttgcctctctgtgtgccccaaaccaattccatgttttcctcccaacccaggggactgggggaactatgtatcttcttcatgcaggttctggctgcctagaaggtcctgccctgttcacacagaagctccccttgacactctcctcttctttcactcttctctgacctctttaaatgtccaatttcctccactctctgttctaatagtgaacagatattaacacatgactgatattaaatgtttgtaatccttatgtctcagcaatatttacaatctaacatctgataccaggaaaaagcaatgctcagtctagaggaagagttctgctatggtgaaaatgcagggagcataatggatgggcagggcctgtatgaagataaaaacagagaatcctttcagtgttctttctgtgccaggcactgtgctaaaggttttgcatgtgctgactcatttacttcccataacaaccctatgagatgggtaatactattatcctccttttttatagatgaggagacagacacagagaggttaatcaacttgtcgaaggtcccaagttagattacggcaaagctggatttgaatccaggcagtctagtgcagcttctgtgctcttaagtagtagtttgtctagcagcttctctgagcctccctccagcccaacacacaacacaaaagcaactgaatttagtctacatgaaacacttgccaagtccacagtgccttggagaaggagggagctaagactccatcaaaaattgcgcttttctggtctctctagatccatggaaactcaccggggaagagtcattttctatcggctttggacttctgctatgaaatggcaattcctttgagccagtctgtctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcaggagagcaaatggtcctgcctgtaacccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatagctgtaaaaggaaataagcaagctgtgagccgtatgcagattataaagcacaaatgagtgtagagtatttatctgagctccatgtagcatggtgttcattttgtgggctaattccaggtgacaactttaccggcagcgtcactacctgtggatttcagaggagcctgaagatatggatgttacatccgctgcccttggctagacattagacagctgagatgttagttcattggtggctaactcattttcagcattgctatctgctttttatgatatctgataaaagtttctcaatgaaattaatcatttaagcccatctgcaattcctgagtaatggctccactctcctcccagttgcccaagcaggaaactgtaagggtgattttgtctccttttcctctcatcccagctccagtaggtaccaggaccttcaaggtgaggtctgaaattcaaacctggagtgcatctctcccctcctctgcttccactgctggaccctggttccagtcctcatctaaactttggcacagacattctgattaatctcttgatcacctggctttctcatttcccctataccagtctgttttatatcctcaagccaaggtaaacttcctacgccacaactctgcgtctgtttatcttttattattattactattattattattattattattattattattattttgagacagggtctttctctgccactgaggctagcatgcagtggcatgatctcaattcactgcaacctccacctcccagactccatccatcctcctgcttcaggtttgtgattagctgggactataggcacataccatcacgcccagctaatttttgtaattttagtaaagacagggttttgccatgttttccagccagacctccacctccagaaatcaagtgattcaccacctcagagtcccaaagagctggaattacaggaatgagccactgcacccggcctgtttctctacttattccaacataaataagggtttttctttgacatggtgctggagacccaaaatcataattctatacatgattcctcatcgcctacagaattaaattcaaactttccctcttatacccaactctccacaatcactctattctccataaaaaatttggtgagtctcccatgactctagcaatgcttatatttcacggatgtgtgacaattcactgctcacattacttttctggaataagatggggtagaaacagatgtttgctctttcccaataaactgctacacatgctgatttctgtgcttttgtttacttgttccttttatggaatgtagtacaccctccactctaatacccacactctaatctctttgagcacctatgtaacatcgcctttatcagaaaacttcccagccagatccagaaatctttccaatgacctgacctgtgttcacacagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcaaaagtcaactaaactccaacttcaaattcacgatatccagctactccttggctccccgggccagaatcagaccttccaggtgccaccatagtcatcattttgaaccttgtgtgtaggctgatgagaacattcagagtcttcctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcaagggaagacactccagatacctccatgagctttgcttccacacagctcaggtgatgctgacaggtcttcccagtgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaaaaaataaagtgattaccctaggtccttttccaaaattaaagtgtgtgtgtatatatatatatgtatatatatatgtatatatatatatgtatatatatatgtatatatatatattttataatatatatatatatacacacacgtatacatacacacacacacacacacaccacacacaaacataggtccatgaaacccaaaagtctagaaattcttgctttctagaacccaaatgtcagtttctttttatttttgtgtttttcctacggctgtatcatgacccaatctcagtcagagccacagaagaatgcaccctgagtctgttataaccactgcacttgggagtggggagtggggcacatggatctgtgcatgtggttgcagctcctttgggatatttcctgacactgtcatcatgctcttcgtgggcaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaacatggagagaagcatggtttctgttaatacatactttcatccttttcctttcatttccaactatcaccatctccaacttagaagagtagcatgaaaccagggttggggggtgggcagagtagtaggaggtacagaaagggcagatgaatactgaataagctctactatgttttaggcatgtatgaaatgaactacatatgacatatattatctcatttaatactcatcagaaacctgtcaattgaggaaaatgacaagacacgtctcaatcattttaggagattcacttgaagatgtgcccaggagacaggcctatgcctttctccaaagatgattttgagggctccaattcaaaggagggaaagagagggatattgagaagcacacagtttttatgtaacgggatggtaggaaaaaaatagtcattcatgcctttgtctggctcagtgaatctgcattttttacataagatgacataaacagtaggggcagagggaaatgcagattccctgcattttacataaaataacagacaaaatggggtaggggaaaaatcagataggcatttgtgtctggggtaactgcaccggtagtgataagctatcaatttgcattgccgtggtgaagttttaacagctcactaggaaattccttgtgggcaaaatatgggggaggcatgtagcttttcatcttgtagccatcttgtttaggcaccaaaaggggggaggcaggtttgcctgacccagttcccagcttgatttttccctttggctaaatgagattggggccccataatttaatttttttcacgttttccccctttttttctctaaactcttttgaagtactgcattttgaaagaaatatgcattcctggcctctggttgctttttctttttttttttttttgctggtttctcatggctaggatggtttattcctagaagttcaggtcccacatcactaggaaggctcattcctgggaggttatgtctcaccttgctaggaaggcttattcctaggaaatcttgtcccatgaagaaaaaaaaaaaatggaggggtggggtggaagaagggaaaatgagaggaaaccagaaagagagagagagagagagaaaagaaaatatatagggacctaggccagatttatagcaacaaaaggaaagcaaacctggaagctgggtgagggtatattactgcctcctcaattagagcaattctttgggccttttagttgcacgttgacttacatgcaagcacataccataacaacattgtaagcaaaaacaggatggaacacaaattattactattattcctattataaacaatagtttctaccaccatgttccccaggatccaagccaaccactcaaccaatcgattagtgagggttttggatctgacaggttggttatctgggttttcatagcagtcatatgttgcattatgttctttgattcatctggaacatacacacaacatttagttttatgatggcacaggtcccctcttgtgctgtcatgagtatctaaagccatatgattttgcagcacagctttcctcataagcataacctcattgtttagcaaggggatactcatgcggctatcattcagggccttttgggtgtaattcgttaaggcctctatatgccatataacatcttcaatacctatctgtggtacaaagattgaagctaaatgatcatgccattggaatactgaacacatccaataagagtgtaaatgaaaaaggtttgctggttttggcagggtctgaattacttgtccttgtgcccaagcataacctagggaacatcatcctaaccaccttggaggtaaccatggccataaggtagtgccacatagccaatatgtcccatttggagctagccaataaatatctggttgctgcacccaattgttggcatgccagtcagtgtcttataatatgataatgtggtctcaatgttctccaggtatccaccccacatctct

SEQ ID NO: 15993 - DNA, 31144 bp, Human
ctttgcatatgttagctcggtttcattaattgctgtatgtaattaaacaattgcataatgttatcagttactatagcgtaagcactctctaaatcttggctgctataataatatttttttattaataattcaaaggttattaaatggttttgagcctgaagagctgggaaaattgtgtcttagtgtcagaagaaaagagaggggtaccagaagtaaggtaggcttggttatagacatgttaaatgtgaaactataaggtattcaagtggagatgttcagtaaatattggaaactctataattagtattcatgtaggtggaaaggactggaaatagacagatgggagtccctggacctaggcatgctatatgaattctccaaggaaaacactgtagaaggaggtggtagatggccaaagacagacaaacataaggaacaactacagagtctggaggaataagaggaattgggaaagaattaatcaaatggcctaggctaagagcattatcaccatgttaatattatctttccttgattttaaattggctttatgttggttcctgtgagagaagcaatgaggccagtaagtgattattaccagaaaatattatcagagagttgagattgaattttttttgtgttagactaaaacagcatttgataattagaaagaccctgtagagttaagccaaccaaccaaagaaacaaaaaacaatagcaaaaagaaacagctcctcataaaagactgtaacttctttatttttgtgtgttttaagttgcatgggtgttttttggggatactttttactcttccatgtaaagaacagatgggactgatttgttatctccttcattcacctcttgtcccttttataaataaccagtggattatggattttcagtgaatttaataaaagtgcagaaattatggcatctttccaaaaatagtgtgccaagttgctcaaccattttctatgccaagggtaagtggctgctctgattttgaaatgaaggacagactttcatgtactagtagttctcaaagtgtggtccaagaactgcaatagcagcatcacttggaaacttgttagaaatgaaaaattctaggccctacctcagacttatgaaatcagaaacaggtgctgggagaagagatgagatggtgttttctagcaatgttttcataagccctccaggtgatttggatgtatactagagttagagaaccactgtacaagaaggtaagtaccatgaggttagggattttgccttgttaatagtgtatttccagtgtctagaatggtgcctgtctaattggtaggttttcaatagatattcattgaaaaatatgttcagtctcagactgccaatctctgtgtaaaagctttgatgctggtttaatgggcagaagtaaatcagtttagctgcattgagcctataatgtcagatatgcatgaggtgggcatgacaacgtgactaatttggaacttgaggaatgagggattatattgagtcaacactgaataaaaaatgatgtccaggtattttaggtcaatgattcatttagagtaaataaagattaagaagtcacaagttacatgcttttaatgacatgatcaacagttggtgttgttctggcgcagtggctaacacctgtaatcccagcactttgggaggccgtggcggatggatcacttgaggtgaggctttcgagacgagcctggccaatatggtgaaaccccatctctactaaaaaaaaaaaaaaaaaaaaaattagccgggtatggtggcacatgcctgtagtcccagctactcgggaggctgaggcaggagaatcgcttgaacctaggaggtggagtcagctgtgagccaggatcccaccactgcactccagcctgggcaacagagtgagactctgtctcaaaaacaaaaaaacagttggtgtttactaacctagtagaaccaaggcacccaaggagctgagttttctttgtttatatgcacagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaaggtgagcctaaaatgaccagtttgatactgatttattggtatttgaggatggagaggtagtagaagtgggggggctctgatttatttatcatgagtttttttgtgtctgtgcccttagaagaaaaatctttttcctttaggtctagctagccaagcatcaagttcctttgtgttcttcgccactgaattctgaaaaccacaatgaaataggagcttatttcttagatgtctatttgttggaatatttacaggtcattatttgcagtaattatttattcctgatgtattttttctctaccaattctatttttcaagctcgacttatgcttatagctggttataaaatattaggcatgtaaaaggaaggttagtctattttggcagaatctttttctaatatggataatgcccaagtgttgttaaagtagactttgatactttgtgtgactgaattccctaagcctaccacttttgccaaaccaaatataggcattttgatattgtccattcattttgtgattcccaagaggttagtactttgattcttgttgccaccaagagtcctttgtggttaaaaccactgcagtactctgttgccacacagattattttcttataaaatgggtctcagttaaaggaatttataaacctttattgaaaatcacgtagtgttgttctagggttaagaattagattaaagggattaaatttattttattgcctagggagtttttatatgtattacaacaacgtagggctttggagaaaataattaagccttttcttaaatgtttcattgcctagtacaaatactaatttctatattaaaaaacttgaaatggattgtggagtttcatttttattcataagagtaatttggaattattggtgctcttaattttactgtgcctgagtattcctatgcttttcccttgagttcatgcttaactcttctacattgtttttaatttttatgatttcagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggtgagcctttgaatcagcccaggctttgatctattaaaggaatgtaaggcttatgctgaagcaagttgttgacaaaaattgtcaggtaaaacaatgggctgtcaatatacaaagtagtataatgatagagtgaagaggatgggtgtgaattgggtggttcattttgtttccttttgttcattttgtcatattttctgataaaagcctcttaagtgtaggaataagatgaagagagccatgataactcttattgtggaagtgctacgcaaaacagtaaaataaggaaagaaaacaaagactggaaaagaagagacaaaataattatttgccattgacttctgtaaagtcagtagaatttcctgtatctcacaagtcatgagttagaaaatataaaagattccattcacaacagattaagtaacagacataaaaataccatgaaactttactgaagaatggaatagaagacttttatagagatataatccatgttcttgaatgggaagacaaggtattgaaaagatggtagtgttttctaattgatttatatagctaaagctatgtttagacatatgtttatatagatacagatatatttaaatagatatcttaaaggttttagttgttacttagaacttgacctaatatggaaaagcaaaggaattggaaacactaaaatttgggaagaaaagaataataaaacaggggttttagatattaaaatgtcatataaacccataatttaagaagtatcatattgatacttcaatgcaagtaccaatgcaaaatagattattgcaaccaaatggaaatctcagaaacacatccatgattacattcctaattagtatattttaaagacgacattttaataagtagaaaaatgatagattacttataaaacagtccttagacaattggctatttgagcgaaatttttaaattaaagctttacctcatgctatataccaaaatgaaacaaagattaaagacttaactattaaaaaatagcattttaaagtaaactagaaaatatgtaagtaaatatccgatagcaaggtagaaaaggactttattagcaaagaaataaattaaaaaaggaaactgttggtagattggaatacttgaaacatttgtacattaaaaacaagtcagaggacactgaaaaagttaaaatatttaatattttcaatataaaaagaaaggattagtatcattcatctattaataacttacagtcaaataagagatgacactctaagaatgatagacaaaagaaagtcatgaattggcaattcaaaagagatactttatggccaataatcaccataaagcatgtaaaatatttctcatttgtattcataaaaaatgtaaattaaaataaatattaagactgaacattttttacttatgatatttgtagtagtttttgagaaaactaataatagagttaaatgaatggggaacaggccttgtcatacatatccctgctggttctatagatttacccaacctggagatcattttgatagtatgaatccaaaactttaaaaataaacatatcatataacccaagagcttttcattttagttttttctaatcagagatacatacagaaatttgtatataagaatgttcacttctgcatatttataacagcagaaggttggaaactaaatgtctgaaacagaaaaatttttaaataagttgtgctattactttagaattgattattatgtgagcattaaaaatgtgaacactctggaataacatggaagaaatggaaataatattaaatgaataaagaaaaggttgtaaaatgatatgaatggcatgattttagtcttctaataggaaaataacctggattatacataaagactagagcaataacaatgtctggggattatttctggttggtgagaataaggctggtgtttattcccctgtactttccccatgctttccaaattttctgtaaggactgtgtattgcctttttaataattaagtctcattgtttgtcaagttgggccatatatggtaaagaaaattatttttcatctgtattatttgatccctttaggacacagatattattgtatgggatgtgatcaatgaaagtggtctgtaccgtctaaaggggcacaaggatgccatcacacaagcattgtttctacgagaaaagaacctgctagttactaggtaaagaaataatggtttaatttccagttattttctaggaagagagaatttgctttattccttactcatttctctcatgagcagtgtgctcatgcttatgcattagttttctctcctgttctcctgcattccttctttccatttcttctaagtagtatcgtagagctatccaaagctatattatttttaaaatcatttttctaatttgtcattcttttttcttgatatcagtttttctgtgtttcttagccttttgaaactcattatagaatgagctttgtctaccttctagatctctagaaagccaggaatcagaatatggagcagagggaagatatgaataccaggtgttaaattcggcttgccttttgaggagagatgtactgtacttcataggccttctgaacacctattaggatgaaccatttgaaatttttatttgtgtacataaaaaatcatcaaatatcaacaattttatattgttcaacctaatataataatgaatattcctaaagaatggccacctaggaaaagctgggataccaaggtttgccaggcattaattagaggaaccatagtaatgactcagaaaaagctgtgagcactaaatgctttaccaatggtggatttgtttctgtgggataggatacaggtaaattagtgtcttgttcagataacacaggttctgtaagagaatgattctatagttctaatagaaaaaatatatattacagcttagggaatataaaggcaaagaaataacactgtaaggtggggttatatgggacggactttgtaaatcaggtttttgagcggtgtttttttccagtttgctcatgaaggaggattatattagatttatgtagtgaggaggtagggaagaggtgtttgagcaggagtagtagaggccattggctgcgagaggttatatttagggggttaagaacaaataaataggaaattttgagactgctgccaatgagcctgactttgattctacagggaacattgagctagtgcaaatattaaaaattaaggttatctgacagttgcacattggatgggatgagagaacagcaatggacaaagagaccaaatgagaagctgttaaaataatccaggtagtaggacttaagttcaggttagtgtacagaaatggactagaggagttaatacttagaaacttcacagaggaggcattttcaggacaagagactaactggacaggaagacaagggagtgggagcggtctaagatgtttccatggtagactgtctgaggggaatgccagtgctgtgatgatggaaatgataggaggaaggcctgatggatcaaattctgtattctttggtactctgcatctaaagtcattcttgtgcttataggtggaacattttattttctgcacaggaataactacaaggaaagttaggattctttgcttttcaaaagtaagatcagagagaatcggagctttagacattattgaagcatatgttccttttaaagcaacagtgagttttggatctccctattcgttgaatgagttttcctaaacaggctatatatttttttcctgtttcttcttttagtgggaaagataccatggtgaaatggtgggaccttgatactcagcactgctttaaaacaatggttggccaccggactgaggtaagtgtagggtcatgggcccagggaaataatgggaaggcaaaagggaaaaggtggtggtcttctcttcccctttcatggctctttgtttttagtgcacacagtaattatcatatgccatcttgagggacagtgaggctggtatgatggaagcaatgccagccattggagcagatactgctgctctgacatgtagtaaaaattggccttgcgtggtttttaattcctgagtttcatcatttctaaataataagtgtccacttttatgaatgtagggaagtttaatgatattatatgtgcagcacctagcttattgacaggtaagcagcacgtggtagctgttaaaatagttacttgaacagagatctattcagttgagttcagggactgttttttatatatctttgcatcctcagtgctttattcatatcaggcattcaggaaggtaatacctagaattaatgacaagaagattaaattctttgttgatttgcaacaatattattttcattatttaattcccggatacttgaagctgaaagttatgcaatggacattagtggggcaccttttatttgctagacactgctaaaagcaaagaaatagaagacttaaaatcatcatttgagtggattctagttaagatttatgctgaacagccattatcttaatttgattatacgaggttagagacaaactgctagtatcacaaaagtaacaatttcaccgcaggccatttttttctctgtaaaagtgagacttctcttagtgcattttgaaagggttgtcgatatgccttttctttgcctttaaattgctagacattttactacggtgtaacagacttttggaatgtcatattatgctacctggaatctcttgaaaatcgtattactcaaatctttttatattctataggtatgggggttggttctgttgtcagaagaaaagcgactcatcactggggcctcagacagtgaactgagggtatgggacatagcttatctgcaagaggtaattacttcttaaaatcatgggcaatatgtttagaagtttcataagcaccttggatttagaatcagatgtaattattcagtacttcacatcatattagaaggaattctatcacaccaataacctgcaacacttaaaaaagcttttcttccttatatgctcattatccttatttatttgagctcaggttagctttaggcttacagcttctggtaatactaatgttttagtttgtggcactcttaatcagatattcttggacctttgggtgtccatggatggccttcagaatatctgtgaacctttcccctcaaatatatatgtagaattttatgtttataaatatgtatattctgaaaagatctataactttttcttagacattcaaagaatttacatagaagaaaagcttgcagaccttaggtttagctgaatttcggtgtgtgctgggtccagcagccatttcgatgggagttacattagtaggctaggggttatcttttctttatttaaggagaaaatgtatctacctgtcttgcgatgcttttgcaattcctaatgccaatttgaattttttgttctataatatggtcaacctttcacctaaatacagaaaattttgaagttagtgaagagtggggtcattattttttcaccattgtcactaaacagtagtccttatgctatagaaagtttttggagatagtataataagtaatattttgtttgtatattatgtagtcagtttttaataagttctgatacctgccttgctactgaagaggtttgataagggagatcactgattagaagctgttattggccataagaaagatttctaagtcttcaggattaagagttacctcctgggccaggcacagtggttcatgcctataatcccagtactttgggaggctgagataggaagatcacttgagtccacacacacgtttgaggccagcctgggcaatatggcaagaacctgtctctacaaaaaatttaaaaattagtcaagcacagtggtgtgtgcctgtggtttcagctatttgggaggctgaggtgggaggatggcttgagcccaggagatcaaggctgcagtgagatgtgatcatgccattgcactccagcctgggcgacagagtaagactctgtctccgacaacaacaacaacaacaacaaaacaacaacaacaacaacaacatgcctcctggaacatactatttcagcttttattttctcatttttataaaacagattgaagacccggaagaaccagaccccaagaaaatcaaaggatcttctcctggaatacaagatactcttgaggcagaggatggtgcctttgagacggatgaagcccctgaggatgtaattcattttcatttcttaagtttaattgtgttgaataatgggaaagtaagaattgcagatttttagggaatcatcactttagggaatatttttgtcacttgcacttattagaattatgtttttttcagaagttcagcagaacttacatctaaccttcatctgctcttgcttcttctgtagcgaatcctttcatgcagaaaagctggttccataatgcgggaaggaagagacagagttgtaaaccttgcagtcgacaagacaggcaggattcttgcttgccatgtgagtaccatacttaggagaaaataacaaggactaggctgttccttccaaacactcattctttcatattcaatgtaaagatgactttttcttgactcatgttaataattcattatatggtactgtgtggacctataatctctagctttattagcataacaacaaaaatattaataattactattaggttggtggaaaagtaattgtggtttttgccatttaaaaagtaataattgcaattacttttgtaccagtattattattagcaaccatttattaaatgcttgctcttctaagcaatttaagagcatttaacttcttgttcagccttcagagcaatgctacaagtaggaaatggtatcctcattttacagatgagatagcaaacccagagagattaagttgtccaaggtaatacaactactaagggaagaaaaataaatattgttgtttacttttaattgagaattaggtaaattacaaattacctctccttgactcacattaaccttttgcctttctagggaactgactctgtgctagaattgttttgtatcctttccaaaaaggaaattcagaagaaaatggataagaagatgaagaaagctagaaagaaagcaaagtatgttttcttaatacttacattaataatgaagtatcctgggtaggccccatgttactgaaaaaaaactggcttctttcatatttactgtcttatcaattaccattaaaagttaaagaacttgtgaggtatcgataacccaaatttgtcaagtctcagagagacagaaaatcatctgatttggcaaatcttttgatacctattctggtttatttaacatggttggattgttaagtgcaggttaatgagttttctaaaaagtcctgaaattagaaaaataaccggagacatttcagtggaatagttggaattacaaggaccttgttacaagaaattttatgggctattgcattcagaatccatttcttaagggtacctattaagtgaaataatactttatgacattgtagtgtacaaagcatttccacttatactacattgtttaattatcatggtaatcctgtgtggttaagtgacttttccagaataacacagtttgttggtcaaggggccagattttgaactcaagtaagagcaaagctgcttctagaaaaataagagcatgatatacttttcttcttccctctagattacattctagcaaaggagaggaggaagatcctgaggttaatgttgaaatgagtctgcaagatgaaatccagcgggtgactaatataaaaacttctgccaaaatcaagtgagtaaaaataaattatctgaagttatagaaatagtaagctaccaagtattattggctttttcatgctatttgtaagctgtctgtatgaattatatatgtggagacggtggtcatgagacatctgtgtcacactctgctcctgttgtcctaatcatgggcccactttttgtcttgtatttggattattatagtaccctttttagctagtcatttactgtcttttcctgcagctaatttaagaaaaagaaaagtgtgtcccacgttcagaaaggatataaggtcacttataaagaatacatacacagaaccaaagtatgtatcagaaccaggatctgagcctagttttttttttttttttttttttttacttaaaagcctactcagctactactcaatactcggagcactcttttaattttttttgagatggagtcttgctctgttgcccaggctggagtgcagtggcatgatctcggctcagtgcaacctccatctctcaggttcaagcgattctcctgcctcaccctccgcagtaactgggattacagacttgtgccaccacactcagctaatttttgtatttttaatggagatggtgtttcgccatgttggccaggctggtctcaaactcctgacctcaagtgatccacccgcctcggcctcccaacatgctgggattacaggcgtgagccactgcacccagcctcagggcactcttacttgaaaaattgtttatagttattcaaactttatatagatagaggacattgtaaagccttttcctggaaaaagtaaaccttgtgagctaagatggtagctagaacatttatgattattttcttgtacaggtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggttcgtgaaatgatgttttatatagctgtagttagtagtatttcttttaattttttttggtactcttaagggttagttattaactccttaaggccctaaatacaattatctttagtgcatttgggccattagcctgtggagcttagagaagaaaaagttgccttttaaaatgtggtgcaaaaaaaaaaaaaggcaagcttattccatgtttagagcttgtaactgtacttggctagagaaaaacacacaaccatactacctactctttaaacttaataaaaagcaggctgttattgctgcccagtaattgtaccctaatttctcacccttcttttactttcccagatgactgttttataccttgcttctgttgtcaaatcaaatacctccaaaaccttgaagctaatgatcatatctcccaccttaaaggaaataataaccctctctcacccctgcattgctctccagttactaccccattctctgatttgttttctccattctgtcttcatctgtctcccatcaagcttttgtccccactgtttcaccaaaacagtcattgtcatcagtgatcttgtttccaaatccattgagctaaaagctttattttatgctttgtccttgaattgatgactttctgtctttgacacactctttgactttcattatttccccttcccttgctgtctgtttattctcagtcctcgctccatctttcttatctttatgacgtctaagtgttagagtgctttagggcagagtctttggaccttttgtgtatctaaactcactttatgtaatctgtcatgtagctttctctgtatgatgacacataaatttatatccagctttaacctcctccctaaacatcaaattcatatatacaaatactttgtgtcaccacttggatgtctaattaagcatttcaaacttttatgtgtcccaaaccaaacttacgttgttcatgtctccaaaaatcttcccacctgctattccttcagacttccctatcttaataaatgattacttgctaccagttgtagtctaaaccttgtagccattcttgattttcttttatttatttatttattttgagacagaggctcgctctgtcgcccaggctggagtgcattgatgtgatctcgcctcactgcaacctccacctcctgggttcaagtggttttcctgtgtcagcctcccgagtagctgggattacaggcgtgtgccaccacgcctggctaatttttgtatttttagtagagacagagttttaccatgttggcctcaaactcctgacctcaagtgatccacccatctcggtctcccaaagtgctgggattacaggcatgagccaccgcacccagcccattgttgattttcgtatcccatattcatccaatctattagcaaatcctatcagctctaccttcaaaagtgatcccaaatccagcctcatcttaccacctgcactgccactaccccattcaaaccactgtcatctctcatctgggttattgtaaagccccctgactggtgtccctgctttcttgcttgcccctctatagtctgttctcaacacagtagccagtgtaatctttttatagtggaagttagatcacttccagtagttccatctcactctacctaccttacacaccttatctcttactactctccttttctgctccactagagccacactggtcttcttgctattccttcaacagaacaagaatgtgcctttcttatggctgttgtgctccctgttctttctgcctgaatccatcttccccatttatccataagctttttctgtgtcttatcagatgacagtcctatcattcttaccctactccttgcactcttcatcctcttctcccagcattatgttgctctatagcacctaacacctgatataccaaatatttagatatttattattcccaaagaatgttaacctttatgagattaggaacctctgctgtttcatccactgttgtatctccagcacctagaacagtacctggtaatgtagtgggcattcagtaaatgtttgttaagtggacatttgatatatatttgattaattaattaatgtttgtggtcctataaaaaatgtagggatatgtaatgatgtactaatttgacttgtaatccttcagactcactcacttcttggtaatggcagattgggctccgtggagcccagcagacacttttctactctgcttttgtgtgatttctgttccttaggatttggaggccttataaagtaaacaaagtttggtgctttttagtattttctcccatgactataattgtgtgtgagtcaagggtttttaagacttttatcttcttttatgttgatctgtctaagtgcattgaaacctacacactgacctctaaaatggggatgcagattctcttaacatgagttctttattttttctttctcataggtctacactgcagtgtattcgcacaatgacctgtgaatatgcactttgctcattctttgtacctggtgatagacaggtagtcataggaacaaaggtaaatggagactttttctgggatatctggatcttttctactcaaaattcataaagttaagaaatctggttcttctttttagcatattggaaatggactggagctaagtaatctgggaggatgttagtttattacatattttgtttactgaagttttactttattttttaaaaattatgaagaagaaaattaaaatcatgaccctgagataactaccattaacattttggtgatcatcctttcatgtgtctttttatgggcgcatatgtaattgtgttttaattaatgataaaatatattaagggtaataattaaatatattaagtacctaatatcatgcttggcagacagaagcattcagtaaagacaaactgatcaagtccttattcctaggtgctagtcagattgggagacaaccatgtggaaataagcagatatggatttggatttagtttctgccctttagaaataggtaatttgggccgggcgcagtggctcacacctgtaatcccagcactttgggaggccgaggcaggcggatcacaaggtcaggagatcgagaccatcctggctaacacggtgaaaccctgtctctactaaaaatacaaaaaattaggtgggtgtggtggcgggcgcctgtagtcccagctactcgggaggctgaggcaggagaatggcgtgaacccgggaggtggagcttgcagtgagccgagatagtaccactgcactccagcctgggtgacagagcaagactccatctcaaaaaaaaaaaaaaaaaaaaatgagtaatttggagcaagtcacataactgctcatagtgtgttcctttatattatgggatgacgacacttgctttttgacagcagctttcgtaccagatggactggtaccagcctctggcacttactagctatgtgaccttaaccctgttagccttggtgttctcgtggaaaatgacgttactgacccatttcacagagatgaagtatacaaaactcttagcagagaaactagcctgcagcgaatagctaatcgataatagagctggtagcagacatagcagtagtgattgtaccagtagtgagaataaaatggaacaaggtctatggagtgttttgaaaagtgctttgcaagtatttgtcattattattcccataaaacaaagccatatgtacatgagttttattacaaaatgtatggatcacaatggatatttcttgcttcaacaaaaaaatgtaggctggagagattttaggaacaatgccaggaaacagtattcacatctcaaaactttccttcctttttcactctttcaacaaatgtccatctctgatttgccgtcgggaaagtagttttttaattgcttaagactacccatgtggctaaaatgcaattgtcggcttactggctgtgctaggcaattaatgtacattatctcatttaatcctgacaacatctttgaaacattggtgatataaatttcattttacagatgaaaaactaggttcatggggatgaatttaccaatgggcacaaagcagacctggtactcaagtcttttagcttatgctgtctgtaccaccttgtgcagaagctcatcgtaaaacaggctttgcctctgtgtgtgttacatgctgacaccatgactatggcatatacagacctctaaataggaattttagagtgattgctttctatgccattatgatttttttttaaattcactgccttccttagtgctgtaggtagatcccatttcttattgtcaatgtattgcagaggaggaaaccaaaagcagatggaaaagaggtggttgcttaagccaataactatagaggatcatccgcttaaaggattggctaaactttaaaggcttttaggtttgcatttgctattttgtttattctgatttgcctatggtcatgatattttccttgtgaagttgtgtaaccaatgaaagtaatgcatccagtactgcatggtggtattattccatacttctacactatggtagccctgccaaggttaacccagcacatcagtaggggatttaatagtatttaatcaggtaggaaatacagaacatggaatgtgggatccatttcctaagcaatggatcacatttttgcagcttggttatgaagtcttttctaaattgtgcagtcatgaatcatggaggttgtacgtatgttcattggagctgtgctcattttgtgtcttcccagacagggaagctgcagctttatgacttggcttcagggaatctgctggagacaatagatgcacatgatggagctttgtggtccatgtccctctctccagatcaggtaactaaaccagattttaaagccctggagttcagccctgtggctaccctgatttctctcagggtttctttaaagaaagcctgaggtttttttttttttttggtctaatctttagtgtttgtatatgatgccttcttataaatgaccacctgtcattatgaaatgaaatcttgtttggctacttttgcttatcagcagcgtgacatcaaattgcttaccatcatgatttttttgccaatgttttgtaatacttcttaagggggaatattctcttgggcaacatgatgcagagaactgaatagactttgctgctccccttttttcctcaaacaaacatctatgactgtataagctaagtagttttagcaagtatgtcagcccttacaagtcaataaatatgtgctcaccttcagagcagttcctggcaaaagtatgcttattctaataatggtgctgttgcttagaaaatcttgagatttttttttttgacaacaccttaagaaattttggcccatttatttaaatattctcaatgatagacaattttcatccgttgaaagtagaacttagttttggaaaaaatcactgaagtttagagtgtttaataccacttggggtccaaacgaaacagctgtgagtctaaaatagtaataaatcttgcatttgtagagtgttctatcttttccataaactgtgtggtctttttttcaacaaaactagggatttacggaaaggttgtttcctgtgttataaatctatgagggacagacacttgagatccagtgttctatgtactttacactaacactgccatgtaatgagactaattttcttgataacggaaaacagcttcaaaactattttaagtagggacattgcaggactaaatttatatccttctgaggtgaatactttaaacaaatctagattatccattctatgtatatttttcaaactggtttactgagagtttttgtttcttcttgatgctagataatagtataactagaacttttcattagttattatttctgcctatgttagtcgatggtaggaattttcacataaggtttgtggcagcagacccaaaagatcagtgaaaggggctagggagaaccacgtttttcttaatttttatcccatgacgttaaataaaaatactttcttagacttttaaaatgtatcttcatagcaaagtttttatgctaaaatagtttttaattgaaatttcatttgattttcagcgtggctttgtgacaggtggtgcagataaatctgtcaaattctgggattttgagttagtgaaagatgaaaatagtacccaaaagaggtgagtagacattttttgtgtccattttttggagtgaaaatggggagctatggaatggccttttgacgtcttatatcatttgttgtgctctaaagagttaggatttgtctgaatttgtatactcatttattttttcttgatgttttttgtggtgctagactttctgtgaagcaaacccgaactttgcaactagatgaagatgttctgtgtgtcagttactctcccaatcaaaagctattggctgtgtctttgctggactgtactgtgaaaattttctacgttgatactttaaaggtacagtggttatgcctgcggatattttccctttctgactgactgaccttaagaatttgggttgaggctataaagaagtggccttgactgtgcccagcgatagtacatttctaaaaatgtgtgtgtgaatcaaagcaatgtaactatgctagggaagctagcattttaaaataattctatggttcatgaattttgtttaaagcaagttatatttcatatgttcaaaaaatcttgtggacagaaaattctgtcatactaagtagttataagagcattgctaggtgtcctgggcagtgatttcacacttggctatatattaggatcatctaggttgcttttaaaaatatagattactgagccctatacccagagagttgataggaccaggttgggcctgggaaatttttttgtgaaacaaatgccctggaatcttttcagtgaggagatacagagatctgactgaggcagtaagcttctgggggcttccttgcctccactatactgcagtattcttggcaagcacatggagggtctgtgtagtggacacaggtactcctgccaagctgtcttttgtgggttgtctttgaaaatacagatataaagcaatttaaaaatgtgtttaaagttatattttagacctacatgtaataaattatacccatattttatagacagacattaattatgtttttttgatgtttagttttttctgtcactgtatggacacaaactgcctgttatatgcatggacatctctcatgtaagtagtttaaatagtgtctcagtaatatgttgtcttttttacagcagatactttcttaattctggcttgatgtcttcatcttagattatttgtttttatcatcattctgttatatatctttctccaaaaacagtctcaaattaatatatattgtatcttatatatattactttaatgttttcagaataattttgcaaatatcatctcaatcaatccttataaatattatctctttccctcttgtagctctcccaaatagtactttattgtttaaaatactataattggtagagtacactaaaatatgaaagactttaaaaaggcattcctttttattctgaaggataatgctgctgaggagctcggatttatatttggatagttacggtattttacactatgtagacttttggtctcttgaccaaaatcatttatttcccaatacctagttttgattaggagtggcaatgtatattaaaaacaatgtctattctgcagagtgagactccgtctcaaaaaaaaaaaaaaagtctattctgtgtgaaaggagttgacctcatagctgtctgtggtcagtgcactaacaaagttaagttacaatgttaaatgtatttcttttttttttttttttatgttgacaaccatttggaccacgcattgaaataggagagataagagaaatactgatagggaatgtgggctacataaacattctagtagagtctttctcagcttctcttctgtttctttctcccactttctttccaaatcccatgccagagattagaaaatctttttcctatctaacgaagtaaatagataaccctatgtcaaggcacagcactgccctgtgacagtacgaaagtatttaagccacagagttcgtgcttttacttaacaagctttttaagttcctctgtaggtaagagcaaagaattcagtgtttttagtagagatgaaaatcagttttttggcttcattttaatgtgtttgaaagaaatgggttaaatattctggttagctttttattcatatacggaattcaaaaatcaaggtagtgttttacttttatttctcataggatggagcactcatagcaactggctccgctgataggaatgtgaaaatctggggtttggactttggggactgccacaagtctctctttgcacatgatgacaggtatgtatagtcttttcaaatgtctccctttgagtcacctgtaagttatcactttccttgagcatctgtgtctatttttcagtgttctcaggcagtgatacaagttctaaaatatagtcagacaccctagaactagctagtcaaaagctatttatgtgtgtaaaactctttttactaacctggaatttgatgacattttaatatttctgtcacttttcagtgtgatgtacctacagtttgtacccaagtctcacctcttcttcactgccggaaaagatcataagattaaacagtgggatgcagacaaatttgaacacatacagactctggaggtaaccacatgccttctgtgcttgcttggtacttaagaaatacttttaagaatatttacattacccactaagtagtggtcaatgaatgaggtattctttattttttttttctcctccagggtcatcaccaggaaatatggtgtttggctgtaagccccagtggagactatgttgtatcatcgtcccatgacaaatctctgagactttgggagagaacaagggagcctcttattcttgaggaagaaagggagatggtaagaactttaggcttggttacaaatatgccagtaggtatctgacaggctgtcctagttgaagttttctgtctagtgcagttacacctgatgcattgccaagtccaagaaccttcaggagatcttttcaagaccattgtcacccatttcagaagctaggcagagataaagatgccattagggtattatgttgtcaaaggagcagcttctcgcttcctcatttctcttcatatagagaccatgtttttttctctcaaattaatgtatatctatctcatggcaggaaagagaagcagaatatgaggagagtgtggccaaagaagaccaaccagcagtaagtaaattttggggaccttgagattatgccccatatatagttatcttattgaaattgactataatgtccagaatttctaatagaattaaaattgaggctagaagttgcaggtatcaccagctgataaagaatctgtgtaattctttctcttcaactgtatatcctaattttgtggttcaagtgattgaccaaatttgctactgaataattattctgtcaattgagactttagggaattattttattcactgtagcacaaaaataaaaattagaaaatttggatattctctttttaaacatttgcaggatgttcttacaataatacatatgctaagttctgttactggtagctgataacactgttagtattttcataaaataataatagctgttctcatatggatgtaagattaatttatcagctctttaactcaacagtcaacagtgttattcaaggatttctttgtttctggcaggttccaggagagactcaaggtgacagttactttactggaaagaaaactattgaaacagtgaaagcagtaagttgatatagaatgtggtatctcgttttttaataagatctcaactttttagtaaaagttttattctgtatcaaccagaaagccatttttttggcaaaaagttgatgagatttaaagatggggattataacctgtttccttctcttgtaaccaaagatgggagtagtcctgaatctctttgatcaatatgtgctcctttcaggtgttcctgggacctgccctattcagagtgtctagatatcatcccacctgagtccatgacactcagtctcttccctgtacattaaaaaataagaaaaccaaaaatgtctttaaatgctttttggcactctattcgcacgtctttattaaacagattgaagctatttcatttggcaaatttctggtcagttcttccagtttcagtgtcctgggatgatggagtatgttgtgatgacttctttcctttctcatcctctgtaggctgagaggattatggaggctattgagttgtaccgagaagaaactgcaaaaatgaaggaacacaaagccatttgtaaagctgcagggaaagaggtaataagagagtacagtaagttacagtatcaataaagggaattcccaaggagaaaaaccattgttttgggatttattaactaagatcaggatatgcaataaatggaatagaatctttccaactcactatattagaagaaattgaggaagtgtgggaagaagggaacttggtcttaatgaaagcgaaggaaaggaaattacagattgaggtgattattgtcttgagtagaaacccacgttctatgttggtttgggaggcagggtaaccatttcagatttctagataaaatacattgtccaagctcattcatgagtactatagaaactaacaggtttgataattcttttacactctgtcagttttttagggtctcttttttcccttttcaaaattataaaatacagttaccactctgtctataacaagtgctacctaagtctcagtttttttaatgacttgatttaataatttcttcataggttccacttcccagcaaccccatcctaatggcttatggcagtatctcagtgagtaaaatgtctaacggttttcctttgtttattaaaaggttacttacaaggacaagaaaggaagtagaggcattatgatttggggatggattattgggaatactttgtcttcaaaagtctcttttgaatcttggcattctctaggatattttgtatttcaaaaggaccactttagtgtgacttcccaagccagcctttttggttggactggactggcattcttctgttttctagtgcctgtttatgttcagtgtccaaagccctctgaagattctgttaatctaaattaacttttgaatcagccttcagaaggaaagttgacagaaatcagtctgatgagataaagaagagagagaggggaagagtgatgggagaatgtatgtttatctagtaatctctaattagtattttattgcatgtctcatcacagtaattttgtgagtcagggtatcttcaccttatagataaggaatctggcttgacttgtagcatagttggtaaggggcagagttcagttgtcaacccagatctgactgactctaaactcatgcagatcttgccattttagaatactttttctgaagtaagaaggaggggttcctgttttataggagatagaaattagagaactttagtagaaaccaaccaagagtatcactaatggtattaatccttcctttatagccttcagcttatgtattagagatttttaaagggatcaagtcgaggtgagtgagtccttgcgcacaatttttgtaatctgtcagcaaacatttatgaagtgcttatctgaacgggaaataaatagaaattataattgatggttatcttataggtttaactatatcaaagttttgatggaaaataatttataatgttctttttgaagtgctagaactaggaagttccttctaaagtatgaagagagatgcttttaaggacaaataaaggggagtgatttatgttgtaggcgatgaaataatatataattcaattagaagcaccaattgttaatttgttttatattttggcttcttttctatgtacatacacaattggaatattatataaagttttatattctgttctttttcacatatttcctgaacatttgtttgttgttcatattcttcaaaaaaaaaaaatcattggattcagaattattccattgtatgaataattactcgatattgcatttgtttctcctttttggctattatcagtggcttcactgaatatgtttacacatatatctttgtcatcattattgattatttttcttaagagtcctagcagcctaataactgaccagtaggcataagcttttaaagttttatattgccaaattactttccagggtgattatactgatttttagcaggctttaaaaaatttgttgccagtgtgtgagccaaaaggtaatattttattattttcatttcttttgactattaatgaagttaacatttcagcatatttgttgaccatttgtattttgtcctgtgaatttttagttacctctttttgctcttaagtattattttactggtttttaaagaattcttgctgggcacagtggctcatgtctgtaatcccaacattttgggacacttgagaccaaaagtttgagaccagcctgggcaccatactttattttctttgtcatacatttttgcaataattgttatattatttgtgattttccttttgattttatttatgagtttgaactactgaaggctatcattttcataatgaaccacaatatctacatatatattccttacaagaaacaacacttgtcttaggataaagatgaaacttcactacaggaatgtaaaagaaaattgattaatgtggaggttacaatacatttcaagataggaagattctgtgttttaaagatttaacttttcctaattaataggtttgtaatcccatttgatatcctcttaagattttaaattggaattgatgaaataataatacttgagctagttctagagggaactattttcccagattaaaaggctacaaaattagcaaaattaaaatagtgtagcattggtgtcaggatcaatcatcatgtcaggatcagtcatcataatagactctaatggactcaatatatggtaaaagaatatcatatgaagatggaatattcaacaaaaggctttggagatattgtttatctggaaggaaaaaaagttagattttcccatcatgccattgaccaaaatgcattccaaatagattaagatattaaatacaaaaaacaaagagagtcatctagcttacagatgaatatttaactctaggcaagatgtatccaagtataaaatcagtagaaaaaataataaagggaaggatttaaaaattgaccatgttaacaacgttaacaaatgtggcatttttatatttattttttctttttcagtgagctggaagaatctctacttgtgctgcctttctcttatgtcccagacattcttaaactctttaacgaattcattcagctgggctctgatgttgaacttatatgccggtgcctcttcttcctccttaggtaacatccttttccaaagaataccatgtctgttcagcagaactgcttcagtagtaccttaactgaagctgtcaacactttgggattaagaaatagtatgccgaactcggtggctcacacccgtaatcccagcactttgggaggctgaggtgggtggattgcttgagcccagaagtttgctaccagcccaagcaatcagtcttgcctttaaaacaaggatcatgatgacccacctctttaagtaagaagtcatggtaatacattgctcaggaatgcttactcagtcataggcctccatgttacaatcttaagatagctctggttctagtcagtttgccaaaagccaattatgattggccagtttgcctcatttgttgtttcttttaagccaaccttgtccagcctgtggcccgcaggccacatgtggcccagtatggctttgaatgtggcccaacacaaatttgtaaactttattaaaacattatgatttttttgtgatttctttgttgttgttgttcatcagctatcattagtgtattttatgtgtggcccgagacggttcttccagtgtggcccaggggagccaaaaggatggacattcctgttttaaagtgtttagtgtaagctaacaggttttgctttgtcctttaccaacattttaagaaagtcagtttatttctcttggtctctacaggtgcaaatggaaatgtaggggcatatatagaggtaaactaaggaacataaagcaaatatgttcattaggctatattcttacttatgaagattctgttaataggtagttgagaagaatatatgcacaaaggcttgatattcttctcatctctcaccctcattctcaagcggttacagcagagaacagggatggagacaaattgaacattccttcaaatactgttatgaagacaaaaactggtcagccaatgccaaatagttaaacaggtatatgtagtgaactgaccaaataggtatttggtgaattggcctggttttatgattcttaaccctccatttcttatactctatccaggatagtagcaagagaagaagaataatatgttctgttgccatattcataatttggggcaacttgtaaagacataagttcatatttaaccatgttactaacaatttttttttactgctatggtatacgtgctattgaattagggttgctggttctacgagtaacactgtgaatacttatagcgtatcagaggcttatggatgggtactacctgacaggtatggtagggtcatcaaggatatcttggtactctaggtcagagtttgaatctcacgaatgtctcttttttgctgtggctttattagaagtattaatgcatctttgttaagttagcatttcttagaaggctcattctgtctttgagttttccttaaagtaccactgtcaaaatctgtagccactggcaggttgctgggctggaagaagagcctttgcaaatgagttgaatgtgtcataaggtttaggacagtattttttaagttgtcatcaaattgaactgaatagtagagaaagaaacttctttggcttttttttttttttttgctcgaaacatttctataatgtatattttgttgttgctttgatattgtgtctgtttactgtttctagaagggttaagtagggctagaacctctctgcaacatggctgtgttttgtttttctatcaggattcactttggacagatcactagcaatcaaatgcttgtgccagtgatagaaaaattaagggaaacaactatttcaaaagtcagccaagtccgggtaagtgtctttgtatagagataaaataatgaggcaaattcctagtgtgatttagaaatagtatagtatgctgtgctttgtctttagcaatacccaccaccgataaatccatatttgagatagtttttgttagaattagtaggaatagaaaaaacaaacaagaaaagttcttaatgagggaaagataagtaacaacacctgaagctttggttaccctaactctcatacgctgctataatgaattgaagtgggagaaaattttttaatatttcttgtattgcactccaggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatactataagtgtatgtcatctgtttataaaatgaattgtctgtctggattggcaggcaaccacagccgcagacctcaatctgtggtacttatcaagcatcagctttttcttgtaatgtcatgacttttctctgctttttgggagcactgtgatatgcagtttactggggcgatgagttgttcatgcacaggtgattagtgtcacagcattttaagtgcatacgcacaacacttgagctcactgcatagcaacaggaggtggctgtgaaattatttcagtaacatactgtgtattacagttcattttatgcagctatgatttaatactgcatctttacattattttacatttctcccaaaactgtgaattgcaccatgtatgatctgtatttgtgtgtgttaatgttgataatagatttgcgtgtattttatggcagtaaatgataaaatagtctagtatctacatatattttgtgcattcatgatataactacttttttcctaatttttttcatctgaaacttttctcattgtttcagatctccaaaaatttttccaatatatttattgaaaatatctgggctgcgtgcagtggctcacgcctgtaatcccaccactgtgggaggccgaggcaggcggatcacaaggtcaggagttccagaccagcctggccaacatggtgaaacctcatctctactaaaaatacaaaaaactagctgggcgtggtggcaggcgcttgtaatcccagctactcaggaggctgagacaggagaatcacttgaacccggcaggcggagattgcagttagccaagacagtgccaccagcattccagcctgggcaacacagtgagactccatctccaaaataataatagtaaaaaaaaatctgtataacagtggagccaagtggttaaaacccatgttcaacggattgtctactgtatatcttcatggtaaggatttggggaatgttctaggaaaagatattgacagatacctctgggtctgggcttttcttttggggaagtttataaatgactaaatcatacttcttgttacaggcctgtttagatgttctgtatcttcttgagacagttttgctttttatcttttttgttgttgttaatcccaaagatttaaaactatggtttctgtctgaatttggtcattgcaaccaagttactgtgttgtggggccaccattttcttctaggctcagatatgcagtccttgtggcttgccgatttgtgtcccaaaccacaagtcttaatgttcttgagcataacacaatcactgaagtgagtaagggatgcagtggtgttatttgttgggcagaataaataagtgaattttggcatagagtttctgaaggcataactatgaaggcaagagaataggcaggcaggataatgcattctaggtgctttccaaggagtcagtgttgtttaggcagctattcctgccaccagggagaggagttaattcttgaaaaaaaatttaattttttatgagaacagaagttgattcaatatccttcttagagttgctcatcagaacataaatgtcactttctagtaacatttttgatggtttccaaaccaaaacaagttccaggagggcattcgagatgtatacatcatcaataattactcttatgttaaaagttgctgttttcccgtagctttgccaccatttataactcaaaagcctgatagtgctagggaatgtaaagatgtttctgtctgctaagtgttatactaatcgaagagaaggagaacttttatgataaagtgacatgtacagaacctagccaagttacaatttttggtcaaaatacttgaaactctttaactctaaaagtttaaggtcaataggtgcattataaagtaaattttaagccaggcaaatttctagtcattaagtcagtattcattgccttagtcagccattggctgtatataatccttaatataaaaaccatctaatgactaatatctcttgcata

SEQ ID NO: 15994 - DNA, 160018 bp, Human; identical to SEQ ID NO: 12617
  misc_feature (1)...(160018): n = A,T,C or G

SEQ ID NO: 15995 - DNA, 60465 bp, Human
gattcataaaattaaccaggcatttgagggcttctaaaagtgcttgatggacagcatttctctcaatgaaagagcaggcactgctccttggtcaaaggagagtccaaccaaggaagcctaatgagttattcctcacccaatacctggagaccatgacctgggggtgaggggcttccccagccccatgtgactgggctgttctttcctcagccctgctcttaaggggcttaacagctcttgctggcagtccaaatggctgcatagctgtcagtccaaaagtcccattatcatatcccgttcctgtatgaagggataagagtagaggcattggacatggcctcagctggactccaagttctgccctttactgtgtgccctgagtaatttaccttccccaggcatcagtttcctcatttgcaaaaacaacagcagcagtaagactaagttaatccaagcaatgcacttcacacagggcctgctcaatagatgtttgctgtcatatcacttcccagctcaaaaactttctgtggctccccagtgtctgaaggtctaaccccatcctgcctttctaagttggcctgagttcctaccagcccagggcagagaacacttgatttcctcatattttatgttacacactgcccctgccttgtgttcccagtatctacagatggtagggaatatctcgagatagcaggtttgtggtagagggcattggtcccagaagtttcactgatagagataccttttaagattttatggctaacttaagaaataattcatgtctctttgcaatatggttcaagtgtcttgagtgacttcgagtccccacctggggataatggaggtgaagcagcaagaaagcacattcccactcagtttcacaacctgcaccatgtatgtgttggtggttatttgggcagcagggagtcctgttcatggaaatggattcctgctcacataataactaagagttctgtgaactccctcagctgggcaggggcaactctggtgcttctgtctgcaagaaaggggacagacagggaggctgatgtgaggagctggttctgggaatagggtcatttgttctgggatatagggatgtgaggggagggccagctcaatccagactgatgaagagcggggagagtgatgagtgcctgcctcagcttgggctggatggatgtggggaggctgggcagtgagggagatgtggatctgacatctcagcctgagggaaagtcccggttgagatgggggaagacagaaaaagaggaatctgagaagggagaaaccaaaggctggaaatcccagctccggggataagggagtatggggacgggggaggcctgcctcaggtaaccctacgcctaacagttgtctaaaatgctccctttccttgtcatgtttgaggaaaagtggttcaaagaggccgtctgatgcgggatcacacagcgctgaagggatgaggggccccgggtgctcccgcccgtcctgctgcctcctccggtggctctctgggagccacagccccgtctagccacggaggggcctacagcacgccccaaacgctaaggggaagcgcgggaggtgcggtaggaaggcagagaaacctggtttttaaaaccaagccattttcaaggaaagaatttcttactttaaaaccttggtttttaaaaccaagccattttcaaggaaagaatttcttacttaaaaatagcgtatggaatggcggcggaatgacgggagggaccgagctgggggactggacggcgccccggggacacaggaaggaggcgcgcagagccgaggccagaggcgcgcccggggagtggaagcgcgaagacaaacgcggcgccgcggagggtgggggaggaagggccggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtgagtgaagcctgccccaggggccccgcgccggccggcgggtactgggcagcacccaggctgggtggacgcgccgggctcgaggcggttgccgatcagagacgggtggggacgggtcgctgtgggccgggaacaactcagccgtgggagccttttcaggaagagaaagttgttatttcatcgccagtgtccctcatggagtcagcaaggaactgtgtggccttagggaaggacgggctccggcccgctagcctctcctgcggggcctgcgcccccccgccggccccctcccgagctccagtgaccaagttccttcctgggcttccccagtaacgtcgctgagcgcttcagcggactgcaaaatttttcccagccgtgaacgcgcccgggacggggagcgggcgcggatgccacctgctcgagggcgacgcctgctgccctccccgcgcggtgccgtccccgcccgcgcggcgtccgccgtatcagcagagaggacttttcagaatcgccccacagcgaggagcgggtaggcaactaggaagcccagtcggcagcggcctcacgttgggattcctaagtggtgcgactcctgctcctttttcctcccctcaaatcctaaaaactagtatcagaactggttccatcctctccgtgtgttgtcagccaagtcgtcacaacaacctcaggaaataggtccccttcttcccattttgcctccccatcctccttcaccctccacacattggccccagtcaggccatagcaaaaccccgggagtacagcagtaacctcccagcgagttcaactgtacttgaggggttctcatggctggctcctgcaccccactgccagccctccagcccgtccgtccgtttgctcagcgtccgctgcctgcccgggaggtgcgcgtgtgcatctatggaagacagccaagggggaggggttgagatagactcaaaagtacccgcacgatcagataagtcagtgttgtaagaggcctgggctgggcgtggtggcttacacctgtcatcctagcactttgggaggctgaggcaggtggatcacttgaggccaggaatcggagaccagcagggccaacacggtgaaagatcggctctacaaaaaatacaaaaattagctgagcgtggtggcgcatacctatagtcccagctactcggaaggctgaggtgggagaatcacctgagtcccggaggcagaggatgcagtgagctgtgattgtgccactgaactccagcctgggtgacagaatatgacctgtctcaaaaaaaaaaaaaaaaaaaaaaggtgagctgtgagggtacagagggaagaagaaggcagtctcttttgtgaaatcaagtgtcttttgtgaagcagtcttcatgggagggaggatatttgagcccagccttcaaggactggtgatgtgtggacatgtgataatgtgggaaaagattgctgagtgtccccttagggagtctggattctctgagctgagagagcttctcctgggccttacaggatcaggaccatgcgcctgggaagaagaatctgttagcaacaaagaggaaggctgcagtcaggaggaattggaggcagggaggccagaaggccagggtggactaccatcacagggcccaaatagctctggggagttcatgtgcgggtggctggggaaaagaagagatacaaacagggattaattgaatggatggggtaactctcctccaggcaagctggtccctcattccctggcaccttgggtcactgctgcctgtacctgtgttctcccttccactgcaaacccagtttgcccaagctccacctccaacagattatttgaactgtcccttcctggtgatctctctcacctaattcatgtattcattcagaagtcatttgattcagcaaacatgtatttataaactgctctgcataggccttaaactaaagacaagactgaatgggtatatccccttttggggacccaagcctgcctcattagggaagctgcaaatgcagtgattaacagcatcagctctggggtcagatgcctagctttggatcctggccccactcctcacctgagtcatgaacttgtgtgagttccctaacttctcttcacttcagtaccttcacttttgaagagagtaccactcacatgagggaaaggagaataataaacccacttcatagaattactgggaacatcagtcatgcaataaatatttactgagtgtcaattatatgttaagcactgcacaatggacgggggatacagcaagctatgcacagttccctgcctttgtgaagctcaccttatagtgagggagagagacagtaagtaaatgagtaaaaacatggatgctggatggtgataaagtaaacatttactagtacagagatgagtaaagcaaagaaaggggtgatggaagtcgttaatacttcagtttagggttttttttgaaattttagaacaattaaaatctttaggacagttgcaaaattagtacagtgaacatttgcgtactttctccttgaatcaccagttaactgtcacattagttttctttgttatttttgccatctgttatttttgccaaaccatttgagagtttcagatctcatgacacctcacctgtaattctttatcatatgtctcataagaacaagagcattctccaacaagtcacagaatcatcataatctggaaatgtggcattgatacaatactgtttcctggtagagaacccagaagccagtcctgcaccacatacttcatttgataatcatgcctttttaaccccctttaacctaaaactgttgcttttttttttttttttttttggtactttaagacatcatcatttttgaagtgtctgggctagttgctttaccgaatgtccctttggatgtggattgcctgcttgtttcctcatgatcagattctggttgtaactctttgtagcaggaatacttcatagctatgttgggtccttctcagtgtgtcacatcaggaagatgtggtctgtttgtcacattattggagatgttaactttgacatttggttaaagtgaagtttaccagatttctccattgtagaggcaccattttacctttgtaagtaataaatgatgtgttaagtgatgttttgaggttgagtgaatatcctgttctccagccattgttcattcagtggttttagtatcctatggtgattcttcccagaatccattatcactaaaatattttattttattttttgagacagggtctcactgtgtcacccaggctggagtacaggggtgctatcacagctaactccagcctcgacctctgaggctcaagcaattctgccacctcagccttctgagtagccaggactacaggtgcatgccaccatgcttggctaatttttttttagtttttgtagaaacagggtttccctatgttgcccagactggtcttaaactcctgggctcaagtgatcctccctccttggcctaccgaagtgttgggattacaggcatgaaccaccacatccagccactaaaatattttcaaatggtaattttcttcccccacccttgtccctttcttctccctccctcccttccttccatccttcctctctcccctcccctccctccctcccctcccctccctttccctcccctccccctcccttcctgtcccttcccttcccttcccttcccttcccttctttccttctttgtttcattgccttttctcttttcttttgagacacagtctcactctgttgcccaggctagagtatagtgacacaattatggctcactgcagccttgatctcccagactcaagcgatcctcccacctcagtttccaaatagctgggactacagggacatgccttcacgtccacctaatttttttgtattttttatagagacggggttttgccatgttgcccaggctggtcttgaactcctgggctcaagcaatcctcccaagtcagtttcccaaagtgtcgggattataggcatgagccacccagcaattttctcttctgtttctctctatatatatatttattagtttacattgttcagtaatggatagcttttgcacacacatcctccctttttttcttttattttagaaggttatgtggactcatggattcttttttaaatatggcattcctgtcatccattttgatgctcggcaaccccacatttgacaagtgggaacaccttcaagcttcagagtccttttgctctgtttgttcctgtttgattttaaacacttccttactttctggcacagaaagatgttctggactcatcttgtagtgttcctgcctcagccttcgaatcattaggttccctggtttcttttagtgagagatggtatttagaaatcaagttctgggtgcaaagtgtgcccacaggtaccagagtcattgcttctcagccttgtcagttttcaaagttaagaaatagagtttttacaaagtcaggagttcaccctgatacttctaacactaataatcttgctgcttagttcttctgcctcttctgctcttccatatttgcatctccttactcccacagtgagaactctgttcttagtagcatcagtatattttcctaatctacattaaaccccaaatcattttacagttgctataccaatctactaccaactacaaacttactaaatacagttaaagatttctttacagttccttttatttttcattacagtctccaacttagcaatggttcgacttaagatttttcaactctacaatgagtttttcaagatataactccataataagaaatatctgtatatcccagtgaatatgcaatactatattcaaaagttacttggattctggccgggtgcagtgactcatgactgtaatcccagcactttgggaggccaaggcgggcggatcacaaggtcaggagattgagaccatcctggctaacgcagtgaaaccctgtctctactaaaacaaaaaattagctgggcatggtggcacacgcctgtaattccagctacctaggaggctgaggcaggagaatggcctgaaccaggaggcagagactgcagtgagccaagattacaacactgcactccagcctgggtgacggagtgagactctgtctcaaaaaaaaaaaacaaaaaaacaaaacaaaacaaaaaaaagttatttggattcttttttttttttctaactacccttcttaaacaaggtaacactctatgtatttttttgtatctcatttttgtcacttaaccatacatctggaaaatcattccctatcacttcatagagatccacctcattctttttcacagctgtacagtccctcatagggtggctatatggtagttcattcagctaccctctgctggttagtattacatagtgtggtcagggagggtctctttaatagggtgacaattgatcatacacttaaggaagtgagagataggccacaaggctatctgggggagtgatattccaggtctactactcaggaccctgagataggcttcaagcgtttaagaaacttcaaggataccattgtggtggagagtggtagaaaatgaagttataaaagtagtcagggttggatcctgtagataaagtttttagggccttttaaatattttggcctttttgctttcagtgactggaaagttttgaaggattttgaacaggagtgaaattatgatgacttggatgtttaaaagaattattctggctgctggatgaatagtctgtagaggagagaaaaggaagagcagggaggttggttaggctgcaggggcaatgcaggaaaggaatcactgggggtgggagatatctggatgtgttttgaaggtggagctggcaggatttggtgtgggcttgcattagtggaatgacatgtggatagggcctggatagtgctgggcaagtagcaagaactcaaaagtatgaacttggctgagagtggtggtgcatgcctgtaatcctagcactgagaggctgaggtgggcagatcttttgagcccaggagttcgagaccatcctaagcaacatgctgaaaccccatgatatggtttggctctgtgttcccacccaaatcttacgttgaattgtaataatccccatatgtcaagggcagggctaggtggagataattgaatcataagggcagtttcccccatactgttctcagatagtgaataagtctcacaatatttgatgattttataaatggggattcccctgcacaagctctctcttgcctactgccatgtaagatgtgccttacttctcctttgcattctgccatgattgtggggcctccctggccaggtggaactgtgagttcattgaacttctttcctttataaattacccagtcttgggtatgtctttattagcagcatgagaatggactaatatagtaaattggtactgggtagtggggcactgctgcaaagatacctgaaaatgtggaagcaactttggaactgggtaacaggcagggattggaatagtttggaagactcagaagaagacaggaagatgtgggaaagtttggaacttcctagagacttgttgaatggctttgaccaaatgctgctcatctcagatggagatgaggaacaattgttgggaactggaataaaggtgactcttaatatgttttagcaaagagactggcagcattttgcctgtgccctaaagatacgtggaactttgaacttgagagaaattatttagggcatctggtggaagaaatttctaagcagcaaagcattcaagaggtggcttggttgctgttaaaagcattcagttttatatgttcacaaagatgtggtttggaattggaacttatgtttaaaaggatagcagggcataaaagttcaaaaaatttgcagcccaatgatgcaatagaaaagaaaaaccccttttctgaggaaaaattcaagccagctgcagaaatttgcattaagtaatgaggagccaaatgttaatcacgaagacaatggggaaaatgtctccagggcatatcagaaaccttcatggcagcccctcctatcacaggcctggaggccttggagggaaaaattgtttcatgggctggacccagggcccccctgctctttgcagcctccaaacatggagccctgcatgccagctgttttagctccagccatggctaaaaggggccaacataccactcaggctgttgcttcagagggtaagccttggtggcttacatgtggtgttgggcctgtggatgcacagaagtcaagaattgaggtttgagaacctctgcctagatttcagaggatgtatggaaatgcctggatgtccaggcagaagtttgctgcaggagtgggaccctcatggagaacctctgctagggcagtgtggaagggaaatgtggagttggagcccccacacagagtccccactggggcaccgcctagtggagctgtgagaagagggccatcatccaccagaccccggaatggtagatccaccgagagcttgcaccgtgtacctggaaaagccacagacacttaatgccagctcatgaaagcagccaggaggatggctgtaccctgcaaagccacaggggaagagctgcccaaggttgtgggagcccatctcttgcgtcacctggatgtgaggcatggagtcaaaggagatcattttggaactttaaggtttaagactgccctattggatttaggacttgcatggggcctgtagcccttttgttttggacaatttctcccatttggaatggatatatttactcagcacctgtacccccattgtatctaggaagtaactaacttgcctttgattttacaggctcataggtggaaggtacttgccttatctccgatgagactttggatttagacttttggattaatgctggaataagttaagattttgagggactgttggaagggcattattgtgttttgaaatgtgaggacatgagatttgggaggggccggggtggaatgatatggtttggctgtgtccccacccaaatctcaccttgaattgtaataatccccgtgtgtcaagggcagggccaggtggagataattgaatcatgagggcagtttcctctatactgttcttgtgatagtgaataagtctcacaagatctgatggtttcataaaggggagttcccctgcacacgctctctcttgcctgccaccattaagacatgactttgcttctcctttgccttctgccatgattgtgaggtttccctggccatgtggaactgtgagtccattgagcctctttccttgataaattacccagtctcatgtatgtcattattagcagtgcgagaatggactaatacaccccatctctacaaaaagttagccaggtgtggtggtgcacgcctgtagtcccagctactcaggaggctgagatgagcctggcaattgcttgagtctgggaatttgaggctgcagtgagccatgatgacacaactgcattccagcctgggtaacagagcaaaaaaataaaaaataaaaaggtaggaactattttattattaacagagtctgtcttattctgctgttgttgacattttacagatcctttattgccaactatctgcataactagattttaagttccttgtatgcagaagtcatgtattattttttaaaattttccttatattgatctgtttttttttaatagtaaagattgttgaatctgaacattagatgacaatgtatttgtccagcatttctccatttgaaattatctcacattattatgtgagacttgttcatgtgctttgctggagttgagacttagacagtctgtgtttttttatttagcaaagataatccaagttaaaatagtgttgtgtgttcctataggaaaactaggcccagtgttataacagagtgtaagtaataatagccactaggaggtaagtacctgctctgtgccaggagctatgcttcagatttgagatgtttttatttaattgtcacactgattttattacatagggaacatttaataggagaacaaagcttaggtaggttcagtaatgtgtccaagttcacacagcaaataagtggcagagtgaacttgaactttgattctctctgaatcagaacctattcctttatatgctctgttgtatccctagcctgagatccactaagcaactttttgaagatgagtactactgatttcttatatccaacatgtatacattgtccaatgaaattctgctaaaacatgggaaatataggtcagcacaattaccagtcatgcaaaattgtatttaatatcataatttgtaatggtgaggggtgcttctttgggacatagaatttacaatggcaatttattgacatatttattattaacattattatatttacattctctaggtacccacatttcactcctagacacttttgcataatctcaataacatcataacatctataaatattaacactaatcctgtaacatcacctaacttttacccgtattcagatttccccacttgtcacaagagtgtcttttgttaaaaaacccggatctaatcaagtttcactcattgtattcgttgctatgtttttttgttttaattttgatgggcatctttcagaagttttaaaatagtcttagaacctctttttaagaaccagatttgaataatttattttattgacctccttgtcactctaacatttctttagtaaatacaggctttgagggtaggtattggtttctctgtttaaaagtagaaactttgcataaatcagcccttatatgtgtaagttttctgccttttggtttcttctcatgctgtttctgcacaagtgcctaagcttttttgaagctttacttgaggggtgaccagaaggttttacttaaggacacagacccttaaattctgcaatgacaaatctcaacttccatctcagggttgtaagtgaaaccaggatgcagccgtttctcttttctcagataagttcaggtttgaatataaagtgtgactataagatacagagactgtccctagaaaaggaggggaaaacattttagcagttcctctttggagataactttcagtgcctgcccatcagcctccaaggaaaatgctttttggttactttataggttctagtgaactttgcttactttacaatgttccccaaaatgtctgttgagattagtgcctgaatttccactgggctgaccagtctgtagtttcttgaacattttcttcctatgccagttaaaaattagaagaaaattgaagtttaacatacacattcagaaaaaaataaaaaatcagattaataagaaactaatgaggctgtgccattgtaaactacttgcaatagagtttcccaacgatgaactgagtatctagaaaataacaaggattctcaaggaattttagtgaaatgatcagtactgtattgaaataccttgaatcagactttggagaatagatttaaaaacactcacagccttaaccgatctagtaagaaccttattccctaaagcatactgtggatctcagctgtatcctatctaaggtgagaacagtcaaagacaaatgtggcctttgagaaaggtgggatgtgagtgtcttgaaacaacaggctaaagaagtgctctcaaatagaagtataatatggaacatgtgaaattaattttaataatatattttagttaacctaatatatccataatattttcatttcgacatgtattaggttggtgcaaaagttattgtggtttttgctatttttttttaatggcaaaaaccggcaattacttttgcactaacctagtagttactacaaaaaaatattaacaagagattttatgttccactttttaataccaggtcttcagattctggtgtgtatttgatactcagaacacatctccatttgaactaaccatatttcaggttctcactagccacttgtagctggtagctactttgatggattgcataggtctaaagggaaacatcttgagaaagaagaaataggttaagtgcaagaacaagaattaaaaaggaaactattttagcatcatattagaaggaaagtacagaaagaagttgatttagagaaccaacatcttaattcttgatgaacttatcgaggaggcagattgacagctgagagcaaggtccgggaaccttgctctggccttggggaccgagggtttgtaaccgttgggagacaggtggctgcagtttcagtatgaagtagatgagggcagggaaactggtggtggtgtggctgaaatcagtaaatctctgtcttaaggaaataagagaagtcactaactgggaccggctaagggtggaatcgatcaggaaaaaagaggaatggccccaaccaaggcatctgatgttctggccaacagtgcaggctctggggccgactgcctgtgtctggacaccagctctgccccttgctagctgagtgaatgcagtcagctgaccctctcagtccatttcttcatctgtagcctggtgcttcggaatctttgaccttctctatcaaccaagtgtccagcggagcaaaccaccttactttgataggcgtgttctcaagaaataactcctttctcactctcaccccagatgttcttaggctcgctcccctgcttttctggactctgctcagatgccaacttatgactgccccccatgccatccaactcctttccttaccagtactcctcagcccccacactctgctttatttttctctatagcacttaacatcatccaacatcatccaaataaaagatatttactttttcatttattatgttcttccctccactgaaaaatagactccaagagggctgggattttgtctgttttgttcattgctatatcctgcctgcttatttcagtgtctggcacataggcaggactccatgaacatttgatgaacaaataaatgaataataagaactacctcagagttgagttgaggattaaatgagttaatacacaaacagctcttggaacaagtgcttgtcacatagtaagcctgcagtgaatcttcgtgctgctgctactgttaaatattattactgaggctgagctggcctagggctccttggattggacttgctaagagctaggcaagagtcacaactgtatgaaacttgattgagttaaaacaaacagtgctactcctctttattatctccatgcctggtaagcacattttctacccccaaaattgggactgactaatatgagaatatttatggccttaataggacaggttatttgatacaattactagcctagacattttaggagattggccgctcctcaatactataaatgcatatatgggtgtgtagatagagatgttgcttcccagattgccacacatcctgatactgcaagtaggcatcaactgaaaatgtgccgtgatgtgaagaccaaacgcagagaagtgagagggacaaggctgtgctcagtgacccatatccagatgagaaatccatctgctcacttgggagcaaaaatgccccaagaccctgctatctctgggcttgcacgaggctttaaatgaatcaccattatgatgtcttatattcagagggaaataccaatattcatatattcaggtactgaaacttttaagggaatttttcttttttctttcttttttttttttttttggtcaaatgaacttttactttacctgctaaaatctgcaggcagtgtgagccttaaaatattttagagagagagagagaagtatcttaaaattacattgtttatttctaagaacaaactcaagaaaaccctttccttcaaatcccggaagagtgattagcttgtctctaaggtatggcattggctgggcatggtggctcatgcttgtaatctcagcacttcagaaggcccagggaggaggatcacttgagcccacgagtttgagatcagcctgagcaacatagtgagaccttgtttctacaaaaaatataaaaattagctgggcgtggtggcatgcaactgtagttctagctacttgggaggctgaggcagaaggatcacttgagcccaggaggttgaagctacagtgagccacgattgcaccactgcacaccaacctgggtgacagaatgagaccctgtctccaaaaagaaaaaggaaggaaggaaggaaggggagggaaggagggagagagagagggaaagaaagagaaaaataaaaagaaagaaaagaaagaaatgacatcagtgaacctcctcaaaccatagcgaggctgttaagtttgattggggctgacatccatgagtgggtacaagtttatctggtgtggtgccctgcatcctataacacttagttggtaaaatctacttaaacttgagagggaacatctcaaaagggacagctgtggagttgggaaggtggagcccgcaggtcctcccatcttgctttggtgatgaggcagaaagtggggctgaaaaactgagtctgttttggttgtatatgagggctcctgagccattttatttttaagctccagttaaacttctttctccatctctccttacgaagtcctccttcttcagccaggttccacagcaatttgggatttcacaaagcccagggtttggggtgactgtcaaattttgctattctgtcaggaagccttatcttttgaactacatttaagttgtattttaatcattttagttaattcattcaacagatatttattgaaagtccatatgccagacatatggggatacagccaaaaacaggaacacctttgtccttgtcctgatagggctagcctggctggggttacccctaagctcagatttgaattagttgccaactttcaagaacaggaattttcacacaaaatgtgaatatctggctttttttgaaaaattgggaacctggcaatggtgggcctctgtttccacatggcaggagctgaggcacagctcctgtttccacatggcaggcccctccctgtaggctcactggtgcgcaagtcctcaccagtcccttctgactcacacttggcccgctggtatctcctctgtgggtggaattgctggtcttcgtctaatgcgtcatttgccacagttctgtttctttgtgactcctttgtttgctcgttttctttttattgtttctggtctggctttttcttccttgactggagtcttgctctctgaggccctcttcagctctagcattcgatgatttggaaaccacagagcttagtgcctcacctgtaggtttggaggtgtgcttaactcagtttgactttctcatttgcaacatctgctgttccaatgctgtctatagattgtatcctgagaaaccctgcatcatgtcactatctttaagagccttatgccatgtagcaagctaaataagaaacaatggttaagagcactgattctgcagtcagattgtccaggttcaaatctggcttcattgcttaactagcaagtcacttaacattgttgtgcctcagtttcctcacctgcaaaataataaggttagaaataaaaccttcttaatatgtttttaggattctgattttttttttttttttttttttttttctgagatggagtcttgctctgtcacccaggctggagtgcagtggcacagtcttggccactgcaacctccacctcccgggttcaagcgattctcctgcctcagcctcccatgtaactgggattacaggcgagtgccaccacgcccagctaattttgtatttttagtagagacggggtttcaccatgttggccaggctggtctggaactcctgacctcaagtgatccacctgccttggcctcccaaagtgctgggattacaggcatgagccactgctcccagtggtgagtacctatttatagagcccttgcaacagtgcctggcacagagccagggccatacaagtgttagattaagtaaaaaaaaaaagtaccagtcaatctgaatctcaggccctgagtaataatttgcagaggaatttgtgctgggggttgagagttccttttcattaacccatagttaacggtgaccagattttctaaataagaaatcaggatacttcatctataaaacttgggttccagttacaacttcaggccatacaaaaagaactattaaaattgaggtgttgatgttttgtagaaacactgcaacagaatatttgagatcagacctgtttttagatatgtgatcactctatacatgtagtgctgattaggtattaggtaccctcatatctttatttaaaaaaaattcaaaattcttcaaaacaaaaaaaccttcaaaaattatctggctagcatagaaaatctttttaggcgatcactgataaaattttttccctccctccatctctctttgcttttaaacagcaaaaactcaccccatgcccagttctcacccagttaattcagacagtgtgaataccttgatgttgacctaactcattaaaagaaaaagagagaaaacctttgaaagcctattccatgtcaaccagtgtaaaaagactctcaattttattcaaacctgaaaacaatcttttatggtgggcattatgatttctacttcacagctgaggagatctagtgtggggaggcctttgggagttcaccctgggccttgctggcttcaaaatctgggcactctctgttctgcactctggcatggttattagcgtccctacagtcccttttctgaccactcagtggtatcagcaaagcaacaaactcactgttgacaccattcctttgctcctatttgtgtattcattcattcattcattcattcgttcatccatggtttgtgacctttgagaaaaaactcactcccctttcttctattgttcttttgttcattagaaattatcttagcaacttactttagtgttggccttggaagtgcaacagaaaagactttactgtaggaaggaaataatagatatacccatgcacacaaagtagaggtagatattagttttagagacagttcttaacaactcctcctcttggttgaataattctatttaaaaaaaatttacatagttttaatattataatagtaataggatatttgtcttcaaaagtaacatatttttcaatgtgacctgtattaagtaataagtaataaattgaaatctcaccatcaccacaatctctaaagtaaccgtggttactttaaaaacaaccactgttaatcatttagggtgtctctttccagtctaaaaaaagagcaagtgagaatgcatgtacacatgtattcatgtctttttatagttaaaatatatatatattttttggtagagacagggtctcactacattgcccaggctggtatcaaactcctgggctcaagtgatccttccactttggcctaccaaagtgctagaattgtaggcatgagccaccacatctggcctctttattgtttttaaaaagaggaatattctgcatatatatttctataactttttatttttaatattaagaaattttccaaattcccaataataaaaggagaatatcctgtttccttttttaaaataaccacatagtaagccatggcataatactaaattgtttaactattagactagattattatttactagtatagataactttaaaatgaatatcattatgcatatctctttatgtaggttatactattgttttatttgttaacatcctgaataaatatcacccagatcccagtattcagtgaaactacaggttcttttagagcataagcaaaaataaattgtatgcatgtgtttttgtatgtgtgtttaattctgcttacatttgaattttcttccatctttttcctactatctgagtaatatcactagtgccttttattcagtcaagtctccacatgttgactcttgtcttggagttatgatgccatccccctcctggcctttcttctacttcccaggtctctctcagtctccttagccagtgttttcccctctagccaagctttaaagcacaggtccaagctgccttttcccacttcatacgctctcccaaggtgatggtcctaatggcctccattggagccactagaaatgtgatgactcccaaatctgtatcctttcctgtgagtcccagacctgtgtacttagcagctactgggcatctttgcttggatgtctcacagacccctcacactgaacagtgtcaaactgaaagcatgatgttccaggccagtcttagtcttcctgctgtgtttcctttcttagggaaagacaccacaacccacctaggaggaagtaagagctgtgattcatcctggccctcctggcacctcctctcctcctcctttaccccatatgctgtcaatcatctagttctcccagttttacctccctaatgtctcttgaaccactttgcctagcacaatgctgcctcttgaccagtctgaaattgctgtctgatggatctcttgctatctagtcttacccctcccatcagtcttccacaccatagccagaaaagataaacactttcattatgtaaaaatatagaaactttgtatggaagatattcatttagtaaattcaataggcaaaggctgtatttgaaaaaaaactataatacagataaaaatatataacatataaggagcctttaaactttgagaagaaaaaaacaaacaatctaatacaaaaaaagaggatgtgaaaagacatttctcagaaaaagaaatccaaatcaacaagcagaagagatgcttaaatttttaaaggttgggaaaatgcaaattcaagtatcaatgaaatgtcactatttgcccaaaaattaaacataaaaaaaaaattacctaatgctgtcaggagtccaaggaaagggcaactcaggcattactgatggagatgtaaattgccaaagtcttttttgtaaacaatgcagcaacttctattaaaataaaaaaaatctatttaccttttgatgtagcaactcccagctccactctactcccacataaatatgaaaccataaatacatcaggacatatgtacaggatagttattgcggtgtaactgcaatagacaaagctagccacaaaaggagtgttcatcagtggtggatggcagattaattatggttccctcatgctctggaatattatgtagttattaaaaagaataaagtatagctataccagttgatttcaaggagattttatgacatattaatggaaaggcgggatgtagagaagtgtgcataagaccatttttattaaagaatggtaaatccctcaggcacacctccttttattgcatttcactttattgcacttcacagataatgtgctttttacaaattgaaggttcgtgacaacccagctttaagcaagtccatcagtgcctaactttatgttttgtctctctgttacattttagtaattcccacaatatttaacgctttttcattatcatatctgttatggtgatctgtgatcagtgatctttgatgttactgttgtcattgttttgggatgccaagaaccatgcgtataagacggtgaacttaattgataaatgctatgtgtgttctgactgctccactgactggctgttctccccatctttctccttctcctggcctcccttgtcacctgagacaatgatactgaaattaggccaatttaataaccctgcaatggcttctaagtgctcaagtgaaaagaagagttgcactgtctctcactttaaattaaaaactagaaatgattaagcttagtgaggaaggcatgtgaaaagccatgacaggtggccgggcgtggtggctcacaactgtaatcccagcactttgggaggccaaggtgggtggatcacctgaggtcagaagtttgagaccaacctggccaacatggcgaaaccccgtctctactaaaaatacaaaaattagctgggtgtggtggtgggcacctgtaatcccagctggttgggaggctgaggcaggagaatcgcttgaacctgaaaggcagatgttgcagtgagccaagatggcactattgcactccagtctgggctacaagaatgaaactctgtctgaagaaaaaaaaaaaaaaagaaagaaagaaaaaaaaaaagccacgatgggctgaaaactaggccttttatgccaaagagttagtgaagttgtgaattcaaaggaaaagttcttgaaggaaattaaaagtgctacttcagtgaacacataaataagaaagtgaaacagcgttattgcagatggagaaagttcgagtagtctgcatagaagatcaagccagctacaacattcccttaatccaaagcctaatccagagcaagaccctaactctctttagttctgtgaaggctgagagaggtgagaaagctgcaggagaaaagtttgaagctatcagaggttagttcatgagatcttaggaagaaagccatctccataacataaaactgtgaagtaaagcagcaagtgttgatgtagaagctgcaagaaattatccagaagatctaagattactggtgcaggatacatgaaacaacagattttcaatgtagacaaaacaaccttctactggaagaagatgccatctaggacttccatagctagacaggagaagtcaacttcaggcttgaaaggacagctgactctcttgttgtgtgggctaatgcagctgatgactttaagttgaagccagtgctcatttaccactctgaaaatttttagggcccttaagaattaggctaaatctattctgcttgtgctctataaaatggaacaacaggctggatgacagcacatctgtttacagcatggtttactgaatattgtaagcccactgttaatacttactgcttagaaaaaaaagattcatttcagtatattattgcttgttgacaatgcacctaatcacccaagagctctgatggagatgtacaaggagatgagtgttgttttcatgcttgctaatacaacatccattctgcagcccatggatcaaggagtaattttgcctttgaagtcttattatgtaggaatacacttggtaaggctatagctgccatagataattattcttctgatgaatctgggcaaagtaaattgacaaccttctgaaaggattcagcattctagatgtcattaagaatatttgtggttcatgggagaagatcaaaatatcaacattaacaggagtttggaagaatttgattccaatcgtcaggtcaaaatatcaatattaacaggagtttggaagaatttgattccgatcctcatggatgactttgaagggtggaaatagcaagaaaaatagaagtggagcctgaatatgtcactcagttgccacaatctcatgatgaaaattgagccaatgaggagttgcttcttatggatgagcaaagaaagtggtttcttcagatggcatctatactcctggtgaagatgctgtgaacattgtttaaatgacaacaaagggttaagagtattacataaatttagttgataaagcagcagcaggatttgagaaaatttactctaattttgaaagcagttttactgtgagtaaaattctatcaaacagcattggatgcctctgagaaatattttgtgaaaggaagggtccattgatgcagcaaaactcatcattgtcttcttttaagaaattgccacagccattgcagcctttagcaaccaacaccctgatcagtcagcagccatcaacattgaggcaagacctttcaccagcaaaaatattaggacttgctgaaggctcaaatgattgttagcatgttttttttttcagcaataaagtattttttaattaaatatgtacattgtgtttttagacataatgctattgaacactttaatagactacagtatagtgtaaacataacatttatatgccctgggaaaccagaaaatttgtgtgacacactttactctgatatttacatgattgctgttgtctgggaccaaacccacggtatcttcaagctatacctgtgtgtatccattatatgtgatacatgtttgtatctatttgactatatgagagaaaaatattgaaagatgtattctgatttgttaatgtagattatagaactggagattgttatggggttaagagagtgggtaaggcacccagataagaggactgaaaaaatacttatatgatcgtttttcattagtgtaaagttgtatgtatgtgtctatgtataatttatgttttaaaatacattttttaaagaaagagttactcttattttgtccccatcctgtttgaaactcttctatggctttctttacttcaatactagaattgtgtttgtttgatgccttgcaagggctggctgtgcttgtgtatgcagctcggcttatgctacttttctcatgccattgctcctgcttcaaggtctgcataattgttctcttaatggggacctgccctgctctcctgggcatagttaactgctgcttgtgcctcagaacttcttttagggaagggaactgccttccctaaccccttgttagttccctaagtaaatgttcttattgacacctgatgcttttacttagcagcaattatcacagttgcagttgggcattgtctaattatttgtgtaaattctgcctcccctaatagaatgtcaactctaagaaggaagggacggtgtctgtcttgttctcaaggatcttatatagaatagatgcccaatgaatatttcctgagtgaatgaataaatgaatcccatcctgaatgtgggaccacgctgttctgaaagggcactgaccaaggagtcagacaatgtgtgttctggtcattgtgccgccataaacttgctgagagacatggagcaaggtgatatgcctcttggagcctgctttcctacctgtaaatggggttaataacacctactgcaggtagacatggagagggataaaaaggaatacaagacaatgtgaacatataaccagcagagagtaagcattcaataaaattgccttatatttttcttggtgtcttgtcacttcaccagtgaaatgggagtaatttgactaaataatttttagagtttcttctagttcaaaattatagttgacccttgaacaacatggcaattaggggcaccaaccccttgagcagtcaaaaatttatgtataactcttgactcccaaaaacttaactgctaatagcctaccagaagccttaccaataacataaacaacacatattttctatgttatatgcattgcatgttgtattcttacactaaattaagctagagaaaagaacttattaggaaaagcataaggtgtagaagaatgaaactggatcctcatctttcaccttatataaaaatcaactcaaggtggatcaaaaacttaaatctaagacctgaagccataaaaattctagaagataacatcagaaaaactcttctagactttggcttaggcaaaaaggtcatgaccaagaacccaaaaacaaatgcaacaaaaacaaagataaatagatggggcttaaattaaaaagcttctgtacagcaatataaacaatcagcagagtaaacacacaacccacaaagtgggagaaaatattcacaaactatgtatctgacaaaggaccaatatccagaatctataaggaagtcaaacaaatcagcaagaaaaaagcaaacaatcccatcaaaaagtgggccaaggacatgaatagacagttctcaaaggaggatatacaaatggccaacaaacatatgaaaaaatgctcaacattactaattatcagggaaatgcaaattgaaaccacaatgcaataccaccttactcctgcaagaatggccgtaatttaaaaatcaaaaaataatagatgttggcatgggtgtggtgggaaaagggaacacctgtacactgctggtgggaatgtaaactagtacaaccactatggagatttcttaagcaactaaaagtagaactaccatttgatccagcaatcccattactgggtatctacccagaggaaaacaagtcattttatgaaaaagacaacacacaacatgttgcacacaacatctttatagtggcacaactcgcaattgcaaaaatatggaatcagcataaatgcccatcaatcaatgagtggataaagaaaatgtgggagatatatatatatatgaatatgccataaaaaggaacataataggccaggcgcggtggctcgtgtctgtaatcccagcactttgggaggccaaggcgggcagatcacgaggtcaggagatcgagaccatcctggctaacatggtgaaaccccgtctttactaaaaatacaaaaaaaaaattagccgggcatggtggtgggcgcctgtagtcccagctactcaggaggctgaggcaggagaatggcgtgagcctgggaggtggaacttttagtgagccgagatcacgccactgcactccagcctggggacagagcgagactctgtctcaaaagaaaaaaaaaaaaaaaagaacaaaataatggcattcacagcaacctggatggaactggagaccattattctaagtgaagtaactcaggaatggaaaaccaaacatatgttctaacttacaagtgggagctaagctatgtaagaatgatacagtgaactttggggacttgtggagaagggtgggatggggatgagggataaaagactacacactgggtacagtgtacaccagaatctcagaaatcacacccaaataactaaaaaaaaaaaaaaaacttatccatgtaaccaaacatcacctgttcccccaaaactattgagataatagtaataaaaaaatttaaaaaagaaaaaaaagcataaggaagaaaatatacttactaagtgaaagtggatcatcaaaggtcttcatcctcattatcttcacgttaaagcaggctaagtgggaggaggggttggtcttgctatctcagggatggcagaggcggaagaaaatccacatgtaagtggacccacacagctcaaacccatgttgttcaagggtcaactgtactttgatttcttctgagctgcagtctcccctttctctaccctcacttccctccaccactagctccattcctgactactttcttctactgttctcaagcccaggatacatcagctctccctgggaaagacaaaagacatcttcatgccgccagggtatggcagtttatctcatacctactctttcaccaccaccctgccctctatcactcattgtttcatttacatttataagacatttttgagtttccactattgtgtgtggtagactctcaccccttgaattctgtactttttcttgtgccttcccacatactctgttgagtggaggaaataatgcataatcggcaaagcaatggaaagatgctggtgtgtttttgagggcagttccccttaattaagggagatgggttctaaaaagtccttgtagataaacaaatgggtgatatttgcttcttatctgaaattactaacacagttgtctacaactggtcattcagtgttcttgatttcccctgtattatttcaattaccctaattgctactaggcaaaaacttcagtcaaattttaattgctctttaatgttaacttaaaatagctgcagttttttgtttgtttgttgagacaggtcatgctctgtcacccaggctggagtgcagtggcacaatcatggctgactgcaatctctgcctcatggcttcaagtaatcctcttcagcctcccaagtagctggggaccacaggtgtgtgccatgcccagctaattttttgtacttttcgtaaagatggggtttcgccattttacccaggttggtcttgaactcctgaactcaagcaatccaaccaccttggcctcccaaaatgctggacttacaggcatgaaccacaggacccagctgctgttctctcttaacaagagacaagtcctagagcaagatgcatttaaacccactttggggtatcaaaaatatcccaatcttgtggttctaataaatgtttaacaactaggttggtatggaggttctgatgtgaagcattagtcagtttctgtgctgttactagatgttccctaatagggctgggcagagatgctaacaattggctcatgagggcaggtggacctggctccaacccaccactgcacccaatccctgagttcttaatcttcatcacaccctcgacttgcttcccagccattgtttctgatctcagttaatgatgcctctcagtcagccaaggagacctgacagtcccatccacttcccccaccctcatcactgaatcctgttgacttctctctccagcatctcctgagtctgtccgcttgtctgtccccactacaaacaccctgctctggtctgtcctgtccatggacttcattgctacagcattgactttcattataatttccctgcctctgtgctggcccctgtcagccgctctctactctaaagacagtcagcctgctgacacttaaattatgttaggccagtcttgttaaaaacctttctgtggcttcctctccattaggatcagtccaaacccttagcgttccttactttagcacacataggctgtgggctggcctttgtctgtcttgttccccaccagccaccccttgccctcctcattctagctgttaggaatcacgtgtgtatcctcaagcacaccatgctctttctccattcagggccttcctttgggggtgctgcttcctatatatctgtatgatcatctcttcttccactccccacccactcacctacccagccctgcggcctaactgccttttatccttcagtgatttgcacgttatgtcagttccagcatgacttccttggggaggccctagaccaggcagctcccctcatgcagcccctgatgtagagcctgctccctgtcttctccacacgtgaggctcctggagggcctggaacaaccccatattcccagcccagcccgtactacctggcagatggttggtgctccatgaatgtcgggtccatttcttggatttatgcaggtcccagttttctattaaagagtaagctccacatggtcaaacatgttcttacttcctgtattttgtgtcagcagtttgtcagcttagcacaaaaagtacctgatgaataatttctgccaccaaagtcatgttgttttttctaaccaatttttttttctctcctaggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttggtgagtattccataagttgatttgtttaaaatggcaaatttccatttttttagtctgttttcagagactagcacaaattaatggtctatgagaaaagaattagatgttacctgttgtcagggttttctccttttctggtatagaggagctagctactttcaattcctttgtcattcctctgggtgaggagagaatctaaccaaggtggggagaacagtatcagttgtcttactaggaatgttttggaaagagatgtagtgacagcagttagcttagaactctttgggctccactgatagatgttactctataaagttcctgcttccccacacagcggggagattgtttttcctcctgcaccattttatttaattaatttatttattttgagaaggagtctcactctgttaccaaggccagagtgcagtggcacaatcttggctgactgcaacctctgcctcccaggttcaaagtgattttactgtctcagcctcccaagtagctgggactacaggcccgcaccaccatgcccagctaatttttgtattttagtagagatggtgtttcactgtgttggccaggctggtctcaaactcctgagctcaggtgatccacccgcctcagcctcccaaagtgctgggattacactcatgagccaccacacccagctcctgcaccattttaaactgaaactagagagaggggacacatttctccctgcttctcactgacactcctccctggtctctaaagccccttttgtgttgcagtcttgtataggcccctgcctcacatgccagtgtttcttggtcattttaaggcctgcctcattttcattgtttctgacattcctggtgtcttggtggttgcaatatttaaattaaaattctttcaatattgtccttgatcgcctctcctgtaaggatcttttcctctacgttacccactacccatggatgtaaccgagaactcatcattacctcaatgtcaggtgtctcactctgaccaccatgccctgtccttgatgatgctgatgctgacagtccttcacacacctgatgtccctgctgccctccctactcagcctgagtgctgttgtcactcactagactcagtccgttgcagacacacttagcttccttgctcctttgctggcttgtcatactcgcatggccagattacagctagattaagtccgctgctttgcctattctgtgctcacacccatgtggttgcagaaaaatacaccaccctacaaagtcctgcacttttaatttctctaatcacttacctcaattaagttggtatttcctagcctgttcacttacccactctcctagcagttactttttctctcctcaaatcttgaatacctccttctctagactgactcttcagctgaaggctttgcttcttatttcactaaggagaataagcaatcagagggcaatttccacaagctctcaccacctgcctaccttcctacccatacctgagcctgtaggccctgctttctctcctgatatgaatggactttctgagttctcacctgaagttaaactttccacgtgtgccctggatcccacctcctcttgccgtcctcgggaatatcaccctagtgcttctacccactctctcctgatgagaatttcccccataagttgatggttcattttaagtggcatacatatatactgtcattaaaactttctcatgatccctgtacccctccagccaccaccacctgctgtcttcactttatagaaaatctccttgaagaagttgtccatattcacttattctgatcccttatattcacttttaacccactccaaataggctttcatctgcactgctatgccaaaactcctctagacctccttgttaataaatccagtggttcattctcagtccatgtcattcttgacttctcagcagcttttgacatagctgatcactccctcctccaagtactgtcttcacttgacatccaggataccaccctattcatgtttctttctcttttttccttgagagggggtttcgcccttgttgcccaggctggaatgcaatggcgcgatctcagctcactgcaacctatgcctcccgggttcaagtgaatcttctgcctcagcctcctgaacagttgagattacaggcatgcaccaccatgcctggctaattttgtatttttagtagagatggggtttcaccatgttggtcaggctggtcttgaactcctgacctcaggtgatccacctgccttggcctcccaaagtgttgggattacaggtgtgagccactgtgcctggcttcacatttctttctaacacactgactattccttttcagcttcttttgctagtttccttgtttccccaacctcttaacactggaaacatcaaggcttaagccttaggtctctttccttttctgtctgcgttcatagccagtgggtgagctcatcccatgtcagggctttaaatatcatctcaatgctaataatgtacagatctagagctctagcccagagtaccccgccgagctccttatgtgtatacctgactgcccagtgtacctctccagtcagacatctaattggcctttcaaatatcacaagtccaaaagtaagctcattatcttccccttaaaacctgctgctcctccccaaatcttttcccttttggttaatggcagccccatcctttcagctggtcagtctgaaaccgggatgtcatccttgatacctctctttttcttgaataccacattcactctaccaggaagttgtattggttctaccagaatgatctttttaaaacagaagtcagatcatgtcactcatctgtgtggaactttctaatggccccatctaactctgttaaagctaaaatgtgtaaagcgacttgcaaggctatgtgaggtctgacccctgtggactctatttagacaaatacagcttgctaagatgtcaaagtatcctcttagaagatttccttgaaaaagtagaatctttgaaacatggacattggggatctgataatttatagatagggccaacaaacaagaggattgagtcagaatttagatcacacattttaagagccctttttatagagtttgtaaaactaattcaaaacatttgaataaatttctcctcttaaacttgatgaactgttttaaaataatttaaaatattctaggccgggcattgtggctcaaggctataatcccagcactttgtgaggctgaggagggagggttgcttaagcccagtagttcaagaccatcctaggcaacatagcaagactccatctctacaaaaataaaataattaaccaggcatggtggtgcatgcctgtagtcccagctactcaagaggctgaggtgggaggatcccttgagcccaggaggctgaggctgcagtgagccatgattgcacctctgcactccagtctgggtgacagaccaagaccctgcctcaaaataactagctaaataaattaattaaataaaatattctatggcacctcagcaaaggtatggttttgttagtcagaccaactggatagaccttaggaagcctgcagaggagtaaagtacaggggaggtgagttttgatcaggaggcagtgatattgatagtattgagtgtgggacttaaagtcctggtttgagagtctggacatcagcttgtagcagtggggagccattgtgtcctatactggagcaaggaagtgacttgataaaatacatttttggaagattaatgtgatggtgcatacttatgatggattaaagagaggagatgtcaagttagaagctactatcatccaggtagatagagggtccaagaaagagtctgcaagatgtaggttttggttgtaaaaagacataagatgactctaggtttcacatctgcatgataaaatgattggtcatactatttttttttttttttaagaaaagaggaagtcatacttccttgaggtaatgttaacacttgttttagtaacctggtaatcttctagagacaccagacctaataggagacttccagtgagcatattttggacagggggatttcctggcacttcctaaattcagggcatccacttccttctgtgtgtacattgagatctggctttcctccatacccaaaagtccccttaaaatttctacttctgaggtttattagtcctttcccatctttttatggaccttcatcacatctcagatgatgatttttatgtaagtagaattaactgccctgtccttaactgggctggattgatacttgacctttactaaaattcgtgaaaatatacacatatttctataaaatgtcatcagatatgtgtaagaaattctcattttttacacagcagtgaactcaattcattaattataaattgactaattgtcttagggaggaagtaggcacatttcttgccagtttaatgctgcttaaagtagaggtataacgaatatttgttagatacagctgtggtaagtcccacgggcagcaagaaaatatgaaagatttatagaaggaaaagatctgaggtgtagaaactgtgatctaggtgctgcagaaaggcttgcacacttttagatgagttggataggcacttctacctttgccatctggcaactgttgtgtaatgagatagccagaaagagcttctacctagtcaagggagttctagcaacttagaagataatactaacacttcttcatgtttcccctgaaattactttcatattctgttttttttcttttcttttcttttcttttcttttttacaaaccctgcatgtggcactcagtcatattctgtttgacctttacagtgacctgatacagcattccctttcacagatgaaaataagacagtttaggagtccgtttctctgtaagtagaacaagagacctggatggatgctttcttaaaactcttccagctcctaaaaggactgtggccccaggtcacacagcaggccaaggctaaggcttgatcaaacctcccaactcctactcagtgactcttctcatcatatcacataccctccggggagcctcggcttcctggagttggaaactcacagccaatggccgtgtgctctattacagctagcatttgttaagtacttactctgtgcaggcactacatgttaattcatatgttgattattatctgtgttaactcatttaatctcattacagtctgatagagtaagtactatttgtgtccttattgtagagaggaggaaacctagacacaaggtgatttaagtaacttgcccaatgtcaaatggctcttagtcatgaagctgggatatgcactcaggcagctgggcttctgagtccatgctaaacaccatactgtacctctttggagatagcgggtagaagaatttacattttatttgaagactgtctctctgaatctatccttctatccatctgtctccccatctgtcctgtactgcttgtgaggagccatctgtgtgccttgcattatgtcatgtgctgtggttgaaaggtgagtcatacctagtctttgccctccaaagatacacagtctctggggctgatgatgcacctctgttcagttcagaaagtgctggatgaaagactagacattggcagagctagatcaatacattagaatctgcaacagaacaaacaggccacatacatcagaagcacctgggatggtggggctcaggaatctgtatttttaacaagcacccttggtgattcttaggcaccttaaaatttgagaaatgcttcaaaggaccatttctaaggaggtagaaagcttggttttctgcccctgagaaatgcccagcctagttacagaggcaggcataagtatatgaaatactgagaacaggcatttttgaactattctggggatgcatgttccttggaagtcccctgagggctgctatggggtggggtgggcaaaagggaccagaggaagttaggagagcagggctctaggctttcaattttgagtcaactagagcaacttcttatccattggattggattgccactgaagatttaattctgagaaattccactgcttaaaagatgattaaaagtctttttaattaaagaaaatcttaaggaagtatgtaaggacttgtgtgagctagattaaacttaaaaactaggaagccccaagtagaaagggaagtcagtgtgtgactctggtttctaccaaggcaggctgggtactttatttaactgagcgagaaggaattcaggaggaggagaagatgggggaaccattaaatgcttttatttttcagattataattggagcataagcattaacttgtcttagaaaacatcattttaaatgacaacatagtattccattatcttggtgaacctaaatttacttaaatgctctttttagtagacgtttataatgtatcaatactttattatcccagtgctaccatgaccattgttgtatattacatatgtttttgcatgtttcctcaggcctcttatgattaattgctggagggtagctgagacgcaagaaggcatatgaattaacaaataaatgactcataggacaaagtaattagccttgaggcttttaaagggcaacaatggcagaatgtgacatgttagtgtcttaactcatccttgtaggtccatgctgccttagccaataggaggcacttcctagaagaagggtgggagtgaggcctctggacaggcaggtctgtgacacatgctgctccctgcactgcctattaacaggtccagcccaaccaataggcagggcccgacaaggctctgtgtagctccacctttcacaaaatgtattgagtcagatgtattatggactttcctttcacaaaatgctttgagtcagacgtgttatggaattaaaatttttttttacattttggaaaggtaatacaaagtatttcctctgcatattaagcaccccacttaattatggggagcaccctatgggtcaagcataggaacaagtatttacttcattcctatatatttaaagacaaggtctcagtctgatgcaatcatagcccactgtgtgtagtgagctagagtgcactggcacaattataactcactgtagcttcagattccttggttcaagcagttgcaagtagctgagactacaggcaggagccatcatggctggctaatctttaaactttttataaagacagggtcttgctatgttgcccaggctggtcttgaactcctggcctcaagccatcctcctgcctcagcctcccaaagtgctgggagtatagccatgagccactgtgtcctgccaagcacaggaatatttttgtggtgaaacgataatgaatatttgaagtgagtgagaaagactcaaatccttgtgttaattcaggtcaggtcaggatttgcagctaaacgattttgctaccaacttgcgaagactcttttggcttcagagattttttgatttaagaattgaggataagggatttggggcctgtattggtctgttttcacactgctataaagaactacctgaaactgggtaatttataaagaaaagaggtttaattgactcacagttccacatggctggggaggcctcgggaaacttacaatcatggcagaaggcgaaggagaagcaagcacttttttcacaaggcagcaggagagagagagaactgccacacacttttaaaccaacagatgtcatgagaactcactctctatcactagaatagcatggggaaaccatcccccatggtacaatcacctcccaccaggtccctctctcgacacatgggaattacaattcaagatgagatttgggtgaggacccagagccaaaccatatcagggtctgaatttattctgttaaatttgaacaggtagatctgacctagcaaaagaaagaattctcgctccttgatgctcaaggagtttgtctgctcatcctttcaagcttgtaaggaggttgcgagctcttcataaatttgcagatgataagtctaaatattactattttctgtactaaatattatacttttttttccagagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtgagtaaataactaaatgtgtcatggaggctttcagaccacagatgtggtgactaacacaaggttcacaattttgaaatgtaaaacaagttacaattttttttttttttttttttttttttttgagacagagtctcgctctgtcgcccaggctggagtgcagtggcgcgatctcggctcactgcaagctccgcctcctgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaacaagttacaatttttaacagaaaccccattatagatacaaagctaacattatttagcactttctgtgttgagcaccattctaatacatatgttaattaattcaatcttcacatcaatcctcatacaacctataagttgtgtactagtacttatccctgtttcctggtgagaaaccaacagagagagagtttaagttgtttgctcaaggtaacagctagtaagtggcagaacctggctttgagtagaggctatctggctctagagcccatggttttaactattcacaatgctgctttataatattgttataatatcattatgttctgaaaggttacatatctactacaggaacatgcatttgatatgtttccttaggcctaacactaagttaatatcatgacaatctgtcttggctatgattttctaatgttgttttagtattatttacatttgtaatttttattatctgttttttacattatatccccagtttaacaaacaaaaaggtcagtgacttgaaagtggtttattaaaatataaaagagacgaaaatagtaaatactattattcagaataatataattgtaaatagtgaacaggattccagggcaaatagagaatatgagtctctagggctgggataaggtgagtctatgaatgaaatttttctgaacaagcagctgaaacagataagggaaattagcaaatacaagaaatatatgaaacttggattttaactggtgagccattctaagtctcccatttattgtcttttctgaaccctttcaaacaataacttaaagccattaaagttatattattttcagacaaagcagagtcacttttgggaaaggaaagacatttttcaagaaaaagtagacgtcctcgtcagggtgggcagcgccgccgcggcgggcctggggcttggggcctggagcggcccctcccagcacccggtgcgcccctgccctgccgcccactgccctgaaggtcaagtcgctttgttctgcgctgcgggcggcttcctcgccggcggcccagcggaggaggcgtagagggcggcgagtgggggctggcagctcaaatctcccgctagcccagccagccccgcgtacccggagggccgcggcgcacccggaggagcattcaggcttcccgtttttaaggtggagacgtccaggacctctttattagatgtttaggaatttgagtttttccgtagggcgatggtcatcgtgagcatctgtggggtcaggctgggctaactggggttttgattgtaagtttcgtgtggacgagggcatgtctgatggggaagaaagtccttggcattgcatctcagctgttgggagctgtgcggtgcgagccagatgggcggcgtgtgctccccgaggactggcctgagtgccttagcctagttactcacgggacttggtttaccagacaaggggataaaaacattcagatggcagataacagtttttcagatggggttccttcagatttcgtggaagctgctaaaaatgcaagtaagacggaaaagctcacggatcaggtgatgcagaatcctggagttttggcagctttacaggagcgacttgacaatgcccctcacaccccttccagctacatcgaaactttacctaaagcagtaaaaagaagaattaatgcattgaaacaaattcaggtgagatgcgctcatatagaagccaagttctatgaagaagttcatgacttggaaagaaaatatgcagcattataccagcctctctttgacgagagaagagaatttatcaccggtgatgttgaaccaacatctgatatggaatcagaatggcaccgtgaaaatgaagaggaggagaaattggctggagacaggaaaaataaagtagtcataacagaaaaagcagcagcaacagctgaagagccaaatcccaaaggaattccagagttctggtttaccatctttagaaatgtagatatgctaagtgaattagtccaggaatatgatgaaccaatcttgaaatacctgcaggatattaaagtgaagttttctgaccctggacagcctatgtctttcatattaagagttccactttcaacccaatgactgctttgccaactcagtcctgacaaaaacctgcaagatgaaatcagaaccagataaggctgatcccttttcatttgcaggtcctgagatcatggactgcgatgggtgtactattgactggaagaaaggaaagaatgttactgtcaaaaccatcaagaaaaagcagaagcgtaagggtccaggcactgttagaacaattaccaaacaagtatccaatgagtcatttttcaacttcttcaatccactgaaagcatctggggacggagaatcactggataaagattctgaattcgtattagcctctgattttgaaattggacactttttccgtgagcggaccacaggctgtgctgtacttcgctggggaggccttaaaggatgatgacaattttgacgaaggtgaagaagaagaggacgaattagaaggtgatgaggagggagaagatgaggatgaggtggaaattaatcccaacaaggaacccagccagccggcggaatgcaagcagcagtaggaagtggaggtgggcgcctggcagaccggctgtcgcgactccgggcctgtagcgggaggcctcagtctttgccgcatgcggcacaatcccgtcgacagcgcttactccatctaatcgttttcaagtgcatgattttcactttcacttttcctttttccttattattttgcttaatgtgtacagtggcaactgaaatgcatttcagaaataggaggttttgtccaataccctctgcagccttggtgcctgtagctctggacttgcctggacccttccctgcgggagggccccatagaccccattggggtggggtgggatggggtggggatcacttggctaaaagggccgaggtctggtgatgaggttccagggatctagaacctctcctaccactcctgcagttggactgaattctttcctttcatttgaagaaacccactcgctgttttcagctgcttaatctgctgagtgtgcagcctgcatcacctgctgtatgctaatcatctcagaagggccgtgtagagtagggccgtattctccttaggatgttgctttttgatcttcttttttaagggttgggtcagggttgtggcacaccagctcaggcgagagctgccacgggtcacctcatatttatttatcccttcttgcctgtgaggactgcggccttttgctgtcgctcgtccttgccatttctgaaccaccctggtgacctgagcaggaagatgtgccacttcctagcaggagcaagggctgtgcggaagaaacactgcttcctgccaccagggctgaagacgcgagcctgtcctcgtgacacaggcaccgccctgctgccggagttgggattcggcagtgttctccagtgaggggctgggctgggaagtcctgcgtttcatttgagcatatgagcgtcaagtcctgctttctcagtagtcccattgctgggccccaccattcatcctgtctgaaggtcctggttggtgtgaccggttggtggctggtgagtggggtttccaagtgggtgacagcgctctgtggcagccggggatggccttgtccgcgctgaccaggcctgtagagagtgctcagcctaaccttagaacacatttataactgaatacagtgttttcaatttgtacataatagttagaatattctattaaagttatgaaacacggagaaaaaaaagaaaaagtgcaaatgagtcccaatttataactgatagatttgatttttgaagacagagaaaagatcaaacccacagaggtgtcactcaaaggagcactgtttgtacaagtcacacaattgcaagaagtttttaaaacgagctgcaaagttaaaatagttaagcttggagcaaacattcctttattaattccaccttttgagtgttacataatacccaaggcatacgatatggaaatgcaatttgttgtaaaagcagatagttgctttataatgggaacaacaaaaaataaaaccagtgtgcttttgccttttggtatatgtgtgctgcatctaactgacaagggggaagaagatgaccacatatagacagagcaagcaagttgaaatcttgaaaagttttaagtgttccaagagacaaaatacttgaaggaaataatttctgagtaagatccctctatagaattacatggaatattttaggggatttttaaaggttttgcccttgcaaaactttatgtttaactttatgtttgccattagaatttgaagacacaaagtaaaattactcttactgaaagtaagattactttccctgtaaatagtctggtaaaagatcataagaggaatgatattcctcttattgatttgaaataagtactattaatttgaaaaaattcttttaattattaaataatggtgatttatccttcttttacattttcttccaaattgatagttcacatatatacaacagattttgaaagtttgaggaatgttgcttgataggtcttaggtttaaatcctggagtagtgttgacatctgagacatatgtctgggcttctgaccctggtttctgttaaccaaatattggaggaccttctccttttaaaatgcaaaccaggagctgaacttaatgatcttaatggttcttttgaacagtaacagtctaggatctttttttttctgagatgatttttgaatgcttttgtgtggaaccacatgcatcataatagatacaaatccatgaaagtataacagttaaatactagatcttactttttcaggttttgatttctcatctaaactttccaatgctttatcagtgaagcaaactaactcacattgactagcctgctctcctttagcaaacccttcaaataaatgcctcatttgctcctcaccactatcattttagattggccagacagttgttacttaccttttaagaatgaggagacaggtagccgggtgcggtggctcacacctgtaatcccaacactttgggaggctgaggcgggtggatcacgaggtcaggagatcaagaccatcctggctaacacggtgaaaccccgtctgtactaaaaatacaaaaaattagtcaggtgtgttggtgggcacctgtagtcccagctacttgggaggctgaggcaggagaatggcatgaacccgggaggcggagctggcagtgagctgagaccacaccactgcactccagcctgggtgacagagtgagattccgtctcaaaaaaaaaaaaaagaatgaggagacagggtcaaccaggtggggtgacttgcccagggtcacttaagtattggagatagaattaaaatttaggtctttgaattccagagtgtttttgtatgataccatcctgactctctatacgtttcaaaataaatcaaattttaaagttttctttgatttattcatatgaatgagctagagaaacccatactatatagatatacatagtagatattggtcaaatgtaacttaattttttacctcattatctcatgtttcttgtaacattttgtctagtaggacctttttgtggtttgtcatcattttagtcatgacatctactgtcataccgtcactgcaacccagaaatggggcgatggggttactaactagttaaacacaatctaaaggagaattttagagacagttaagattgaggacagagttcttgtccaactcgtattgtactgggggaatgaactaatacttactgaaggcctgctccacaacaaactcctgtaaatgatttacataaatgtgtcacatttaatccacacaacaacccagtggtgtgggtatttataaaggaggaatctgaggcacagtgaggttaaataacttgaccaaatatacacatttattaagagcaaagccaggatttgacatccaactccatctgaactcaaagcactgtgtcttccccactgtactgggaagtaaaagtaagaagatgactcagagatggagaattataatctggaatttggaatttacttccattggttaaccgtttgaaaattgcagctccaaggcattgggagatggaaagaaagctagtgagcaattatttcttgcctttgtgtcatgctcctacattttgctcctccttatctccttatctgcggtcagagtagatagcatggaggttttatgcccatgctacagatgttcagagatctcaaggtcagaaagctggtttatggcagcacgtgaatatagacagacttatacagattagaaaattgagaagttgagggcaggagaaaattctggatagaagagaacatgggattgggagcaagaaaacctaggtcctagacctgatttcattgcttactggcagtgtgaatgtgggggataataatacttactttacaagggctgaggaaattaaataaaatagcatgtgggaaagagtattgatggttagtcactataaaactgctagttgttattcaggatacaggaagagtttcaagagaggacatttggtataacattatatacagccaatggtttaaggaggacaatgtagaagaggttgtggatttggcacttaggaggtcattgttgacagaccttgtgaatagatgagggtaggaaccagattcctgggctttaagtaagaagaggggtagtccaataggccagttatatatttggctgtgaaagaggaaaataaaatctgagtacctttgagagtcaaaggctatttccaggtaaagaaacccagtgcacttcaccattctcttttagataactgctgggaagaagtaggatgattgtaacaccctccacattgacacagaactctaaatgggagcctagggaaagggcacattttttgaaggggtaggcaagaggatattctctagagtaccagtttccaactgttgtacacatttatggaccaagaacataaaagaaacattgttcagttccgacctgaagttatgtagaacaaacattgttctgagttcaactagatgatctttctttcatagctgtgtggacattatgttacctgcagggagtaagtcactgaaggtagagcctcaaaaaaacaccctttgatcttactcctaagaaaaaagagagaaattggaaaaattcatcatagaaacacaaaaatatgcggaaataggaaaaaggagaagaaggaaagaaatgcaacataggaaataatattatgtagactgagataaagaatgttaagaatatttgaacaaagtttgaaccagatgaaatgtaacaggcagaaacagaagtaggaggatttttggactgatttaagttggtctcttgtgacttttatgactttccactgggaagaatagtgattaagaatgttcactctgcttttaaaaattgagaaagaacgctgcgtgcagtggcttatgcctataatcccaacactttgtgaggccaagacgggaggattgcttgaggctgagagttcgagaccagcctgggcaacatagggagaccctatctctactaaaaattaaaaagttactgaggtgttgtggcatgtgtctgtagtcctagctacttgggagactgaggtgggaggatcacttcagcctggcagtttaaataaatcagatcagtaattaataatcttccaaaacagaaagcaccaggttcagatgggttcattggtgaattctaccagatatttaaggaagaaatactaattctctataatctcttttagaagatagaagcagagggcatactttccaattcattttatgaggccagcattattcttgtgctaaaaccaaagaacaatacaagaaaagaaaattaagacaaatatttctcatgaacatacatgtagaaaccttaaacaaaatattagcaaattggatccaacagcatatagaaagaattatacatcatgactaagtggtatttatctcaggtgtgcaaggcaggttcaacatatgaaaatcaattaatgtaatccatcacattgacagactatgaaagaaaaatcacatgatcataccaatagatacagaaaaagcatttgacaaaatccaacatcaatttatgataaaaactctcagtaaactaggaatagaggggaaactttttcaacttgttaacaaatgcctacaaaaaaccctgcagctaacatcatctgtaatggtgagaaacttgaagctttccaactaagaccaagaataaggaaataatgttcttctcaccactccttttcagtattgtactataagcactaactaatgccataagacaagaaaaggaaataaaagttatacagatgagaagaaagaaagaaaattgttttagttctcagatgacatgaatatctatgtatacaatccaaacgaattgaccaaaaacctcctggaactaataaaaaactatagcacatttgtaggatacaaagttaatatacaaaagtcaatcacttttctataacagcaatgaacaagtggaatttgaagtttaaaacacaacaccatttaccttagcaccccaaaaatgcaatacttaggtacaataacaaaatatgtcccagatttatatgagaaaatcaacaaaactgatgaacaaaatcaaagaagaactaaataaatggagagatattctatgttcatagataggaagactccttattgtgaagatgtcagttatttccaatttactctataaattcagtgcaatcccaagcaaaatatcagaagtcatttgtggatatcagcaaactgattttaaggttaaatgggcaggcaaaagaccagaatagccagcaaaatattgaaggagaacaaaattgtaggactgatactactcaacttcaagacttactataaagctacagtagtcaacatagtgtggtactggtggaaaaataaaagacaaatagatcagtgaatcggaatagagagcccagaaataaaccaacataaatatggtcaactgatctttgacaaaggagcaaaggcaatacaatggagcaaagatgatcttttcaacaaatagtgctgtaacaactggacatccacatgcaaaaaaatgaatctaaacacagaccttatgcccttcacaaaattttactcaaaatggaccatagatctaaatgtaaaatgcaaaaccataagactcctaaaacataagagaaaacctagataactttggatatgatgactttttagatacaacaccaaagacatgattcatgaaagaaagaattggtaagctgtacttcattaaaattaaaaacattgctctatgaaagacaatttcaagagaatgagaagccaagccacagactgggagaaaatatttgcaaaagacacatctgataaaagactgttatccaaaatatacaaaaaacttttaaaactcaacaagaaaaacacaaacaacccaattaaaaaatgagtcaaagatctcatcacacacttctccaaggaaggtatacagatggcaaatagggatataaaaagatactcctgggccgggtgcggtggctcacacctgtaatcccagcactttgggaggccgaggcaggcggatcacctgaggtcaggagttcaagaccagcctggccaacatggggaaaccccatttctactattttctattttgtaaaaatacaaaaattagctaggcatgtcctatgtcaacaggcaacagggaaatggaaactaagacaacaatgaaataccacttcacgcctatcacactggccaaaatctagaacactgacagcaccaaatgccagtgaggatgtggagcaactctcattcattgcaggtgggaatgcaaaatggtacagccactttggaagacagtttggcagtttcttacaaaactgtatgtactcttaccattcaacacaactgtcatgcttcttgctatttacccgaaggcattaaaaacttatgttgacataaaaaccttcacatggatggttatagcatctttattaataattgtcaaaacttggaagcaaccaagatgtccttcagtaagtgaatggacaaataaactgtggtacatacagacaatagaatattattcagcactgaaaagaactatcaagccatgaaaagacatggaggaaacttaaatgcatattataagtcaaagaatccaatctgaacaggctacatgctatgcaaattttacctatgtgacattctggaaaaggcaaaactgtggagactgtaaaaagattagtagttggcaggggatatgaataggtggaacacagaggagtttgggggcagtgaaaatactctgtatgatactgtaacgatgttattatacatttgtccaaacccacagaatgtacaactgaatgctaatgtaaagtgtggattttttaatgataatgatgtatcagaatggtttcattaattctaaaaaatgtaccactctggtgagggatattgataatggggaggctatgcatgtgtaggggcaggatgtatgtacaaactttctgtaacttctgctcagttttgttgtgaacctgaaactcaaaatatttaaagccaagtgaagctaacttactaagccatgaatcaagtttgtggaataaccccaaatagaggaaccattccaagtgttttcaaaacatagtaatttgggtgcatatttcaaggggctgcattctaaggataaaaagaactataaagaaaaaaattgtaatgttttaagtaattatgtagttagcagtaatgctggtatttggttactgttgagtatgtattgcaggaaaatgcaaatgaatatttatattgttgttattgaatattgggatgtttggcatgaaagaaaggagattcagctgtaaattgattaggttaagtaaacattgtagccctggatttatttaaaggtattaatttgaaccatatgaaattgctgtttctctagtcaaaaaccattgaatcttggcagcttaatagggttcagcataatgccagcatgacccattaatgtattttgtctcttagaaaattgtgtatttcctggttctgtccattgaaatgttctagaaacaagagccagtcctgtagcaatttgcatgcttcttggttcttggacccagatttgagtgaccagtgttacctggtgtgcccagacttcccagtttcagcacccgaatttcatatcccaggaaactcttcagtttcaggaaaaccaggatgattggccaccttcacccagattatggtacctaattatcatttcccatgaaaatgaactagggcctttgggacagttggctgattccatacctggggcatggaatgcattaaaataagccttgagtatcttattttaccacagaacaagaaagctatcaaaaagacttaacatgatggtacgaacaggactcaggagccactctgaagaggttccctctggccaaaaataagacaattggaacatcaataagaataacaacttcagtagattgaaacacatcagttgtgctcagttcatgcgttcataatgtactaaaaacaaatttaaaaactcactggtcatctctagagaatgcttgggagctaactcattattttgaaaaacgataaagaaagagaagaatcaaatgctgcttttcctatataaattgaacctcagagtaaccacattgttgatgaggggcagtttatctttatgtgaagattgtagttagtaaagaaggaatgatagactaaaccactttgcaaacccttgatgaacttatggctctagacaatgatcttcagtggcactgacatcatgaaaagaaaagcaaccaggcatcgtatgccacctaagggaagtatacaaacactacttggggagtattattgccaaggaatatctgaattttgctactaaagaagggaaaatgatgttcgggggcacctagcagtttctggccagggtcttctcaaatctgaccaataggtgactgcctatttgctccaacacacctgtgttcctaataaaaggaaagtgtgatcatatccttattctcatttattcattcattttctctctctcttcctcctctcccttcctttcccttcctttcccatatccatgtcacatttgttcttagtgacccctccccaatcctttagcagtgcattgtgtactctgattttggattttcaatagctggatagagtttaccttgtgaacataccacagttttttgtgaaaacaaggagctgctgtgaaaacaacttaggttgtttttgccttatggtatattaagtaaggctgcagtaaatatctttgtgcctttttgcggggagtagaagggcacatcattgatattttccccaggataacatcttagaaatggaattgcagagtcacaagatattaatagagataccaataacatctactcaataggttaatgacagtatataacagctgttcttaaatgcaactaccctatgagataagtatatttattagtctcgagtatagttaccctgtgagaaaatggaggcactgagaggttaaggcacttgcccaacattgtaatgacttagtgagactataggcacatgacttagtgcaatgtctagatgcttcatgataaatatttttaaggcttattatatacaactgccagaattgccctaccaaacacaatgccaagttctgcttccactggcagtatgagatggtcagaaacaaaccttctagtggaacacttgcttcttttattaaataacacagggtctggaatgtatcaagcttgtgcatataagtttgtttagaaatagtcgaatcttgttattcatattagttctacagagtcaagttaacagtgaaatagcaagtagtgaagtaatgttcctgggggaaatacaggggtaggttcctgtgagcctctagtcataagatttttgttaatgatctgtttataaccttgttttatgtgtgtctctgtttaaataaaccttaatatatagtgttgatttattgaccttgaactcatagccaacagcactgtaactcatgcctaagtgaagcttatctaatacacctattttctctgcaaggcacatcgcagccttcttgcacttaggaactcttgtcagcccttcaacactatactttgggaccacttaaaatagtgaaatcaccaacaaaaaagcacaaaaatgcaaaatcatggcactaaatagactgcaaataggacacttgttaacagtgtaagaacttgaaacaagaaggcagagctttacctttttccacctctgctgggaatctgcttattgggtgactcaaagttttcatcactgttcttatgtctgagaatgactgctttgggtattgatttgtggattacaaataaatttcagtaaataagcaaaccgcaaggtggaatctgcaaataatgaggatccattttgatcagttcaactagttgaatttcttttcttttcttttttataggtcattcaagacacagatatgcacttatacccataccattagcagtaattacaacatgtattgtgctgtatatgaatggtatgtatgctttttaaaacaaaatagtttgaaaacttgcattgttttccaaaggtcagaaaatagtttaaggatgaaaataaagtttgaaattttagacatttgaaaagaaacaaaaacttttttgctttacgtgtgtgggactgctgagcatgctaggttcctccaaagatccacattatctcaaggtagaatgaatccttaggccacagagagctttacaggcctgggaacacagcctggacctgttgcatagcctccttttacctgtgatctgcttcaaaatatagttaaacttctggtctccaagtcagagtttgctaaagacctctttaggctgccacctctgtaattttcatgtcatataacacgaatggggctcccaggtaggaagggagttttggttgagttaagtgacttacgtaatacaagtaattgtgcttgtattacttcctgagccttctcagtcccctagcaatcttgggcagtcatacagcttggagaactgatgacttggagaatttgttcccagcctgttcattcctggtaatgagtaatccctctcaaatcccaaaggacagggagcaggctgtaattctgaagagtggatattcttgatgccacagcagtttccataccagccttcaccaaaaggaaatatgccagacagggaatgccgaagagtaaactttctacaagtgatagtatctaggatccattgtgtcatgaatcaagtttataaactagatttcagtttccttagacctgcactgtttagtatagtagccaattagccacatatgattatttaaatatatcatttaaaatgaaataccattaaatttaagattcattcctcagttacactaaccacctttcaagtgctcaatacctacatctggctagtggctaccatactggatagcccagataaggaataatcctatcattgcagaaagttttcttggtcagtgcagaactagactattttgcgatatcagtgctaaatataatttcctgatgataacattttcatattataagttgtaaataccatgaaaatccatccctaagtaatagattatcagtcagttgactctccactaaacagtattataacgatcagctgaagaaagttttcagctattgcccaatgcataaaatattttgggagctcaaattttttaaaaatctattttaatccccaaatagcagtataatagttaatcatctcctgaacaggttggttcccagaaaccaaaatcattttccactcagtgttgttgtagatctcaattaaagaactaacccaggatacctgaactaaagagaggtggcactgagtttccatagaacttcaaaacaattggttgatttcacttaaaaaaaaaaaaaaaagtcattcaatatacagaaaattactcccctggtcagtactgttagccccagataatctgaaaaaatttgttcttaaaaaaaaaaaacaatttggaggccaggcatggtggctcatgcctgtaatcccagcacattgagaggtcgagttgtgtgcatcacttgagcccaggagtttgagaccagcctggacaacatggtgaaacactatctctacaaaaaaatacaaaaattagccaggcatggtggtgcatgcctgtagtcccagctactcaggaggctgaggcgggagggaggcagatgttgcagtgagctgagattgtgccactgcactccagcctgggtgatggagtgagaccctgtctcaaaaaacaaacaaacaaaaaaactcagcaagcatctcaacctttaagcaaccttaaagtcattaattgggaaatagtgagatgtttggcatggaatcttcagaagaggaaagagttgaatggaaacagctccagctgcctagttgtagttgacagacaactttataagctctagtcaaccctattgactaagcttctgaaccactagcatagttctagggtcaggcggatgcctactgtgggcaggaaagtgatgcatgcatgtgtgggagcagtgtcttaatgtctgaaatagtagccatgagctacatgtggctatggagcacttgaaatgtgggagtccaaattatcatgtgctgtgagtgtaaaataatatgtttctaagaccgtgtgtgaaagaatataaaatatctcattaaaaaatgtttatattgagtacatgttgaaataattttatatttgtgacacattgtgttaaataaaatattaaaatttacatttttttttactttgtaatgtggataccaaaaattttaaattacttatgtggcttgcattatatttctattggacagcactggtccaaactattctagccttccctgcatcttcagccttatgcacgaggtaaaattagccattttgtcaacagtttttgcatttggttttctatcatgttctgaccaatttttgaacaactctttggaccagctctgtagccgatttgatttaaagcatataggatagcaggaaatcccagggtgatggggctctggcttagttttccatatttaggcctctaataggcagtcagtaactccacatttcaccttttcttttcagttctttaattgagaagacaatttcttcatttttaggtattctgaaatgtgacagaaaaccagacagaaccaagtaagtacactgcaggctgtgcactctgtgccagaacaacagcagccctgctgtagatgcccattacttgggaagccagattgtactcatctgttggttgccttgtacagtaataagaagtaacatcagcagatatactaaccatagtgtattaagtaccaactgtgtgccatgcactgcactagccactctctgcatatcgtttcctggaaccctctcaatgagccttgcaggaggagtatcataccccttgcttagagacagcgcatatgagattcatagaagtcaagtgagatatcaaagtcacgttgctagtaagtgatgggctgggatttaaatctaggtctttggactccaagagttatactgttaaccactacaatacactccctccacctcccatcccagaaaaagttggatcagggatagggttcacttcaggagccagggtcagagctgggcctgtagtcacatataaaagataggacacaaacacaattagcagcagtgttggtttaataaaccgccgtagggtgctccaagaggccccctcctggcagatcccactggtggtcaggaggcagaggcatgagctgggtgttgagggatgaggggaagagttaaggcccagggtgtgaagggcaggacaagaagtagcaagccatcctctttggagcagagagtgttgaggcattagagaaagatggggctgggctggcaggttgggccaggctgagactttgagagaggctttgggtcattctttagggagaaccgcagagttttctagcagaactatgctttagtaagatcactctgctggcaaagcatgggactaattaataggagatgagatgaggacactggttagtggagtaatgaaataatccagccaagcagagaagagggcctgagtcaaggtgatggtggcagaactgaatatgcagagctaggtttgagagaaacagcagaggtcctgttagcaaaactttcatctggcagtgtaggctctgatgccaaactccctggttcaaatgccagctccatttctcacaggccttggacaagtcacttaaactctctgtgctttggttgtcttctgtggaaaatgggcataatgataatatagaaatgacaatgatagcatagataatcacatagaaataactgtgtcaaaatatattaatataagtacaatgcttacaatagtggctggctcataatagttttcaataaatgttagccattatgactattgttactattatttttcaagaaaaataaaagcgacaggaccaagtgtcacagaggagtcacacaggaatcttggttgggaaggaaaattatgaatttttgctttgacaggttgattttggggtgctggtgtattacctggctagtgatgtccatgcacagaattggagcgtgggcttcacgctagagttacggattggggcgcctcttcatctggacagtaattgatgccgtgagcacctgaggtcactaagaaagaaaagctagatgccctagggtgatgggaagaggcagaggaggcgggactggggaagcaaagtccaggatcagagccagggtagccccgggttagagactcgagggaggaggctacatgttaaagctgcagagacaaggaggtaggcgaggggttaagacctttggttttgtggagtcggttgctgtggtcagtgcagggatgaagtgagggtggctaagcagcagcaagggcctaggtgaggtgggatcgatggatgggccacaggtgtcctttctcctcagctgccaggtggaacagtgcaggagaaacaagctgtggcaggaggcctgggggcaaggaagtacaaggggcagctcagccggccacagacccaagctgggaggacccaaggccatgaggggttgatgggccaggaggctgggcagagaggagccaagtagctggagatgaggtgaggtgggagaggtagggacctccaggcttgtggtcagaggaaggcatttcagatctgagcaatatgcgtgagccccaggtgagtgtgagagccaagtcaggtctctgctgagatctaggtggttacagtggaggggaactctgagtggatgggggaggcatagccatcactaccaatgatgggggtaggggggcatcatccagggccacggggaaaggggatgggcattctggaactcatcccttcctctgttcctttcatcacaacaaacgttatggagattatgcgataccaggcactgtgctagctgatagggtgggggtcagagtacccagcgaggctagacattgtgtgggattcagagaaagcatataatagggctcctcccacaagaagcttgtggccacaccagggagagagaatggatgcacatgagcatacgaaactcttagaaggacttaggcaggaagcacaggtgataggcagaatgtgtgatatgagggtaagggctgagcaaccaacgcagaggaattggagaggccagaataatcagaaaagctttggagggggtaggatgtgacctacattttcagaacaagagtggagtagaaaaggcattccaggtgggataaacagcggaggcaaatacatgagagggaattaaatctgttgtgatttatttgatagtaagattgacctgcctggcatcgagttgaagtagaggcaaaagacactgaatatttgcaaggaggtccttagaatggagtgatatggaaataagcagccattataggttcttgagcaggaacattttgcatgaaaagcactgctttggaatgatgagtctagaaaggtaacactgacctctctaaggtggcattctagggagagacctgagtatttggggctgagattgagagaggagcttacttttcttggtatatttttatttactattcaagttctgcatcatgtgtgtttactgcctatttaataattatttttaaatttaaagaacccattgtggcagcagggggaattctctaagctcagttactaaagggttatgaagctgggtatggtagcacacacctgtagtctcagctacttgggaggctgaggtgcgaggatcgcttgagtttaggagttagtgggaggatttcttgagcccaggagttaagagaccagcctgggcatcaaaaaaattaagttaaattaaaatgttaaaaggttctgtatatggtggagatggaggagatcgggggaggagatgagaaaggggcaagcataagtaggaacaaatgcaatatttccccagctgcgcgagggcaggagcaggaagaactaaacccaattaggaacaacagaggacagatgagtagatagcagacatctgacgggaaatggccacgccacacttctcacccaggcagttcaacgtaggcaatttctgagtgccctggtattttttgtgtaagtgtctagaaaacagatcacaaagttagccaaattaaaaaggaagcagggagtcctatttctccgagaagaaagatttacaggtgggatctcaggcaggagccaagctggagaagcaggcttgattccttgtagtgggtgaggagactgctgggagagggcagggaagcagagaccggcaaaaagctgccccaacaagaatcctgtgcctgccaacctggtttacaaacatttcccactttatccccctcagaaagtcacagcacccatttcatgttctgtgaggctcccaaggagggaaacttctagtttgctgtcctttacctcacccctgtgaccacagcactaatttctcatgaattcttgttaccaatgagatacaaatgtttggggagctctggcctggtctgattttgagctctgtggaaatacgcagaccacgggggaggaggccgggaaatggactcggtttgagggcttgctcaaggatgcggttttgtttttcggctgatttactccaagacagccagagattgttctgtcgttgccacagaggtgactaaacaggaaggtaagtttgaggtaggaagaaaaccatccccaggagtttcatgtagcaaagaaggaagtagctgttacaaatgggtgacagtttacatgtgggtctaacagtctcagctctgttgttcaatctttcagttatactcagagagtaagcgggaggagccttggggctgctattgagtgcagcatcctgaaggctgttcttcaagtgttactcagactactatcccaagagcactcaaggcagttcttcctccatccctgctccctagctcccttggctttgatgagtttattacaaaagggctattcactttagaataggagggtaattaagactcctggtctgcagcccagatttactgcattttacaagttaataatatgatttttttttgtagctccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtgactaggtggtttggctactgttttcctaagatagaaaaataagggtcacatacccttttaaaatctatactctttctcccttgctttaggggaaaaataattcattgtagggtcattcatggagtgagggagaaaagtactgtccctcactgggttccactgctgtcagtacgaggcaagtgaacacatgggtctttacttctagctgcttttgaaaagagcagatcaccaccatccagtgcagttgtataacacaggtggggcagggagacttctctcgctgccattaattagcctacttagtttgttgcattggttagctgtcacattgggaggtcaacagcagacagtagctggaaaaccgtagtcataacaaatacagagtggcagccactcctgaagtggtggacggtgccagttgcctctggcagccatgtaaacccaagtcaatacatagacgctttagcttgtgcctgcactgtccctggaattcctgtcacatgagagtctccaggctgaaggaagaaatcaatatttcttgactccaagatgggcctgtcaaggtgggtggatcacaaggtcaggagatcgagaccatcctggctaacacaatgaaaccccatctctactaaaaataaaaaaagttagccaggtgtggtggcgggctcctgtagtcccaggtactcgggaggctgaggcaggagaatggcgtgaacccaggaggcggcgcttgcagtgagccaagatcaggccactgcactccagcctgggggacagagcgagactccatctcaaaaaaaacccctcaggctacatgtgttctctctagaacagcctgcatctgagctcccacaggcctcagcaagagtgggaaaggagcccagagtgcttctgggaagacccacatctccccagctccccccatctccatgtggcatggattcctatcctgtctcagactaatcttgtcaaaccctttatcccagaccctgtaggaagcccatgactcccctggagacttctgtcccatgcagctctgtaatgccccactttctgcccccatccatcagcagcgacatccctgatgtcctcttctgtgaatgcctcctttgcttcgctgttctaatcgaaacccagctctccctggggatgctgcctcccacagcctctcaaggggtagctgtgttctttcctgcatcccttgtattcagggcctaggggaaagaagacgtcctccttgctcttctctgcctgcagaccagtgctccttcctcggctttgatgctcatgccagctaatcatcaccacctgacatcccttgttctggttatctttgttattccctatcccttggaggttttagcactatgtcaaagtcttctccctgacatcacttcttccagattttgaatgctttcaaaatctacaaatctaataccctcgcatggtcttttcttctccctttttcagctagccaccccatagccatactgctgacctataactgcagcatccccgaatagtctctgtaacaagcatctcacttcgctagtccctacttcgcatcttccgcatcacccccttgggggctccagcgccaaacattcttcaaccccactagaacctacaagccagtgaccttgctacctgttccctggccctgaaccccttcaagttctcactcttcctcttacctggcttagattcccattgttcatcattacaattactcctttttcttttcttttcttttcttttttttttttttttttttgagatggagtttcactcttgttgcccaggctggagtgcagtggcacgatctcgcctcactgcaacctccacctcccgggttcagccttccaagtagctgggattgcaggtgtgcgccaccacgcctggctaattttttttttttttttttttagtcggagtcttgctctgtcacccaggctggagtgcagtggtgtgatctcggctcactgcaagctccacctcccg

SEQ ID NO: 15996 - DNA, 118382 bp, Human
  misc_feature (1)...(118382): n = A,T,C or G
cccttgttcaagccactccagccacactgactcctcctctaacaagccaagaatccgtttccctcaggccctttgcacttgttatgtgttcctctcctgctcttctccaagacaggttccttcatctgatcaacaggggccttcttcaatcacctctaaccccttttaccccacttattcttttcttcacagcacttaccactccctggcatgtatctattctcaatctttttctctattagattgtaaaccccttgaatgcagggagctcctctgttttgtaatcccagtgtatctctaaaacactatgacaataaagaggtcaggaaacatttttgaataaattttaaaaagttttcaggaggctgggcgcagtggctcatgcctgtaatgctagcatttccagcggctgaggcgggccaatcgctcgggcccaggagtttcagcctgggcaacatggtgagaccccagcctcttcgaggcaaagggaaaaaaaagatcagctaagtcatggtggcgtgcatctacggtcccaggtaattgcgaggagcacggcttgagcctgggaagtcgaggctgcaatgaaatgtgatgacgccactgcactccagccagggcgacagaacgaggaggtctcaaaaaaaaaaaaagttttcacgtggtttaaggacttacagcacctttcttgggaacactaacaggagaccaaagcatttcatgatcttaacactaaaacagttgttgcactacataaaatcctccaaatacctttttttttttttcaaataaaaaggcaactttctgaaagcttttcttttttttttgagacggagtttcgctctgtcgcccaggctggagtgtagtggcgctatctcggctcactgcagcctccgcctcctgccgggttcaagccattctcctgcctcagcctcctgagtagctcggattacaggcgcacgccattacacccggctaatttttatatttttagtagagacggggtttcaccatattggccaggctgcccacgaactcctgacctgacctcaagtgatctgcccgcctcggcctcccaaagtgctgggattacaggcgtgagccactgcgcttggcctgaaagcttctactaccattgttgtaagggcatttgtcacccagctcaacccaggacacttaaagtgggacctcagaaggacgcagtattggttatatccgtggctctccaaactgacatacataagaatcagctgaagggacttttccccctccgtcggctctctccctcacttcctgattcaggtctggggactggccctggcatctctgctttgaaaaactcctccgttgattctgatacgtagcaactcctgagaatcaccttaagatgccaaaaatagctgttaaagagtttcttcctcactcggtcttttcagcctatttctgatagatcctcagttcaaaaacaaaaagcaaaaaaaaaacaaaaaaaaaaaccaaaaccaaacaaacaataagccccgctttagtgctccacggccacccaaaggaacgcggctggtctacgcacagcagagacccaggaggtcccggcgatcgagcggcgcggcaggtgaaacttccgcggagacgcccgggacacgctcgcagggaccggaaccgtcccggctaccacccttccgtatgcaccaccgctgtgtcggagttcataaccaaccccagccaaaggctacccagcgtcaacggcctctggctttaaaaaaaaaatctcccttcgggttaaagagccgcggcactgacgcaaggaactggcttcgagggtccgggaccgctccgcgcccgcgaaccgagttcccgcctccctcgggaggacgtccgtgcgtacgtgcgcgtgccgcaaccgccctccttcaaacgcgcgacgcgagggcgggggcgccgcgtgcgcgcgcgctctcgttggttcgctctctcgctagctctcggctgccgctcttgctgcggctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaaggtgagccggaggccctgcctggcatctgggccgcaagggatttgcgcaaccctagaggagctggggacggaggtgctggggcctggggctgctcggacgggcgccatcccgaggggtctctaaggtgaaagactcgcccctgggacactttccagagaagctggaccgcaagagataaggggagcatgaagggaggggtgccggctgcgagaggctgggggaggggacactggctccgagggagggtttgtgatgtgcggaacccggccgagcgctggttctggagctggcagacccgtacagtgagagaagggggatttgggaaacacgttgtgaggaagcgttttggctgaaagggcccgggccagcgaggtgttgagggagtaggtaagaggtaagggcagtgaagatggattgctttggagggaggggacttggcgtgttcacagataggagagaggaggactatggattaaatggaggtggagagaatatgttggagagcaaggggtccagagaaggcgcctggaagaaaattgtaagatgacatggggaaagagaaactcggaaagtggactgcatggttagggaaaatcctaaggtttggggatgaaggagaaatgaactttgaaggaaattgagagttagggaaagctgggcatgaatttgttttagctaattggccgttaatgagcccctagtgttggggcactgtgctaggattgaataaagtactcaatgaagacttcattcacagtctaacaggagaaacatataacttgcagcagtggaggtgagtcctcagtacaatggttgtggcacaatagaggaaaggtcagggaaatttcacaggaaaggaaatccatgaacaggtttcttgaagaatgagtacctcactgggttggagggtattcagggcacaggacacccttctacatccctggaactaaagactgtgtagggtgattggtggaaattagattggattgatgggctgaaaagataaaggtttcacagtctcttaaactcttgggatccaggtgtaaggacttcagaatattttgggatttttcttttttctggcaaggtctgttatgtgagacttttatcagggtctgagttaactctatcaaacacgttaatgtttctacattgaaacacgtgaatgtcacgctaatgggatagacgataaataacctcccagcattcacagtgggttctgttgcaaaccaatgaaaaaaattaaaatttcaaagcttttgaatttcgggactgtaggtaagcgattgtggagctgcactaaagggcttggaattcatcctgtagagtgtatcctcgacattgtggactgaaggatgttcctggagggctttcatatcaagaggataaaaggatcagatttctgatccagaaagatcacttagggcacttgagggatgagggaaggcaaggctggagacaaggagaccagttaggagaatcctggcggttatctaggaaagaaatcaacatttggaatgggtagtaaaggaatgatatatcaggtattacagaatgaagcattttggtttgggggaacggtagggtttggaaatctactttgccatctcctacttacgacttgggcagatgaccttttcttagcttcagttttctcatttgtgaaatgggaaaaaagtatataacctcatagggttattgagagaatgaagtaagataaaatgtgtaaagtgattagtacgtggtagttactaatgaaatggtagctagtatattaatagtagtaactaatagtggctatgggaatggagggatggggggagtgtattgagattggtgtgagggagacaaacgtagaattccacattttttgtttggtggatggcaatgctattaatacatattcagacactgaagcagggctggggtgagggtgagggctggggtgtagggaggataaaatgttttcagattgggatgttttgggtttctagcattattggtacatgtaggtaagaatgttaagagtaaggctttggttgttggagaagctactaattgttagtaggtgttcagagaataactgctggtggtctgtgcacccatgaccatagtaagacacataggattcagtgttcttgtgggaacctgggttaggtaagagatttagagggaacccagaaatacagattgtgtttgactgatgtggctgagggactgaggttatgaaattggctctctgaaatttatgaaggagagagaataatatgtaaatcccctcttcatttctttatcctttctttttgaaggagggggagtaagtggaagggactaaccaaatgctgtcaatcttaagtaatatttctctctaaccaatatctaaaacaaattgagtctggaatccaccatgtttttgattaaaaaaaatttttttttgagacagtctcgctctgttgctcaggctggagtgcagtggctcgatctcggcttactgcagcctctgcctcccaggttcaagcgattcttgtgcctcagccacccaagtagctgagattgcaggcgcatatcaccacgcctggctaatttttctgtttttagtagagacggggttttgccatactggtcagactggtcttgaactcctggcttcaaatgatctgcctgcctcagcctcccaaagtcctgggattacaggcatgagccactgtgtctagccatccaccgtgtttttagatagtctagaaaataatttgtcagtattaactcctatataccattctgctttgctctttaaaaagatcaagctgtgctggaaagagcactagattgggtgttaggggacatagttcagctctttagctattttacgctaaaggaagttcatactgtttttgtccttcagtttccctttaaaatgtagctgatagtcgtttacttatatctcaccaaggcaaataataaatgtgaaaatgctttgtaactgagaaatgcttcaacaatacaggatattattgatcaacctcagatatcatctctggtctggagatcatagctagtggttttaactcaccatctttttcaagtgattttgaaacaatgatgagtataatgccctcctgcctaactggccttttcctgtttctcttaatacatttattcacaccctctggctgttctttctagatcaacagttctcagagtgtggttcctggatcaacagcatcagcatcatctgtgacattgttaggaatacagattcttgggccgcattccggacctcctgtccagtagtctcgtttaacaagctctccaggtgattctgattcacgcttaagtttgagaaccactgtcttgaatgaagggctctcacttcaaatgtctcctcagactttgacttctcattttaaagtagtcctccaggtcgctctctgatagatcatcttattttctttgtagcacagctaaaatccaaaatgtttatttttgtttacttgcccgtctcactttgcactaggatattgtagactgttcaataaataagttttgtgtaaataagaatcactagagagcttattaaaatgctaacttgggagtttcttcagagactggtttagttgatttggtgatgactccatgtgcctgcatttttaacaggtgccctgtgattttgatgctggtggtaccaccacactttgaggaacacagatttaaatattttgaggagaaagtacaatctgtttaccgttggagtatttgcaaaatcaaaatagataaattagttaatattgaatctcaatagtgagctttttaaagtgtttttgtgattttttggggggtgctttttcaggttgaggcagaacagctatcagtagtgggtatatatacatttatactttatcaataaaaatacagatttgctactcaggaggctgaggcgggaggataacttgaggccaagagttcaagatcagcctgagtaacatagcaagaccctgtctctcaaaaaatctttttttaaataggaatcatattgatgcatctgaacaaactctcagatgaactcttgaaggagatgaggctacctctgagatggcacaatgatgtggctgaagaaatgaattggtattaagttgcattgggttctgctatttttttttttttttttttgagacagttttttactcttgtcacccaggctggagtgcaatggtgcgatctcggctcactgcaacctccacctcctgggttcaagtgattctcctgcctcagcctccccagtagctgatattataggcacccgccaccatgcccacctaattttttgtatttttagtagagacagggtcttgtcatgtaggctaggctggtctcgaactcctgacctcatgtgatccacctgccttggcctcccaaagtgctgggattataggcgtgaggcaccacctggcctcggttctgctgttagttagctacgtaacccttgggcaaggaacctaggaagtctctccaggtcttgcaatacgaagaggctgagttcctatcccgttaggttatatgattctattgtcttttatgctaacattctgtatgtacatacgtttaatgtccttatagtttgtggggaggaatagtggaatcaccatggaaaaatcattctgttactgaattcttcaacttactgtggactgggcacagtggctcatgcctgtgatcccagcactttgggaggccgaggcgggcagatcgcttgaggtcaggagttcgagatcagcctggccaacatggcgaaaccctgtctctacaaaaaatacaaaaatttgccaggcgtggtggcaggcacctgtaatcccagctactcgggaggccgaggtaggagaatcacttgagtcttggaggcggaggttgcagtgagctgagatcacgccactgcactccagcctgggggacagagtgagaatccgtctcaaaaacaaaacaaaacgaaacaaaaaaacttactatgaaaagtctgagatggcaacaatcatgtgtaagtgggagggaaaacctctgagtgtagtgtgaagagcacttcctcatagtgtttctgtctgtttatcacagaccatgctgagccactctgaggagtcttctgtttgagccctcggaatttcttgtccctggagtgtgtatactatatgacagttctggcctcagtgtgacttaactggtttggggactttttaggctctactttttctgactctcctcttcaacagaaacaagcttgagtgtttgaatgatcatgtggtactccaccaacaaccagtcattaacgatgtgtccaagattgctgaaatacttctcacaacttctgtctagcattgtggtcaaactacctgaattcatttttgagctctaccatttactactggaatgaccatggataagttacttaacatctgtaaattgggagtaataattacacctacatcatagagtttttgtgagaattaagagagttaatgtgttgcaaggtacatttattgggagcttacatgggaagcccccaataaattgtagtagtgttatttcggtaatttttcatttgtccccccgttgtctttgtgactgtatctcacagcaaacagaaagaagaggcaggggggtaaattgtggttttaaaggcttttctgatgtctactgatatgtacagcatgcatgataaatcatttgagttccaaatcttctagttacctagatcttgtaaaaacttataaactaatgtcctaaatcctaagtctttataatgtctagtatttgtacatcaaaagccctagttaggggactttaattacttttacttttctcatggattctgctgtcagtgggtcctaaatgagaataccttaaagcagtgattctcaaagtgtgggccacagaatgctggggtgggggtgatggtagtgaccgtgtcactgagacccttttagaggtgcacaagtttaaaactattttcataattacactaatttgatattctccttattcactgcgctgacatttatattaatggtgcaaaagcaatgatggataaaactgccatcacctctgcgtgaattaagatggtgagtgactccatttgggaggccgaggtgggtggattgcttgagtccaggagtaggggactagtctaggtaacatgatgaaaccctgtgtctacaaaaaatacaaaaaaattaaataggcatggtagtgcgtgtctgtagtcgcagctactcaggagactgaagtgggagaattgcctgaggcacggagtgtcgaggctgcagtgagccatgattgtgccattgtactccagccttggcaatggcgtgagaccctgtctttaaaaaaataaaaaaaataaaaaaataaaaaaaaaggataatggctccaagccatactataaaagtcattgcatatttactttcacacacttagagaaagaacaaaaataaacctatgtcattgtcacttaatatcctttatgaaacagtaacaattactatattacattttgatctttaaagctctgtgtgatgaagtgggaaatgtgcctaaaatgcttctgctgcggacgaaagtggaagaagagtacttgtgcagttttttgagttccaagctgaatttgctttttttcatagaaaactattttacttgaaactatggttttacttaaaaactatggtttttaggcatgggtatttggcagccattttctcagaagtgaatgaattgagcctgtcatttccaggaaaacaactgacatatgttgccagtgataaaaattgagattttaaatgaaaattagaattttggaaaattggtatttgctgccatgagctggtcagtttctcagtatttaaagactttcctgaagagattggtggtgatattaatgaacgtgaatttttttgatattgtgtaatgtcaacatttcaaagatctgcgtagcttattgcaatatattctaaatgagaaatgcatgatgttaagtgcaaaacagagcaataataaatagattgtattttattttattatttttattttttgagatggagtcttgctttgtcacccacactggagtgcagtggcgcaatcttggctcaccgcgacctccgcctcctgggtttaagcagttctgcctcagcctcccaagtagctgggattacaggcacacgctaccatgcctggctaatttttgtatttttagtagagatggggttttgccatgttggccaggctggtcttgaactcctgacctcagttgatctgcccacctcagcctcccaaagtgttggtattacaggcatgaaccaccactcccagccaataaatagattttaacgcgagagagtagtcaagtttatttttaaggtttgagatgccacattgcaactgatgtttaaaaaataaatattcttcttaagtttttgtgttatatcaaagaaaaatatccacacaatgatctgaaaagggtattaaaatctgcttttcccttttcttagatacttagctgtatgaagccagattttctttatattcttcaaagaaacaacatattgaaacattaaatgcagaagcatatatccagccatattctattaaaccacatgttaaagagatctttaaaatgtatcacaatgacactctttattaatttttttttgttttaggaaatacagttatttctgatttttaaaagtgttgtttaaacctgtcgtgccggacatggtggctcatgcctataatcccagcactttcgaaggctgaggtgggaggatcacttgagcccaggagttcaagaccagcctggggaatatagtgagactccgactccagaaaaaataaaaaaattatccgagtgtggtggtgtgcgcctgtagttccagctactcaggatgctgaggtgggaggatcacttgaggctgggaggttgaggctacagtgaactgcgatcatgccgttgcactccagtctgagtgacagtgagactgtctgagaaaacaaacaaaactagtaataaagtaaacgtcattttaacattttaaaatttaagattcatttttaattcatcttgtaatgaattaaaatatatttaaaacatccatttttattatacatttgatggtcataccccatctaaacaaaagctctttgtgttcctcagtaactaagactgtaagagaggtcctgagaccaggaagtttgagccctgctctgttaaaggacattaagaacatgataatgtctcagagtctttgggccagtaggaagaatgtcagatcataagatagtaggtggcagatttatacatttatagttcttcattttggagtacccataacagttcagaaaaagcctccctttagtaaaatgtaaaaatgaagaaagtacttattaactgaagttaaacttctaaaaataggtcactatagatctactgatttttttcatgtttatgacagtctatctaagccaacttcagagattgggctcaggatggtagataaattaacctctgtctcttctttggccacaaattgcacatctatccctagccatttgactcaaggggaagtgggaaaaagaacaaggatggataaacataaatataccatttttagaaaaatatttaaagcctatgccccagtgatgagtaaatagcatgcactatatggtactaatgagtacatttgaatgcttattatatgctatttatgttccttttgtgaattatttgtccatgtgttttatgtttttctttagattgcttacattttttgttttgatttacaagaattcttgacaaattctgtatactgatcctttgttgatgatgtaggttgaagatttattctgagcctatggcttggtgtggtagccagcctctaagatggccccttgttccttttctcctgttattcacaccgttgtatggttgctgtccagttgctcaaggctggtctccgtgaccaagagaatataatagaattaatagtgactttattaaaaagtcattaaagccatatatacagttttttccttgctctttgaatcccttgttctgggtgaaaaacagctgtcattctgtgaaagatactctagtagtcctttaaagaggccatatggagaaaaattgaggtcttctgcaaagacccagcaccaacttgccagctatgtgaaagagccgcttttgaggtagattctctatcctaatcaagctttcagatgactgcagtccttcctggctgacatcttgactgcagccttcttagaggcactaagccagaactgcctgccaagtccctcccaaattctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggttttaccgtgttagccgggatggtctcgatctcctgacctcgtgatccgcccgcctcggcctcccaaagtgctgggattacaggcgtgagccaccgcgcccggccccaaattcttgtttcaagaaagctgtgagaaataattattgttgttttaagtcattaatttttgaggtaatttgttacatagcaatagataactgatacactttttagagagctgtcttttcatgtttttatattaaaatagtttttcctccttttttttttgctgttcttagtagctttataataataagcagtaagttttgttcattaaggtaatttcactgccctctctacgtataccttggtcatcttcaagattatctcgactgatcttgaccttttgctcctttttttttttttaattaaaaaatttctttttccaagacaaaccttggccattcaccttttgctcactcttatactaaaatgtattatcttgtgaaagttcattttaaaaacttattaagctgtgtgtggtggtacatacctgtagtcccagctactcaggaggctgaggcaggaggatggcttgagcttaggagtttgaagctgtaatgtgctatgattgcacttgggaatagcaactgtactccagcctgggcaacacagagagacgccgccatctctttaaaaaagaacagaaaaacaacgacaacaaaaaacctgtcagtgtttttgttggaattgctttgaatatgtaaatcagtttgggagaaaatgtctttattgtgtctgcctatttatacacatggtatgcctccacattttcttaagtccaaaaatgtttttgagtgtatattttgagacagagtctcactttgttgcccaggctggagtgcaatggcacgatctctgctcactgcaacgtccgactcccaggttcaagcaattctcctgcctcagcctcccaagtagctgggattagaggcgcccgccaccatgtctggctcatttttgaatttttagtagagacaggatttcaccatgttggccaggctggtcttgaacttctgattctgagctcaagtgatctgcctgcctgggcctcccaaagtgctgggattacaggtgtgagccactgtgcccgacctattttttaaatgtctcaggtatactgatttcatatttatatttgataattccattatctgatgttcttgatgtcttattttactgcttgcttctgcctgctcatttgttgtgggtggtgtcctcctgtgttttatagttttagacagtgagcctgttcactagggctttatgaaatctgccagactggttttagggaacaagcctccagagggtattttgcatttgcttctgtcaggtgccaccaacacagaaattactgaagcagacttttagtttactatatcttagtattgtcagatgttgatttagtgtttaccttataggctggcttgtatttagaaattctcagaattatacacaatgtgggtgtggggaaaaaaaaaagggaattctcaggagaaaaattttttccttaccccgaacccagacagtgacagatttcttcatttccatgctgttggtcagatttttttttttttaatttcactgttctttgcttatgcaccctaataactgaggttgtaatcgttcaagtcagttttaggaagatgagtcttgatctaattaatactttacacaggccctaggctcccatgtcttccccattctttgtttacgcccttgtttgtacatcctaaagaagagtcactaagagtataatttctgagcctttgaatttttgaagttttctttattctactcccttcttaaatgatagcttggctggatatgaaattctgggttaaaacttttttcctcagaacttttaaggcatctcttccagtgtcttaaatcagtgttgctgatgctactctgattttactcctttgtacaaccccagttgggtttcatttgtttatttacctcttcttgagatctttttatctttttatgtcttggatctcttcatctatttatcagttgttttgaaatatagtgatatgcttctatttttttttctaaaagtttctaaaagttcattatgctttttcatttagtcttgtaatcttcatttatagtaagagaactttacatttttttcagaaggtccttccccacctcccactcttattgaactattactatttggatgttggctctcctaggttcatattctccgctgtctttttctagtttccttccctttgttttcttgctccactgacattctgaaagatcttcttgtccttgtctctaacccttttatccaatttattaattacattgtacatttcttttttttttgagatggagtctcattctgtcacccagactggatggctcactacaacctctgcctccctgggtcaagcgattcttctacctcagcctgctgaggagctggaactacaggcgcatgccaccacacctggctaatttttttgtatttttagtagagacgagtttcaccatgttggccaggctggtcttgaactcctgacctcaggtgatccacctgccttggcctcccaaagtgctgggattacaggcgtgagccaccgcacctggcctacatggtacatttctaagagcttccttgcttaggttgtatttttataagattctgttctttttctgtggacttaatatcttctttctctgaggatacaaatgtttttcttccccaggcaaaatatgtattttactttatttttcatttgactttttacttttgaaacatttcaggtatactgattccttatttatatttggtaattccattatataacttttttttttttttttttttgagacagagtctcagtctgtcgcccaggctggagtgcagtggtgcgatctcagctcattgcaacctccgctcttggattcaagtgattctcctgcctcagcctctggagtagctggaattatagacgtgtaccactgtgcccagctatcattatataacatttttgacatcttattttactgtttgcttctgcctactcttgtttatcttctattccctttattatctgttttacttttttttttttcttttgatctttgtgtttcataggcttcctcgagcaatagatgatccttggttgtctccccacttgaatgaggcaatacagttctgatggaagattctgtgcttctgtgtggggcctgttaattgttgggcattgctttagatcagggattggcaaactggcccatgaactaaatacagtcaactgtatggttttgtatgacctgtgagccaagaatgatttttatattttaaatagttgggaaaaaagaatattttgtgacacatgaaaattattagaggccaggcagggtggcttacgcctgtaatcccagcactttggaaggccaaagtggacagatcacctgaggtcaggagttggagacaagcctcgccaatgtggtgaaacctcatctctactaaaaatacaaaaaaaaattcgctgggtgtggtgacaggtgcctgtaatctcagctacttgggaggctgaggcaggaaaatctcttgaacccgggaggcagaggttacagtgagccgagattgcgctgttgcactccagcctgggcaataagagcgaaaactccatctcaaagaaaaaaaaattttaagtgtaaatttgtgtttagaaatttttatttgaacacagccacgcacattcatttatgtattgtctttgactactttcatgctataatgggaaaattgagtagttgtgacaaatactgtgtactgctttttggtacattacaaattgcagtgatgcagctataacttgatagggatgtgtatggctgtagcacaacatttaaaatttaaaaaattgtccaaaatattgcatacctatcatttcaaagaagagtgagtggattttaaatgtcatgcttttacagcagagtacattttgttttgagttagatggcaaagcatggtgtttattatgtacttacactatagctgtgctgaaagagtacagtgttttgttgacaactccagagtaagcactgattacattattcccaactcacaggaaagtaaaaatcagaaataagaaagtttaaaatggaatatctgatcacagcagaatttcttaaaaataaaaaatgaaaatgaggctcttcaaacatgggaagtttttgagtggctcattcattagccaaacagggatagctcttcacctgtggtgagttaattaaaattttcccaattaaatgagaattttattcttctcattggtagacctgtattacaaaaaaaattactcaattattatattttgaatttgtagataaaaattgtggaaatttttctttcattatgtaaatacctacatactatccttgatacttttttcctaaacaacctaagttatttactatgccttgtgatgccacatcccatgttttcatttgatgggacatgttaggtgttggttatgaatcagatttcaggcagtgttgtgtgtacagcctgacctgttgtccacaatagatttggaagaatgagaatttacagggttctacttctaacatcacaaatgactgccagaatgaattccacaaatgaattttggaccagtctggcctgtcatccatgtgtggtttattaatagaatgctaaaattcaaattacacaactcatttcttttcccatcactgagggttggcttaaatactatccctcacaaagtaaatacttaagcaaaaagctaatgtcagtcaaaagatccccatcagttttttgtctgccgtagggcagatatgagggtaaggtattgagaatcatttcactgtattactgtgcttatgaatctgaagtattgaaagtaataagagcactgcatttcagctgtccttcgtatattacattttctgctttgtgttgaacattaccttcatttgttgtgaggcatataaaagggatgtatgtaatgaaccttggacccactgaatctcgctggagaggtaagagattatattaaagaacagtataatacattttataataaattagtaataaatttgatttcagtaaaccagatatttgttgaaatatggttcaaaagaattagtcatagctgaaatttactatttctgctcttaatgttggtttggaggtgattccctctttttcatttgtgtattatatgattttagtccttatgcttttggctgtaatctaggctgctcttgacatccatccaattttctcttctctgttttccttcctcaatttatgttgaatgctttcaaagtagattatctgaattaataatggcaggaaagaactagctgtggataagtttatttgaatctgtctagacttctgttccttgtctgtaaaataacatattttgttatgttttatcttacgttaaagataaaactttttcgtgttatcttatttgcctataaaaatcctctcagagggaagactcattctattttgcggaatgaagttttgcccaattaaaaagaattatttcagggtgataatattatccttgtttcttttttaaacaaatgaggccaccgaggtaatgtggtaaaattatacctaaatgtggcctttccatgttaagctgatagcacaaactcagatgccttcaggaactaggaaagtaactagtataagacattgagagtagtgaaacttgcctagccttcttgcatttaaaaaatactctattttggcaggcatgggggctcacacctgtaatcccagcactttgggcggccgagatgagcgaaccacttgaggtcaggagttcaagaccagcctggccaacatggtgaaatcccatctctacctaaaaatacaaaaattagccaggtgtggtggcacatgcctgtaatcccagctacccgggaggctgagtcacgataatcgcttgaacctgggaggtggaggttgcagtgagccgagatggtgccattgcactccagcctgggcaagagagtgagactgcctaacaataacaacaacaacaacaactactctattctggccaaataataccagttaggctgccaattttctgtttttgtcctgacttggtagaatctgattagtcatttttaaggtggatgtaattaatttatagttagtttgatttcataatttttaaaagtttatttaagtacttaagtaaactagcattatagtttaatttgcagatctgtgagaaccggtaaagtccaacatcttttagtacggctgttggcctttgaatatcattttttgtagttgcctgttcgggttgtgcttaccttttcccctgtggtttgtctaccttttttcccagtgcttttgtaggattctttatatattccaatcatgactcttttgtcaggtatatatcctattttatggcttgcctagcagttgtgttttaaaatgttaaatttattttagcttttgagtaaacagtactttcccactggttgaaaagttaaataagtatacgaagctggatattgagaagcctccctcccactccttatcctcatccagttcctgtctcccccaacacataacctgtgttaatactttatctgtccttccagtatatccaagtgatactggacaatggtgccagatccattcagtggcagaaatattggtatcttcaaaaaatgacattgggccaggcatggtggttcatacctgtaatcccagcactttgggagcctgaggcaggaggatcacttgagcctgaagttcaagactcgcttgggcaacatagtgaggccctgtctctaaataaaattaaaaaaaaaaatggcggggtgcagtggctcacacttataatcccaacactttgggaggccaaggtgggcagatcacgaggtcaggagatcgagaccatcctggccaacctggtgaaaccccatctctactaaaaatagaaaaatgagctgggcgtggtggtgcatgcttgtaatcccgctacttgggaggctgaggcaggagaatcgcttgaatcaggaggcggaggttgcagtgagccgagatcgtgccactgcactccagcctggcaacagagcgagactccatctcaaaaaagaaaagccagatgtggttcacgtctgtggtccctggtaggtacttgggaggttgaggcaggattgtttgaacctggggaggttgaggctgcattgacctgtgattgtgtcactgcactgcagtgcactgacagagcaagaccgtgtctcaaaacaaaaaaaggatgttggtacaactggattttcacatgcaaaggaatgaagtcatacccctacttcacaccatatgcaaaagttaactcaaaatatatcaacaggctgggcatggtggcttacgcatgtaatcatagcactttggtaggctgaggtgggagcattgcttggggccaggattttgagatcagcttgggcaacatagtgagatcctgtctctacaaaaacaaaacaaagacaagtaacaacctaaataaagcatgagcaactaaagaaaaaatagtaagtcggacttgatcaaaatgtaaaacttttgtacattgaaggccattattcagaaagtgaaaagaaaacctgcagaatgggagaaagtatttgtaagtcatgtattggatgatagtgaaatatataaagaactctcacagcctgataataaagacaacccaattaaaaatgggcaaaagatctgaatagacagttccccaaagaagatatgtatatatggccaataagcaaatgaaatgatacactagatcgtttgttattaagagaaatgtaaacaaaaccacaaggagataccacttcacacctgctagggtggctctagttaaaaaacaacaaagtgttggcaaggatgtggagaaattagagtcctatattgctggtggaatgtaaaatggtgctgccactgtgggaaacagtttggtggttcctcagaaagttaaacataaaattagcatgtgacctagcaaatccattcttacatatctgtgacccaaaagaattgaacactgggactcaaacagatacttgccagtattaattgcagcattattcacagtagccaaaaggtggaaataatgttaagtgttcaacagatgaattgataaaatgtatatacatgtaatgggatattatttggtcctgaaaaggaatgaatttccgatacatgctgcaatatgagtaaaccttgcaaacataagtgaaataagacagacataagagggcaaatataagattatacttacatgaaatgtccagaataggcacattcatagagacagaaagtagactagaggttaccaagggcttgcagggagaatagggagggaatagagagttgtttaggatgggagtgggggaggaatgggcgattgttgcttaatggatatagtttctgtttgggatgataaaaggttttgaaaattatggtgatggttggatggttgcacaacatgttgaatgtagttaatgccatataacatacctgatagttgtatacttgtatacataatatacatacataatagttcaaatggcaaattttatgttatatgtatataccacaataaaaatgttaaaatatgttaaaaatgtttttccttctagaaattttaaaatcatgtgttttaaagtacgttttattgtatgttaaaaattgattctcattcatggattctgtgttttagaattcacctacatgctaaaatttatttgtaaccccagtattaataatagcagtgccttcacagtcatccctacacatgggcagagcagcaaaaaatttgactcgcccaattcacatattcccagctgaggtgaaactgggagatgctttgccttctttcagcactcatagcataaatatgtgtccttgttgtggccatgttctcattgtgctttttgttgacttcactgcttcaaatggccctaaatgtaataaagctgaagtgccccgtagtgttgctaagtgcatgaaggatgtttgtgctttatggagaaaacacgtgtaaggtaagcttcattcatgtatgagttacagtgttttggctttgaattcagtgttaatgaaccagcgatatattttatttatttatttattttgagacagggtcttgctctatcacccaggctggaatgcagtggcccagttacggcttactgcaacctttgcctcctggtctcaagtgatcctttcacctcagcctcctgagtagctgagactacaggcccatgctaccacacccagctaattttttacattttttgtaaagactgggtttcaccatgttgcccaggctggtcttgaactctggactcaagctttatctacctactttagcctcccaaagtgctgggattatagacttgagccactgcatccagccctcagcaatatgttttaaagtgactttaaatataaatgcatataaaaatgttatgtattgactggttgatgaaaattttgtgaccagaggcttgcaggaacctaatcctgcatttcctctaggagcaatagtttagttaatttgttaatttattgtttgcagcaactgtatagaatataactactataaatgatgagaatcgaccctaggtcaatgcaaataaaattatttcttttatataaatggcaacacctcaagatctttctctgaaaagtacatagtttcctttgatttttgttctgaagtctatttgatcttatattaatatagccactcattaaaacttaattcacaaacgatatgttaatcacacatttgaagtgtatggttcagtagtttttagtatattctgagttgtgtaaccatcaccataatcaattttagagcatttttattactcccaaaagaaaccctctaccaattagcagttattactcacttacccccaaaccattccccccagacttaggcagccattaatctactttattgtctctatagatttgcctattctggacatttcttacaaatcgaaatatacgatgtgtggtcttatgtggctgaccttcgccttcatctgtgctgtagcatgtatcagtgcttcattctttttttaaatactttttaaaaaaactagtcaagtgcagtagtgatatgaggagagagtagagcaaagacttagatctgtaactgactgaacaatctgttgagataactcactaccttcaagtcagccagtacttcactatttttaggcctgaataatatactcttttatggctataccacattttgtttaaccattcattagtaaatggacacttgaattgtttctcttttttggctattatgaacagtgctgctatgaacatttgtggataagtttttatgtgaacatatgttttcatttctcttgggtgtatacttgagagtgcaattgctgggttgtgtggtaacttatatttaatcttttgaggatctgccaactgttatctgaagtggctttagcatttttctttaccatcagcaatatgtatgagggttccagtttctctataatgttgccaacaattgttatcttttttattgtagctatcctggtgggtgtgacatagtatttcattgtggttttgatttgcatttcttttgtggctaatgacgttgagcattttcttttgcacttattgaccattagtatatcttctctgatgaaatgtctgttcagacttttgtccattatttaattaggttatttgacattttaaagttgtcagttctttatgatagtctggatgttctaccctttttcttaattttttttttcttgtctttcttttttctttcctttccttttcttttttttttttttttttttgagacggagtctcgctctgttgcccaggctggtcttgaacttctgggccctaacaatcttcctgcctcggcctcctaaagtgctgggattacaggtgtgagccaccatggccagccctgacgtgctgcacccttatatctgatttagcgctatcttctatttgtgggttgtcttttactttctgtctgggattatttgcagcacaaaagttttttgtgtgtggaaaaataacatgtaacaaaatttaaccattttacccactgttaagtgtgttcattggctttagttatattcacagtgttggcagcacatgttttttttatttatttatttattttttgagacagggtcttgctctgttccccaggctggagtgcagtggtgcaatcacagctcactgcagcctcaaccttgtgggctcaggtaatcctcccaccccagcctcccaagtagctgggactacaggtgcaccactgcacccagctaatgtttttatttttttttgtagagacaggattttgctgtgttgcccaggctggtctcaaactcctgggtccaagcgatcctcttgcttcagccccgtaaagtgcttggattagaggtgtgagccactgcacttggccacaaaagtttttaagtttgatgaggtccaatttatattttgtgcttttgtttttcgcaccatatctgaaaaatcatttcgtaatccaaggtcatgaagatgtattcttatgttttcttttaagagctttacagttttaggttttagattcagattctctgataaagttgagttaatttttgtatgtgaaatttgtttgtgaggtaaagatctagtttcattcttttgcacaaggatatccattgtccctgtatcatttagtgaaaagactactctgtcctccatttaattgtcttagcaacctgtctaaaattagttgactgggtaaatgtgagggtgttttcctggacttaatttcattccattgatctgtatgtctgtctttatgccaataacaaaattaaacaacaacaaaaacagggtctcactctgtcacccaggctgtagtgcagtggtgcactcagggcttactgcagcttccacctcctgggctcaggtgatcctcccacctcaccttccccagctgagactacagatgcgtgtctcacaccactacagatgtgtggctacaccacacccagcaatttttttattttttgtagagatgggttcttgctatgttgctggggtgggttgttctttttcaagatcgttttggttcttctggatcccttgaattttttttggtttttgttttttaaaggacagatcttgctctgttgcccaggttggagtgcagtgatgcgatcatagctcactgcagtcttgacctcctgggctgaagcagttctttcacctcagactcctagtagctgggactgcagccgcatgccaccacgcctggctaattttttaattttttgtagagatggggtcttgtattgttgcccaggctggtcttgaacttctgggctgaagcggtcctcccgcctcagcctctcaaagtgctaggattacaggtgtgagccactgtgcctggcctccatcttcttttaatgtacttacattattgtgtttgaagcttcttgtattaatagatagcattactgttagattatggtttaagtttattcactcttctggtctttatttagttcatgtgtttaggagtatttaaggtatgtaggtatatttaaggtaattattgatgtgttatggcttaaatatgttattgttttctgtttgtttcctttgtttctcttgacttcgtttgagttacctaaagttctttttaagattccgtctttatttatggtggttttgtgtagtttatagtttttggagtgctttgaatagcgtcttagatatcgcaacgtttatttgtaacttaaagtctttgtattgacattttaccatttggagtgaagtatagacgttttacttctagttaggtccctttactcttcctagttttaaaatgattatctttaattttctgtctatatagatgaccagataatatatgatcttttttataagctctcacatgatttaagaaatccatgagaagaaatctattatatttactctcatttttttttttttttttttttttttttgagacggagtctcgctctgtcgcccaggccggactgcggactgcagtggcgcaatctcggctcattgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttactctcatttttatcattccagtgttcttttccaaagattcaaggttccttctgttaacattttttttttctgttacggcaagttttctttaaccatacatgcttttaggggtattagtgacaaatttttatatattttttcatctgagaatatctttagttgtccttcattcctgaagggtatttgttgaatatagaatttgcatttctgagttactttctttcagcctttgaatgatgttgagccaggttgttttttttttttttttttggcctgcatggttttacatgagagatccactgtcatttgaatagatgttcctctgcaagtaaagtggtcattgtctgctttcaagatttttttctttatctttcagaacttttatgatgtatcttggtgtggatttatttgggtttttcttatttggcattaactcagtttttttatatgtaggtttatgtattttgtcaaatttgggacattttcagtcattatttgttcaagtaattttttttttttttttgagacagagtcttgctctgttgcccaggctggtgtgcaatggcgtgatcttggctcactgcagtctccatttcctgggttcaagtgattcgcctgcttcagcctcccaagtaactggtactacaagcgtacgccaccatacctggctaatttttgtatttttagtagagatagggtttcactattttggccaggctggtcttaaactcctgacctcaagtgatccacctgccttggcctcccaaagtgctgggttacaggtgtgagccactgcacccggcctgttcaagtaatttttaaattttatgtactcctctccttctggaactctgcagctctggtgacagcaatgctagctagctagttttttattgttccacaggttcttgagactgtgttctgtttttcttttcttttcttttggtctcttgattttgcctgaaggtcagttattctgttgcctgttatcttctcttgtctattgagcccatttattgagttttaaatttttggtttttgggttttttttttttttttttttgagatagggtcccactgtgttgcccaggctggagtgcagtggtgtgatcttggtgccacgacaccggctaatttttgtatattttttgttagaaacggagtttctccatgttggtcaggctggtcttgacctcctgacctcaagttatctgcccgtctccatttccaaagtgtattttttaatcctataatttccattggtcttttttttctataactttcatttcttttctattttccatttgttttaaggacattcgtattgccgttttaagatgaggtcttactctgtcgcccaggctggggttcagtgttgcgatctcagctcattgcaacctcttcctcccgggttcaagcaattctcctgcctcagcctaccaaatagctgggactacaggtgtgtgccaccatgcctggctagtttttgtatttttagtagagatgggggtttcaccgtgttggccaggctggtctcgaacttctgacctcaagtgatctgcctgcctcagcttcctaaagtgctgggattacaggtgtgagccactgtgcctggcttatattgctttttgaagcattttcataatggttcccttaaagactttgtcagatgtttctaatatgtgatatctgatcatcttggtttgggcatgtactgattgtcttttgtcagttatgattttcctggtgtttgacaaataattttttgagtatattgcaaatattttggatatcacattctgagacttgcgattctatttaatcttcatttttttccagcagtctttctactgaggtataacataaaggccaggtagggtgtatgttcaccttccccttgggcctcctgacaccaccctggcaaaagtggagtgctgactttctctgccatgttgcagataggtgagatgaaagttcaatttctcccttggtccttcctgatgaagtggggtaccaactcataccaccttgtcacctctgatttagggtttaagttcagttccactgagcccttgtgataccagggagggaggaaatgtagggctaactcattccactggattgctacataataggggtggagtctcagctttccacttggattttatcataccaggcaaagggataagaagtgatgatttgcctggtctcttacccccttattccttattattgccaggtgggagtagaagttcagcttcctgctattccctactgatattgaggagtaggagattttttttttcagtatttttagttttaaaaaaaaaatgggggcttcaattaaagtcgcctttatttaagatcccagcagtggaaatactgagttcttttggtcctaacattttacagattatagtcgtgagattatggaatcatgactcactaaattcatgcttttaattcctattctctgcaaggcagtgttagattatctctgctcttgggagtttggagttttggagactttaataaacacgtactttttttttttttaaaagacagagtctcactctgtctcccaggcgggagtgcagtggtgtgatctcggctcactgcaacctccgcctcccaggttcaagtgattttcgtgtctcagcctcccgagtaggtgggattacaggcatgtgccaccacgcctggctatttttttgtgcatttttgtatttcttatttttatttttggaggtgtagtctcactctgtcatccaggctggagtgcagtggtgcgatgtgggctcactgcaacctccacctcctgggatcaagcaattgtcctgcctcagcctcctgagtaactgggactactggtgcacactgccatgcctggctaatttttctttatttttagtagagacagggtttcactgtgttgcccaggctggtttcgaactcctgagctcaggcaatctgtctgcctcggcctcccaaagtgctaggattacaggagtgagctaccatgcccagcctaatttttgtatttttaatagagatggggtttcaccatgttgaccaggctggtctcgaactcctgacctcaggtgatccacccgcctcagcctcccaaagtactgggattacaggtgtgagccaccatgcccagcctaaacacacatttttaaagatgaaaaggatgaccagtataattcttgcaaatgaaacaatttgcaggtcagagtcttgatggttagttagccaagttttttttatttttttaccagttcaattaaaaaattatttagaaaaagtaaaacgtgggcatggttagagtttcaaacagtataaaagaatataaaataactcatttaagtctgtaagtttccaaagtatgaaatgctgactatctcatctttattataaaatttgaaacaacacactaacaagctcttaagagctccttgaattttgtctggcagaccattatttcaaaataaaacatctttttgcaaactcagttatgtacatttttatttagcacaactgcctgcttaacatcttttcttgagtgacccagatgtgtctcaaatttactgtctctaaacttgaactaattgtagtttccaaacctccacttacaaactgtaacagtcatctcattgttccggtttcctaaaccagaaatttgggcatcgttttcatctcctcttctaatactcctctactcctcagtctgtagttttctagtaatattttatctgtgatgtctttgtcttatgtctttggtaacagggtgatattggcctcttgaaatatgttttttcttctctattttctaaagagtttgtttgaggtttgtattatttcttccttgagagaattcaccattaaaaccaactggggccgggcacggtggctcacactgtaatcccagcactttgggaggctgaggcgggtggattgcctgagctcaggagtttgaaaccagcctgggcaacatggcgaaaccccgtctctactaaaaatacaaaaaattagctgagcgtggtggtgggtgcctgtagttgcagctactcgggaggctgaggcaggagaatcacttgaacccaggaggcagaggttgcagtgagatcatgccactgcactccagcctgggccacagacagagactccatctcaaaaagaaaaaaaaaaaacccaactgggtctggactttcctttttgtagattttaaattactgatctagtattcagattgagtttttctatgtcttcttgagtcagtttggtaaaaattttttttttcaagacagggtcttgctttgtagcccaggctggggtgcagtggtgtgatcgcagctctctgcagccttcatctcataggctcaagcagtcctcttgcctcagcttcctgagtagctgggactacaagtgtgcaccatcgcacctagctaattaaaaaattatttttgtagagacagggtcccactgtgttacccaggctggtctcgaacacctggtctcaagtgatcctcccatctcagcctcccaaagtgctgggattacctagctggtaatttgtatttttaaagaatttgacccattttgttttagtggtctaacttggcataagaggttcatagttctattagtccattctgacactgctataaagacatacctgagactaggtaatttacaaacaaaagaggtttctctggttcttcctgctgtgcaggcttctgcttctggggaggccttaagaaacaatcatggcagaaagtgaaagggaagttaagcacatcttcatacggctgacaggaggaagagagagtgaagggggaagtgctgcagactttcaaacaaccagatctcatgagaactcagttactataatgagaacagcaaaggggaaatctgcccccgtgatccaatcacctcccaccggggccctcctccaacattggagattacaattcaacatgagatttgggtggggacacaaatccaaaccatatcagtaacattttggcaggatctcttgttaagtcttatatttcatttttggttttggcacaatgtgctctcttttctttttagatcaataccaatctgtcttctctatctccccccatctccctccctgcactcattttcccatctaggtaattgtttatcagttgttttcaaagaaccagctttgagtttcgttcccctttcttccctattcatagctactctgatctttatttcgtcctatgtaatgttttcatttggtcttctttttcgagcttaatgaggggcatgttgagatgattgcttttagatgtttttttcctttctaatatatgtctttgaagctatacatttctctctaagttcatggtgttaaatgtggtacctaatggccatatgtgacaaaattaagcgtaaatgaaattgatgatttacttccttagtcactgttgtcacatttcaggtattcagtaatcatgtgtggctgatggctgccatattagacagtgcagatatagaacattttgtcatggcagaaagttttgttggactaatggcctgtaatcccagctctttgggaggccgaggtgggcagatcacctgaagtcaggagttcaagaccagccgcgccaacatggtgaaaccccatctctactaaaaatacaaaaatattagctgggcatggtggcgcacatctgtaacctcagctactagggggctgaggcaggagaatcacttgaactgggtaggcggaggttgcagtgaggtgcgatcacgccactgccctccagcctgggcgatagagtgagactccatctcaaaagaaaaaataaatgtttaagcactctttcagctgtatcccatggggaggaaaaaaccaatataaaaaaatatatatatacacacatatatatatatatacacacatatatatacacacacacacacacacacacaatatatatatagttttttttctttttttttgtttttcttgggttttttttcggacagtgtctcactctgttgcccaggctggagtgcagtggcgcaatctcagctcactgcaacctctgccacccagattcaggcgattctcctggctcagcctcctgagtagctgggattataggcgtgtgccaccgcacccaactaatttttatagttttagtagagatggggtttcaccatcttggccaggctggtcttgaacccctgacctcgtgatccaccaccttggcttcccaaagtgctaggattacaggcgtgagccaccacatctggcctatggttttaattttgtgtttggttcatttacatttataattgttacatgtatctgatgtattgattctttaacatataaaatgcttcattttacttagtaatatgctttgagaatctttttttcttctttcttttttggagacagagtcttactctgttgcccaggctgcagtgcagtggcgtgatcttggctcattgcaacctccgtctcctggggttcaagctattctcctgtctcagcctcccgagtagctgggattacaggcatgcgccaccacacctggctaatttttgtatttttagtagagacagggtttcaccatgttggccagactggtctcaaactccggactccaagaatctttttttttctgatgttagtgtgactactccagctgtcttatggcaacagctttcatgattttatcttctcctctccttttactttatccctatttattcatgattttatcttctcctctccttttactttatccctatttatgtatttgaatctaaaaatgtttctttcagaggatatatagttggattttactttttatccagtttgacaatctcttcttttcattggagtgtttactcagtgatatagttggatttaggtatgccattttgctagttgttttccgtgtgtcatttttgttcttttccttctttactgagacttctatgtttaccaatatttttagtgtaccttaaaattttcttttagtttttgttttagttttaactcttgcaattatgatatctctctttttttttttttttaaggcggggcagggccttttcacttctttttttttttttttttttaaattgatcattcttgggtgtttctcgcagagggggatttggcagggtcataggacaatagtggaggaaggtcagcagataaacaagtgaacaaaggtctctggttttcctaggcagaggaccctgcggccttccgaagtgtttgtgtccctgggtacttgagatcagggagtggtgatgactcttaaggagcatactgccttcaagcatctgtttaacaaagcacatcttgcaccgcccttaatccatttaaccctgagtggacacagcacatgtttcagagagcacagggttgggggcaaggtcatagatcaacagcatcccaaggcagaagaatctttcttagtacagaacaaaaatggagtctcctatgtctacttctttctacacagacacagcaacgatctgatttctctatctttccccacatttcccccttttctattccacaaaaccgccatcatcatcatggcctgttnnnnnnnnnnnnnnnnnnnncaggtgcacggcatcacgcctggctaatttttgtatttttagtagagaggggtttcactatgttggccaggctggtctcaaacttctgaacttaggtgactcgcctgcctcagcctcccaaagtggtgggattacaggcttaagccactgcacccagccagaccccatgctgttaacatccatactctactgtcttccaggatagctctgaaggagtgctattattatttccagtttatggatgaggaaactgaggctcagattgatgaagtgacttccctaaggctgcatagtgtgtaaatggcagagccaggcctcaatttctggttcatgtgttttctttttttaattgatcattcttgggtgtttctcgcagaggggaatttggcagggtcataggacaatagtagagggaaggtcagcagataaacaagtgaacaaaggtctctggttttcctaggcagagtgtttgtgtccctgggtacttgagattagggagtggtgatgactcttaacgagcatgctgccttcaagcatctgttaaacaaagcacatcttgcactgcccttaatccatttaaccctgagtggacacagcacatgtttcagagagcacagggttgggggcaaggtcatagatcaacagcatcccaaggcagaagaatctttcttagtacagaacaaaaatggagtctcctatgtctacttctttctacacagacacagcaacgatctgatttctctatctttccccacatttcccccttttctattccacaaaaccgccatcatcatcatggcctgttctcaatgagctgttgggtacacctcccagacggggtggcggccgggcagaggggctcctcacttcccagcaggggcggccgggcagaggcgcccccaccttccggatggggcggcggccgggtggaggcgcccccttcctccctcccggacggggcagctggccgggcgggggctgccccccacctccctgctggatggggcggctaattatgatatatctttaacaccacaattcacttcaggacaatactaccttcattttgttaaaatatagcaactttgttccactgtagctccatttctatcttttgtattgttatagtcatgattgttacatttatatagtctggttttatttcctgtcatcctgacagacttcctttagattttttgtggtacaaatatgctaagtgtgactttctctcaaattttgtttacctgtggctgtttttattttgccttcatttttgaaggatatttttgttgcatatacaattcttggtttataatttgtagtttgaatatgtcattttattgcttcctggcctccatatttttaatgaaaagtcagatgttgatggattggtttccttgatgaattatttttctcctggttttcagcagtttgactgtgatgtgtttggtttgattcatttcgtgtttattttgtttgtggttctctcccctttttgaatctgcagattaatgtgtttcatcaggttttgacattttccaccattatttcttcaaacattttttctatttctttgctcttatgtcctgtgacttttattacatttatgttgggagcttgacattgttctactggtttctgaggatctgttcttttctcgtcagtcttttttcctctctgatttttttgattggattgaaattaaattttaatttatccatctacaagttcactcagatctttttttgttttttgagatagagtttcactcttgttgcccaggctggagtgcaatggtgcaaccttggctcactgcaaacctctgcctcctgggtttcagcaattctcctgcctcagcctctggagtagctggaattacaggtgcccacaaccacgcctggctaattttttgtgtttttagtagaggcagagtttcacatgttggccaggctggtctcgaactcctgacctcaggcgatccacctaccttggcctcccaaagtgctgggattacaggagtgagccaccacgcctggcctgaagtgtattattgaagcccagatatgtagtgaattttttattttgcatgtacttttaatctgtgtggcttctttttatagttcgctcttaagacttcttatttgttgaggctttgccatattattttattatttgaacactggttcctttttattcttttaaaatatttataatagttgctttgaaatctttgtttttattctcacttggcctttagttttttcagggctttcttgtgtctccctttggtatgtgcagtgtcccaattagccatgtctgtatagagagttgatcttagcccttccgtgactctctcatttcaagtttctttgtattaatgtggttgatctgctgcttgctgtgtgacccccaacccaggtatagcaaaacctgttctttccagacagatactaatttatacctggcaaatctcatgttttcgcattcacctctctccccaattgattctaccgtgtgtgacagcaaagctgctgtttttatggtcagccccattctagtaaaactactgatttttcagaccagactttaggactaaatggggaccatgggagcatcctcaagcaagagggccagtgcctttcattgcttttacctgaaactttagcagtctttgtagaataagtgtgtctcattttgcatgacagtagttgattccctgtggtctgaattcgttgtttgctttttttctttgtgacagttttgtacagttttatactttgtctttgaagagaggatttgctttcccttgtgccattattgaaagtggtccagctgttaattttttttgtaccttcattttgttgtaaacttatcttttaaattttagtagtcttaaaaaataagtgacatctcaggtatcctgtgttttctagaactgcagtgtcctgtaccatagcaactagtcactggtggtgatttaatttttagttatctaaaatgaaattttaaaatttagtttgttggttccactagccattttgcaagtgctcagtggccagtgttgtattgagtactgcattgaacagtgcacatacagcacgtatccattattgcagaaaattctgttacacagtgatgctctaaaatctttgagatgaatagtaacttgtaataatagcttacattttgtgagcacttagtgtgtgtcacattttatatgtataaacatgtagtcttcccaacaacctttgaggtaggtactgttatccctgttttgcaaaggggaaactaagactcaaagattaaggaattaacagctctgaaggggttgagatttaaatctgtgtagtctggctccagaatctgttccattaataattttgtatattgcctctttggtaaatgacatgcctggtttctgacttgaatagagaagtgtttttgttttttttttttcctttaaggttttgctagctttaaatgctatttaatattttggtaaatgattctttcatatttaggttgtttgcttctcttttttagtgttcttactaaaaatgtctgaattttatcatatgccactttaacatctgtttatataaccatatagttttcttcttcagttgttttgatatgattattttgttaaatttctttccgttgaataatccttgaattcttggtaaaccttactgatcataatattcttttgacagattgacagaatgtttgctaatatttcatttagaaatgtagagtcaatacgctggagtggtctgcagttttcttcttttgcattgcctttggtaggttttaatagtaaaacaatgtcgggctctataaaatgaattcggattttcactcttttgttctagattggttcaaataataatggaatgctggtttattctttaagcattactctcctgtataactatctggattttgtattttttttaaaatggcaacgtcttctaatctttgtatgcttacatgtctcttcaagtttaattcttgttttgcttttgatgaatcatattttactagaaaattggccatttatgctagattttaatattgcttgctttagagttacatggagtattttctgatataggcttagtaatcttttaaaattgttttgctttgtctgtttccattctgacttctctatgtttttttctcttcattagattcctaaagattttacttttttctcaaaaaatttttaggttatcaattttgttttcagtaatgtatatatttcagcttttatatttaattctgttctcatacttctgtttttttaaaaaatttgtcaaggaaagaactaagttttattagttttgtttttaaacatttaagtctacagatggaaataatagagttgagtatgaactgtttctgctgcatttttttctagatagcttgtaatttaggtttgatttccagatggagtccatttttattttgggttgtgtgtagtgatgtttttatttactttcactttgtaaagttttaaacttttataggatgtggactgtaaaattcagtatctttttaattgaaaggtttttttttttcttatttgtttttggtagctgaatacaagatcaaattttttaaatattacacagacatacccaaaaatgtatatattctattctaggaatatataataaatagctctgaaattatttcatccattcttttatgttttggttttttatatctcacttgaaaactgtacttctatgttttcatgatctcctttattttaataatttttccgtattattattttgagacagagcctttctctgtcaccctggctggagtgcagtggtgtgaacatggctaactgcagcctccacctcccgggctcaagcaatcctgcctcagccttgcatgtagctgggaccacagatgcacacctacacgctgagctagtttttaaagtttttctagagatggggtcttgctttgttgcctaggctggatccttttatttatttagttgttgtttttgttgatagatttcttttgaaattttcatgctgttttttcttggtcatactaagtggcattctcttttgctttgttaaacatttatttttattttgagatggagtcttactctgttgcccaggctggagtgcagtggcgccatctcggctcactgcaagtcctgcctccaggttcacgccattatcctgcctcagcctcccgagtagctgggactacaggtgcccgtcaccacgcctggctaattttttttgtatttttagtacagacagcgtttcaccgtgtttgccaggatggtctcgatctcctgacctcatgatcctcttgccttggcctcccaaagtgctgggattacaggcatgggccaccgcgcctagcctaagacttatcctttattactgttttttagcagtttgattatgatgtgctttgcatggttttatttagaagtgctatcttcagagattattgtggttcttcatctttggcttatagtttttattaaagttggaaaacttgatcattagttcttaaagtatatttctcattgtttttatttcttcttctgggaattcagttacacatatattagaccacttgataattgtcccacaggtagtgagcctctcttttgttttgtggggggtcatattttgttcatcttcatgttcatttctgtttgtctcccttcagttttgccagatttttcttcatgtgttttgaagctgtcttgttatgtacacatatgcatataactatatcttcctgagaatggatatctttattattatacaaattttgctcttgtctctaatgattatttttgtgtaagggtctattttatctgatattagaatagccactcctgcttgtttttttttttttgagatagagttttcgcttctgttgcccaggctggagtacagtggtgggatctcggctcaccacaacctccacctcctgggttcgagcaattctcctgcctcagcctcctgagtagctgggattacaggcatgcgccaccacacccagctaattcttatatttttagtagagacagggtttctccatgttggtcaggcttgtcttgaactccctacctcaggtgatctgcctgccttggcctcttggcctcccaaagtgctgggattacaggcatgagccactgcccctggcctttttttttttttttttttttttaaatagagacaaggtcttgctcagtcacccaggctacggtagagtggcatgatcctagctcactgcagccttgaactcctgggctcaagcagtcctcctgcttcagcctcttaagtaactgggcctgcaggcaaataccaccacacctggcttaattttttttttttttaatttgtagaaatggggccttgctgtgtcacccaggctggctttgaactcctggcctcaagtgatcctcccacctcagcccaaagtgctgggattacaggtgtgagccaccgcaccaagactccagctcttatgtaattactgtttccatgatttgacttacttttttctttcatcctgtatttgtctttgatttacggtgtgtttctgggctgggggcagtgacttatgcctgtaatcccagcactttgggaggttgaagcgggaggattgcttgaggctgggagattgagacccgcctgggtgatatagtgagaccctatctctacaaaaaatttaagcaaactaaccgagtgtgatggtgtatgcccgtagtcctaactacttgggaggctgatgcaggaggactgcttaagcccaggaggttgaggctgcagtgagcgccactgcactccagtctgggctacagagactatatctggaaaaattaaagtgtgtctctggtaaacagtatatagcagtatatagttaattttatctgctctttattttcattggggtatttaattcattctcatttactatcattattgttatggttagatctacgttgattgctttgctctttgttttctgtatagctcatgtatttattgttgttcattggttcctccttatgttagatatgagttctaaatttctcttcaaagaatcaatgtcagtgtgttcaattctttgccttctacttctaaacttcctcataaagcaatctttttcgatcacatgctccaccctgactcattccaattacctgctccacactgactcattccgattacctgctctgccctgactcattctccaccctgattcattccgatttcctgctctgccataaccatttttcctgccaaaccactcaccccgtcactctctttaaagtagccaatcggaattagtttagcctgtgtggtctaaccctcaccaataggggaacaacacagcagcaggggccatgtgcgtcaggaataagaaccccttcccctcccttgtccaggtgtgcgttcaccattgctccatctgtgagggcgcatccttctataaaaataaattgccttgctgaggaaaaaaaatgaatttttttttttttttttgagacagagtctcgctctggcacccaggctggagtatagtggcatgatctcggctcactgcaagctccgcctcccgagttcacaccattctcctgcctcagcctcctgagtagctgggactacaggcgcctgaaaccacacccagccaatttttttgtatttttagtagagacggggtttcaccatgttagccaggatggtctctatctcctgacctcatgatttgcccgcctcggcctccaaaaaaagaacattttatatttgagtgctatttcttttgcggcaccaaaactttataacacactgccttctgaatttttttttttgtttctgctcagctcattgttaatcatattgttcccatgtatgtcatgagttatttttctcctagtcttttcaaaattttcttgtctttgacttttaacagtttaattgtaacagtgtatatctttaaagttaaattcatgcttgtgaatttttataagagccacaaaggccttcctctgtgttttgtttttgtttttgtttttgttttcatttttgagacaggctctcactgtcccccagtggcccaatcactgctcactgcagcttgacctcacaccctcaggtgatcctcccacctcagcctcctgagtagctgggattacaggcaggtaccaccatgcctggctaatttttatttttgtagagacagggtcttgccatgttgcccaggctgatctcaaactcctagactgaagcgatctgcccgcctctggctcccaaaatgttgggattacaggcgtgagccacagcatctggccacttctgtattttgttttcaatcactttattatgaaatgagatacactgttataaagtattttctattttgataattcttaaaaattccacttgaaaaattttctgcttgaatcacagtattgttccttaattagcaattatttcactttggggaactggtcatttttaaaattttatttcttagagttatttggattatgctcatatatgttgtcattaaaatatttaattttggaatttaagaaaattgcagccaggttacatgattaatgtggacataggaaaacaaaatatttatgtttctaagtttaaaaattttattcatatattcagtgtttgggatgcataagtgttcacattttaggaaggcaagatggtacttaaatttccagcatggtctgtggtcgtaccctataatcaaatgccttaatatttctgcagcagtatttacactaaatagcgtaactaaagatatatatagctttatgacagttcaggtcaggtttttttcactaaatgtgttttgtagctaaacatacaataattttctgtatttcaaaaactggataaggaaatgtgagcttgacaaccattcaattttttataaaataacatgttttccatttttgttttaccttttgtttgtggctactatcctgcataaattgcataatttgttttgacaatttgtggactgtgtccttcattgttgtacagtattcccactattcctatttaatgcttttttaacttttacttaggtttatctaatgctaatattcttcctgtttgtttttgttttacctttttgttttgttttgttttttgcagttgctgctgtatgtttgtttatccttttctttttcaataggtatgtcttgaagtttcattagtagcagactactaatttgcttctcaggattgccatttttcaggtcttctaattttttaatatggaaattgtgtttatttaaatttagcagggcacttctttttttttttttttgagacagaatcttgcttgctctgtcgccaggctggagtgcagtggcatgatcttggctcactgcagtctccgcctcctgggttcaagcagttctcctgcctcagcctcccgagtagctgggactagaggtgcacgccaccacacccagctaacttttgtatttttagtagagtttgaccatattggccaggatggtcttgatctcttgacttcgccatccgcccacctcggccttccaaatcgctggaattacaggtgggagccaccatgcccagtctgatttgctttcttatcattcatatgctcactggactgtcacttttaatttccttcaagaactttgcaggccaggcgcagtggctcatgtctgtagtcccaacactttgagaggcctatgcgggaggattgcttgggcccaggagttcgagaccagcctggacaacaatatgagaccctgtctttacaaaaaatcaaaaaattagttgggcatggtggcatgagcctgtggtccccactgcatgggaggctgaggtaggaatcacttgagcccaggaagtcgaagcttcagcgagcagtgttcatgccattgcactccagcctgggccatagagcaagaccctatctcaaacaaaacaaaacacaaaacttttcctttgcattcacaactaggctaactggcacaagaggcctagcattggcctgtcttggcttttgatatgccttctcactaagcttaacaatttctagctttttaaaatttaatgtaggagatgtttgacttgttgttgttgttgttgttgttgttattgaccaagtcatgctgaatcgattcttcttttcagttggacactttgaggccattgcagggttatttattggcctaatttcaatattgtttggtctcaggcattagggtggcctgagaaagggagagagacagggagtggccagtcagtgaagcagtcagaatacatttattgattaagtttgctgttttcattgggcgcagtttgtggggcctcaaaacaattacagtagtaacatgaaagatcagaactcacaggtcaccataatagataaataataatttataagttaggaatattgcaaaaattaacaaaatgtaacagaaagacgcacagtgagcacacattgtgggaaaaatggcgtctactaatttggttaatgcagggttgccacaaaccttcaatttataaaagctcagcatctgtgaagcagtataaagctaaatgcagtaaaacaagatattcctgtataacttcaagaatataagaagccctaagaataccaacaagctttatgataatagatattagttatacttagtttattataagatattagtgttcttcgtatatgattgtatgtgcacatatgtggccatatatgactatgacttcaccttaagccagcttcattcttaagtgataaaattaactttggaaatacttactgacattatctaaatatatgttactctatgatattattttataggatttaagccatttttattataaattatttcagttactttctgtatcatatctccaagttttccctgtataaagcagcattcttctttattctccctctattgacaggtcattttgtctcttttcttcattgccaagttttttgtaagagtgggcaacatattcagcatttcacatcttcagttccccacgctcatgctaatgtctgtctgccgctacctccattgctataaaatttctttagtaaagatcagtgacctgttgctccagaacataattattgtttttttgccatcattcctttttggcaaatacatattgctttctaggtctctattttttaaatttgattttcttgctctgttataagaactaaattatcttacagatgccagtgaacaattttgaaaaacacttccttaccccatatcacatctctctgacagagagagaagaggccatgattatgtcaacagtttgaacagcggcatcttgcaagaatttcagaccaactgaccactcatcaaagaacttggcagctttttaatcttgtttttttaatacaacagtatatccattctgatgacaaacctgtcccgccaaatctccacaacacacgttgtaaaatcagtgattagcaaattagtcagctttggcacggagctgtgcttgcttgcccatgacagtctggaaactggttttgtacttgcaacagattatcaacaataagttgctcactgtaagaagtagagttgagtctcttctgcaggtgtgtgtccagtgatcagcatgtgtgaaaagtattccttaatatatcttctgaagactttttctgtttctgttggaatcttctttgattacaaattggttattaccatctatagaaccacttgtacccagttcagccaacaaaaatgcaagatgtttgggctgatgatgtaatagtttacaaatatctgtaaagttgacaaaataagttttcttggttcctactcaaatgacctgtagaggtttgatgacagatttccttttcagcaaccacatctggattcttttccctcgtgatgttgcacactcgcttcagtagctccttatgtgtatttgagactgccctagcagggcctgtatgattattgaatgagatactgtcatcttttttgctgtcttcatcttctagaactttgtctttctctagtatttcatcctcatctgggaacttgacattcttctttttcttctttttattgccaagcataatattaaggtcatactctggttcagctggttcttgaatattttttcaatcttaagatcctttacaccttcttcagcttcatcagtatcaaacatcttttttgtttttttcttttcttttcttttgattaaagaagttcaagtcatctagatcatcagaagcacctttttccctactgttctcttcatcagcttccaattctttgtccccagttggctctggcgccacttgttttgtttctaagggctgggtctcctctgtttgggtatccccttcctcctctaactaaaggactgctgctgctgattttacttcttggtcatagtaggatcaaaaatcatctcatccccagacatggctgcagctcgaatgggctaggcacagacaggaagtcagacaaatcagccctagcccccagcagcagcgctgctcctgctgttacctctcacaccactgcactctctagccccttattaatgtgtgcacatagggtgggaatagagatgaataagagataggtgcatggtggagagaggaactagacttaggcatggttatacttctccagtttgaggtttctggcacgacttgacaatctttttccatccagcttctttttcctattctttggataattcattccagtctttcaacacttaactcacaggactctcttatcatttggactgggctctgacttaagtaattagaggctgtaggtataaattctctcaactcccctctctatctgaaaatatatctgtaatttttcattattttctaagggaaaggagagtggtgttgatgaccaaagctttggtgtgactgcttgagaatattggaaagagaagctagggctaaatgaaaagattgttaggtcatgctaagagtcagctgactttaagcgcattatgtaattttaaaagtaaattggtacagtggtaacaagttaatcataaatggttaatggaaaagtagttgatccttgtttgacttgtgtttgtttcagttacacagacaggtatgtatttgtgtcctggcctttgatgtaaagtgtacttcctgtggtttgcagttgaaaatgtttgaaagctgtctcctaaatttgagagctctgtttcttctgcttgacttgtaaatattggtgtaacaagggttattgtccttgataatattcttcctcagcagtcataactacatttcacatttgagttatttacatgctggtagctccctccacacccttcagctccagaaatatgctagttaaacaccatctatccaaaacttactcattacatttctggctaaaacactttttcctcattttgagtagttatgtaattatctatgcattacccacaccaggaacttgggaatcatctagaatttctaatttgtttcctcattgtaactcttagtactccttcatcatacagtcatttattaagtccaattgatactctgatttatcctctacatttcctttaatactgccttagtttagtctcttttgttactgatagaccagcgttttaattagagaaatagtttagcatagttcttaagagcatgagctgtagacacagacatgttagttgaattcagatcttggcatttacgtcaccacatgaccttcagaatgtttcttaatctctccgaacctcaattttttcacctttaatgtggggatagtaatagaacctactttacagggctgctatgaggactaaatacacttatacatataaacttcttgaagagttaactgatctggcggggtgcggtggctcacgcctgtaatccgagcagtttgggaggccaaggcgagcagatcggtcacctgaggtcaggagttcgacgccagcctgactaacatggagaaaccctaatttagttgaaagatacagattaaaatcagcaaagagaaaaggtgcatggtgcaaagcccaagagaaagcagacccatgctttcagatgtccccagcaacaatgtgggacaatacactgggagtattgccaagtagggaatctcacctgagccttggtgtctaagttttggagatcagtctcattgccacgcagcccccacaggactggtaatcagctacttggacaccagtgcacccagaggtcaaacacggtatggcttaaagcctcaggtatacaaaagtactcttaccaggcagaattttccacgggctcagaggtcatctcccaggaacgtgtaaagggccagtcctgaagataggcctttcttaagaaggaatgtgcagcatttgagcaacccaggcctgccaaataaaccctttcttgcacactagtatagtcacgttcattcttcaagaccctattagaagtgttatctttttggtgaaaatttaactgatttactctaagaagagttagttgctctcatatctttgtctctacagttacttatacttatcttctttgtagttttatataatacactttctcaagaggtttttaagtcatgctttcccaaatgtgaaaatatttttccttttcccctttctcttcactttactatttctccctttggtttgaaaaattgtttttgtgtgtttccttttaccaagatctttttatttatttatttttttttttgagaccgagtctctctgtcgcccaagctggagtgcagtggcgcgatctcagctcactgcaacccccacctcccgggttcaagcgattctcctatctcgccctcctgagtagctgggaatacaggcgcgtgccaccacacccggctgacttttttttaatttttagtagagacggggtttcaccatgttagccaggatagtctccatctcctgacctcgtgatccgcccgcctcggcctcccaaagtgctgggattacaggcgtgagccaccgcgcccggctctttttatttatttttataccatgtttttggtaaaataaagaggaaatattaataagaacagtattttgttttaaatatataacagtagttattttttaattttaattattttattttaaaattagagatggcgtctcactatgttgtccaggctggcctcaaactcctgggctcaagtgatcattccactcccaaagtgttgggattacaggcatgagccacctcacccttcttttagagtgataagttttatttatgttttcattttccatcagaatgactatatatggtactacagtttgtgtactacacaactcatggggacttggtttatatcccagtctttggtgctttctgtaattgtgtacattataaactataaaaattacatactaatctagaatccttcttgaaggtgtggattgtgtcatttatgctgtatcctctatttcatggctgacatgtagtcagtttgttgtgttgactctggtgctattttcagttatttagcctctatgtgttacctcaacagtttatccattctgataagtcctggaacactagcaggtgaagggacagatgatctttcttctcatattagcatgtattcaagtatctctaaccaagtcagaatttataagatgatagattgtatattagttttctgttgctgctgtaacaaaattaccacaaacttagtgtcttaaaacagcacctgtcttactgttttaccattatggaggccagcagtttgaaatccctttcactgggctaaagtcaaaagtggtggcaggactggtccttctggtggctctgggagaaaatccatttccttgtctctttcagcttctagtggttgcctgtctttcttttctccggcttcttccttcatctataaagtgcatcactctactccctgcgtccattgttattataattgccttccactcttctgtagtcttaccttcctcttcctccccctgataaggtcacttgatcacgtttaggacccgctggacaaaccatctccagagccttaatcgcatctgtaaagtcccttttaccatgtaaattaatattcatagtttccgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatgcacaatttctttattcctgaagaatattttaaaatgttgttattttatgttgtagttggtgtaatacggtgcccagtatgccgccaagaatgcagacagatagaccttgtggataattattttgtgaaagacacatctgaagctcctagcagttctgatgaaaaatcagaacaggtatgcttctcaatttttctttatattcctatcttgatatcaaactgtaagttataagaaaaacatgtttggatagttaagtcatttagggtggttctgctatggattcctgtttcaaatagaaagttaaagatagctttcttatatactctcaaacttagttaaatgagactaaagctattacttaaaatgtcaaatttgggccaggcatggtggctcacgcctgttgtcgcagcacttagggaggctgaggtgtgaggattgcttgagccccggagttcgagaccagcttgggcaacatagtgagactccatctctacaaaaaataaaagtactagccgggcgtggtggcatgcgcctttagtcccagctacttgggaggctgaggttggaggattgcttgagcccaggaagttgaggctgtagtgagccgtgattgcactactgctgtccagcctgggtgacagagcgagagcctgtctcaaaaaaaaaaaaaaaaaaagtcaaatctgcacagacttcgtgttctcagccttagatttttacctacatgaatgatctgtaaggaaaaggattttgttgaagataaatggataacaaaataattttattctgtgtacagtgaaatagtatattgaagaacaagtttttttttttttttagatctagattttatgtatttaatttagattagtgcttatttcttcttttaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcaggtaagatagatgcattgtaatcattacaatgattacagttaacctccttcttttgcccctatagaattttctacttattctttataaactttggatagcaacatcaataggaatttagaaaactagacaaaaattttatgtttggttaaaaaatatttgttttattttgctacagagtctgttggagcatctggtcaacgccctgttttctgccctgtacacaaacaagaacagttgaaacttttctgtgaaacatgtgatagattgacatgtagagactgtcagctattggaacacaaagaacataggtacagaaatcataattgcttaccaggaaatactataaaaagtgcttgtaaagtcattcttcttcttaaagcaaatattgattatatgtttgtgtcttaatcttttaaatctgtattttacatattttaatttcttgagcaatatatgttttggtaaattatttaaagatttccacatttaaatctaattgtcttatgaatgtttgttaaaatgtatcattttgtaggtttgggtttacaagaatggagttatattatgcatttgtttgctactcctgtgattcaaataagctttttcttggtgtcctatagtatttttggctgtaatctacaaaagcagtattcttttaaacatcaaatcacaaatacactgatttcatgttacatataaaatttgtagaaaagctagggatttatgaacaactaagcagagttactgaccctctaatacatacctttgtattttagccttgtaccctcagaattcagtagtattcatttactaggagtgtgtttcatatgaacggtttggaaactgtacaaaaatttctagtcagttgtgtaacaatatccttcagtaaatttctccagcttccatggcatctgtttattacaagtaaaaagatggtgtcacccatagtccagaattttccaaagtgtttttcaaacaacagtttttatggctggatgggaatagattttattaatctattgccaaaaatgtataagagaacttgggttaaccacacttaaatgtgtttcttaacgatatgatttcttagggtttttaattcattagaattcattgaagtttattagagccttcttaaagaggggatacagtaatcccaattgccaaccattattgcagccttactttgtgccaggtacttttctgagtgctgaatatgtatttaattcacaccaactatccatgaggtttaggtactagtattatgacggttttaagtgtaagagagcctactcacaaaaggctgtagtaatctgtacaaagtctcatagtaattggtagtaccaggatttgaatacaggtagtcagactccagatctcttcttaacccatatgctcattttcttccatagggtatagagaatatagaatgcagaatgtctcaaatttgactatataaaggtgtagtgctttttgttctttttcaaggtatctctcacagctttacagtatatttattaaatttttgtgctcttaatttgttcagaaatgtcttaacctataacttggctgaaattttagattgtctgctaacagtctcagtaagacattagattacctttttcacagctgcagtcagatctttttttgagtgttagatttcttatagctttttaagttgatggtgagaggcaaaaagaaaaggaagatgtcatacttttcctcattaaagaatagcttcagcggcattgccacctcaaagtttaaccattatccttccctttcttttaccattttcctttaccacttatatctaagtccttattatctcttgtataatttaaaaaaaatgttttttttctcctcctatactcacacaacacagagcacttctgtgaccatgtgtgtgaccagtttcccctcatattgactgattctcgccagcttggtgtccagaaattcagttcagttctgtcgccgtctacctggagttagagtcaggtcccacaagttaagggctcagtcctgcaaactgccattccacttcaaataccagtcgttaagtcccaccttctggtacttaaaatatatatatataaaatataaaatataatatataaatatataataataataaatatataatatatataaaatataaaatataaatatatgtatatatatatatatatatatttttaaagacaggttcttgctctgtcacccaggctggaatgcagtggcatgatcatagctcactgcagcctcaaactcctggcctgaggctgtcctccctcctcagcctcccaaagtgctgggattacagatgtgagccactgagcttggccccggcctctggtattctgactgacttactataaattgggggtggggcggggcggttcccacgaccccttccttgagtttggtcatttgctggaatgggtcacagaactcagggaagcatttaacttactactgccaatttattacaaattacagcaattacgacaatttaaagatcttaattggttttatttgtgattttagatttgagcaatacttcattccataaaataaaacaagtgtttcagtgaactgagcagaggagcttggttttatagagagagagggactgaggaaagcaaaaacaaataataaaaagtggattggtcatttcaaagttactttcctagtaaggctggagaagggcagaacaatagagaaataatttattggctaacatcaggttacctcaggttaccctttgttgtaaggattaaagacatcagcaccgtaggagaggtttaccaaaaaaaaaaaaaaaaaaaaaaaaaggtggcggggggtgttaaacacagggagcctcattatcatgccaattgaaacaggcttatttgggaaattagggtgttatctctctcctcatttcttggatggtctgataactcattttcagcttgatgaactcagcatgaaggactccattttgattttttttttctatttcaacagtttcaatgaaagtttgtatataagattactttattcctgcatcttctcaattgtttcttccttgtattttggccttttcctttcttacttggtgagatttgactttttgttcaaggatctttttgcggtctttgtccagttttaacctagtgataaccactatgctggcgtgaatgcctacgtggacagttgtgccattagccttttcccatggcacctgttcagtgttgatgatatatttcaaacttcgactaaattgccagtttgctgacctttatagtgtcctcgcacaatctgaaatttatcatccttttgcatgggcatggaatgaacgttgtacttctgtcttagctcttaggaaagaggggaggacataatcttcctatgaatgtgggaaggtgcattgaaacaccttttgtggttcttgcttcagtcagaagttacaaagggattaaactttattttggccactcttgcttcagcagtggccacaaaagggaagagaactatatgctacttctggttctatctgtattttgatttttagtctgatctgttggggcctagtgcaggagcttagtccagaacaatgtcctcctgtaatttttgtttaactgtatatatatatggagagagagaatttttcttattttttgaagagacgggatctcactctgttgctcaggctggactcaagctcttgggctcaagtggttcttccacttcagtgtcccacatacctgggactagagatgtgtaccactagacaacattttatttaattttttaaaagaggttagatcttgctatgtcgcccaggctggatttaaactcttaggctcaaatgatcctcctgccacagcctcaccagtagctgagattacgggtgcatatcaccatgcccagctcaacaatattttaaagaatacaaatgaacaactggatgaagagatgcatagggtgaagtatgtgggaaggggtacagagtttccacaacactctgtggtggatgccttatcctccacgtgttcagtaacctggaagctctccaacccttgctctttcaggtttttatggagattcattatttagggatgcgtgattaaattgttgatcgtttgtgatcatctcagccttcagcccttcccttcctaggttaggaagtagggctgaaagttccaactgtttaattatctggttggttcccctggcagccagcacccatcctgatgggtctgggagtccccagccattggtcattttgttaacatacaaaaatatacttatttcagagattctgagggttttaggaattgtatgccaggaatagggacaaagaccagaacaaatatatactaaaatatcacacatttcttctcttttgttcatgctttcattttattttctctggatggactgttgcagaaaccatgtcattggacttaaaagccagcttcccattactacaacacatttacaactattctccctactttgagtttaactctgttaaattcatcctgtctatattgctgccagggttattttgctaacgtatagttgagcccccattaaaaaaatacttaacagtaaccaaagtttaagtgttcagtatgttatcacccagacagattctccttttctccctgtccagaaaaagtcaatacactgagacagcaggaggtgtagcagagaaagagtttaataattgcagagtggctgagcaaggaggatgggagatatttgagaaatatttctcaaattccaactccttgagaatttggagatgagggtttttaaaggatagtttggtgggcaggggctagggaatgggtgctgctgattgcttgggtcagggatgaaatcatagaggtgtcaaaactgtctttgtgcagtgagttatgctgagtcacttcctgagtaggggtcacaggaccagttgaattagtctcttggtatggatcaccagcctgggtggtagcagttagtccagcagaatgcagagtctgaaaaatatctcaaacactagtcttagatttcacaatagtgatcttatctataggggaagttagaaatcttgtgaccacttgctagtgactcctgagcaataagcaattataaaaaacaagacagggaacaatggttgctgtttatgcctaaatcttagcagaatttaggctcctactgtaattctaaccttatagcctttcattagctttacaaaggtggtttcagtccctgaacaaggagggtattagtttcaggaagaaactattatgcttgctttaaactataaaataaattcctcccatagttaggttggcccacatatgggaatgagcaaagacagcttgtgaggttagaagcaaggtggagtcagttgtgttagatttctctcactgttataattttgcaaaggcagttgcaagtataacatacattattgaattttaccagtgtctttcttcattgtctgttcaaagttacgaaacagtccacaagatcaccattacttctgacaccaactgcagagttccgtgaaaacccaaacataggggaaaatcacatgcccgctgagttgattttttaccttctgtaatcacagtggtggccctccaaacaagatgctgtccattcaccttggaattgtccataaaccaaactgctctttactgattaatagaaagtagtttatagtgtagcacccatccgatcacaggatcagcagctcctcaggtagtttcaaagtcagccttagggaaaaagaagctacctgcttataaatataatgagtacctctttgcattctcctggttgtaaatcctgtgcaaactatttctattttatagggaactcttctggacactgccttccttattagtgtttctccgacatcacctaagatattatggctgttttgaatttcaggattattttatgtccttcagtcatagattcagtctcagttaatgcctgtagtagctatttttttctacagtgttgtacattgtactatggcatctggacatcttctggtccaaaaatcctagtggttgctgctgggtggcactcatagggttttgcccataagctgtagtctgcattagtatgtgtggctgacacttcccaaaatcatggcggaatgtccatagggccggacatggacaaaatcatggcggatcatagggctggaaagtatttagagagactactttctgcagttcagatacagcctgtctttgatcaggcctcattgaaatgtaggcctctttttgggagttttattgataggagcaagcagtattcccagatatggaatatgtgtccttcaaaacacggatatacccaaccaaacactgggcttcttatttagtgctggggtaggtggctacagcagtatatttttctttctctgttgagtatcacaggatgcttctactctggttatttctaaggattttttcaccatttaggcatgccgttagacctttgctggatttatcatacagctcctgttggtcacatgtcatcactgcttttttcccctaattccccaaactttttatcaccattgcgtttaaattagtcctgccttggtcttcagtttctgatagtatcatgacatcatcagtatactatattattacatgtggggacccgaatcaactctaaatttctcctaatcaaattatgacagtaagctggtgagtggaaataaccctgtggtgatagagtaagtgcaaattgggatctctcccactcaaaggcaaattgtggttggctctttttgaggatggaggtaaaataaaaaaagaaattcacaagattagtccctgagtactgttttcctttggcctgctatatattttatatgttttttgtactgttgagaccatattaggaactgctgatgctatggcggaactacttcaggctttcatagttcactgttagtctccatgagccatctgcttttttcataggccacacaggattattgtacaaagaattcattggcaccagcactccgttgtctaattcttcattaaaatggtaatttctttttgtccaacaggtaatttcatcaggcagtaccttacactgtccaaaattaacaacttctgagggcctgggtggttctggtggttcctaattagcatttctcatcaacattgacctcaaggtgaacttacgtgctttctgttttcaatattagacaggtgtacttttcagtcaaacatactgtctatcccaatagtacattcaggtaatgaagacgtaaccacctcacataaaggcagctgagacattctagttttaatctaaatgtttaccttaatcccattagctgtcacctttcaatttaaccttaacacctgttaggacttcaacaagatttagaattatggtgccttgggcctccctgtcaaggagttttagtaaggtctcttatctacccctggcatttttacccacacgtgtatattgccttagttccccagttgctggttgacctctctgtcttcatcttgagtaatctgccagactattgtcccaggcaatttgaggtcaggttgcttattgtcatctttgttccctggctttttaaatcttcccaaactggggtaaaatacagcatagttagtttaaggccctttaatgttgggaactagctggggctctcattggtttatccagtcccatggtaatgctgcattaagacctttgtttcaattccatctgtgttcaatttattcatcccattttaaaacaaccatctgtagatttccatcttcctgggataaattccttgacctctactctactatttccctgttttcttatgacttaactctgattttcttagcatctgttaagacctgtaaagggaagcttagacaatacttctgataaggcttctcagattattgctagattttacagcagtaaggttacatgggggtatccatgcaaaaggggccccctcaatcacagtatttaccatataccataaggcatactgagtcatagtcatgtcactcatagtcatctcctgactatcccatcatcatgtcagtccagtgtagcttgcataagaagcttatcagctgcttattctggggagttcaatttggcatttataggaggaggaggatagttgcccttttcaaggtaaacacactttacagtggcttttatatctagtccactgggctagctgtccccttgggaataacctgctggtgtgtctggatcatgtatagccttctctggttgtacagtagtgagctgtgggtctcgcttcaacctagacacactcttccattctacagcattaaaaaccaaagatcctgtgcctctaagtcaatcactgtcacagtccattttagtaaaggtttttattccagaagctgatagtgttgatcaacaaaatgagacaatttgtactataatccctggtttcagtagtttcttggttttgtctttctcatacctagactacctccttgtaactggaagtcacagacatgctatctaatgttccagcataatttttccttttggagtgaccctgagactagtgactgcagcccagactggctgaagtctgagcttggcccagtgtcaagatctgtcctaacattctcttgtattttcattttagctagtacaggtagcagtaacaaaggaattgtttcattaactttttttttttttttttagaggagtcttgtgctattgcccaggcttcgagtgcagtggctcactgaaggcttgaattcctgggctcaagcagttctctcacttcagacacctgagtagttgggactacaagcatgtgccaccacatctggctaattttttatttttttgtagagatgaagacttcctatgttgcccaggctggtcttgaactcctgggctcaagcagtccttcctccaggacctctcaaagtacttggtatataggcatgagccaccatgcctggcctactttttttcttattagtttgcatttccttgtttatctggtggttcaactcctctggaattgggtctaccatttctaaattccattggtaatttttacctctagtaactgcagctgcagttatacaaccataccatgactgggtacccatccaagaattaaaggtttatcaattcccaccttctcatcctccctcttcgcaaaccacctgttttagtaagccagggtcattcaattgatcccacttctgatgctaactataaaattagagagtaatccacgagactcctttcacttctgacaccacttgtaagatcaagattccctaaaactacactcaggtttgataatttgctagaatttacagaactcactgcaagctgttatactcacagttatgtttattacagtgaaaggatacagattaaaatcatccaagggaaagatgcacagggcagagtccaggagagttccaaatgtgaagtttccagttgtcttctcccagtggagccatggacatcataaacacctcctgatagtgatgtgtgacagtgtgcacaaaatattgccagccatggaatctcacctaaaccttggtgtccagaatttttattgggtcagtctctgtcacatagatgtggttcaccagccacatggtagacctcagtctccaggacagctcctcctgaggttgatatgagactgtgtgacccagagctcccactgtaaatcagattgttgacacagactatctagcttggctcaagtccccaggcaaacaaagataatttcatcaggcaggacatttcagggggttagagattacctgccagggactgaaggcaaaggctagatctctctttgggcaaagttaacttttttactaaacaatctcttatcttccacttacactttagtagcaagaaccctctacctaaccctccaactttgtacatgcggtttcttagacctgtatttattaggagagccatttaaccttaaaacgagttcacctctttgtatctttttttttttttttcctgagacagactctctctgttgcccaggctggagtgcagtggcatgatctcggctcactgcaacctctgcctcctggattcaagtgattctcatgcctcagcttcccgagtagctgggattacaggtggacatcaccacgcctggctaatttttgtatttttagtagagatgcagttttgccatgttggtcaggctggtctcaaactcctggccttaagtgatctgcccacctcggcttcccaaagtgctgcgattacaggcatgagccactgtgcctatccacttctgtgtgtcttaactaacgctttctgctccattcttttccctccctaccaacaccccctcttcctcgctctggacttaaggacttttagggcgagttctttaagaatctcaatttcttatacgcttattgagtcagtcaggtcttctgtctcttctgggttgtttgtttttaggagacagggtgtcttgctctgtcacccaggctggagtgtagtggcatgatcatagctcattgtaaccttgaacctcctgggctcaagtgatcctcctgcctcagccttccaaattgttatgactacaggtgtatactaccatccctggctaattttttttttttttttttttttttaagagatggggtcttgccatgttgcccgggtcttgaactcctggcctcaagcagtcctcctgccttggcctcccaaattgttgggattacacttataagccactgcacccagctcccatctcttcttgagtcaactttgcaattgtgataatttatattttgttagaaaattatttagtagaggttaaaaaatgttgaattaaacattaagattttatgaagatctgtagttatatcttatgattgtttattattattattacttttttgagacagagtctcactctgttgccaggctggagtgtagtggcgtgatctgggctcactgcaacctccgcctcccggtttcaagcgattctcctgcctcagcctcctgagtagcttggactacaggcgcacaccaccacgcccagctactttttgtatttttagtagagacggggtttcaccatgttggccaggatggtctcaatctctcgacctcgtgatccgcccaccagtgctgggattacaggcatgagccaccatgcccagcctgtttatgatgttttctagctgagtttatttcctgttctttattagattggccataagtttgtggtctttattggtcattttagtgacccagttttttaattcatttattctttagaagtgttctgatcctcacagttttcttttatctttattaattttttgcttagtttgattttgctgtattctttttagaatcttatgtgaaacctcagttaatcaaaaagatgtaaattttcctctgaatttagcttcattccataatcatccatttatacagtctaaaactgtgttttgttttttcttgcctctccctgctttttaaaatttttgtttaaattaaaataattgctgcatagtgaaaaagatgagctatgttttgtgtgtatatcttttaagtgaaatatactgccaactttataaggttgttgtgaggattacaagcactgagaattgtacctataaagtgcttagcatagtaagcactcaataacagtttagctattattggctgttattacagttgcagcccacatgttttatttttttctctttatttaaattttttttttaattgaagtcttcgatttactttatggctttagaagttgttttgaaaaaggaaagcagctatagaactgcatgaaattttgtacctgagaacattactaggtttctagataaaccatggggtttttccatctccctccaaaaattctattcacattaaaggaattaaaaaatctgtagacttacaaagactaagaatgggagaagagacatcaatggggatttcagtccttttttttttttttttttaaagcagggtaatgaatggaagatttggtggatctgatatttgacctaatgggattgaatgatctaaggccatgcaaaggagatatgaaggaagccaatcaatatatttctcaggaacctgtaatacctagtacctagagatgataggtgtcacaaaaaatggacctattctctggagaaataaaatcagagaggcactggacttggggatattaggtccacatggggaggaagtaccaggctgaaatcagggagattaagtataaatctgtccattaagctctggggaccttcagtctccctgacttgcttccatattgctagtaatggcgctttttcatttcactgtcccttcctacctctcttttaggatttagagaccttttcaccctcggaagaatatttaaaagaaaaaaattacgagttccagcagaccagtataaattatagaaaaaagaaaacaaatgttgggaaattattagataactattgcaagaaattcatctaagaatgtagagtcaccaggataaaatgtcccatttaatgcccagaacaatgatttttaaaaagacccatatcaaggtgtataacatcataaaatgatagtatgctatggattaaggttaagatcagtgaagtttccaaaaccagcaatgaaataggaatcaaaataggaacgttaggccagacatggtggctcatacctgtagtcctagcactttgggaggccaaggcaggcagatcacttgagctcaggagttcaagaccagcctgggcaacatggtgaaaccccatctctactaaaaatacaaaaaaattctagtaaatttttagtttccaaagccagcaatgaaataggaatcaaaataggaacgttagtccgggtgtggtggtgcatgcttgtagtcccagctactcgggaggctgacgcacgagaatcacttgaacccaggaggtagacgttgcagtaagctgagatcatgccactgcactccagcctgggtgacagattgagactttgtctccaaaaacaaaacaaaacaaaacaacaggattgttaaaagaaagtcgggagatgaagggcaaaggttttcaatctagtattctctttttttgagacggaattttgctcttgttgcccaggctggagtgcgatggtgcggtcttggctcactgcaacctctgcccctgccgggtgcaagcgattctcctgcctcagcctcccaagtagctggggttacaggcgtgagccaccatgcccagccttgatctagaattctgtagctaaagtataaatcaatgtgagaataaaatgtagacatgtttcatcatgcaagtattgagaagctttgcctcttatgtacctctttttggaaagccattagagaatgtgattcaccaaaataagttagtaaaccaagaaagtaaaaggtaagggaatgcctaaaatgacagccatggggtaagataatttagaatgaggaatgaaaactgaggatcctgtgaagaaggtctccaggaaaaaaatggaaccatgtctattaaatttgttatattgggtcatttgaaaaataatgctgacaagtttggcatgtggtagttcatgagaaacattagcgattgcagcatggggcaagatggaataaatttggagagaatatattttggagaaatgtatttatttctcctgaaatgaatagtcacttttaagaccacactctcttactcttcaatcctcgtttgaggtggagatagggttgactcgctgaaactagaatttcttttccattgacagttttacaagaggaagacccaaactgcatccttcattaccaccaccatttgcagcctctccatcattatcagccttgtatctactagactaatattgttacattttttatctgtatttttctgttacccaagagagtgccacaagtgccacactcccagacgtcccctcatctgtcacactttaattccataggctctacatgtgcctgattctgccactttgtcctttggaattgttggcatgtcatcagaatctgcatatccccagcctcttttttgatccttttctttgctttatttggcataatggacactgcttctcttgcaactgtcgtgactggtgactttttttttctttcacatctcgtgtatgactgggcctggaggtatgagatacgtctttttactgttttttttagaccattctttctctttactccctgaaatatccggattttaatttcatgtcatcacccataacctctcattgctgctgtcatctaaaaacccttgggtcattccccttcatctctcaaaggtttttttccctaactcagtggtaaactgtagaatgctactattaagtcctagcaattttaatatatgtggatttgatccttcagacactctagtctttgtgttctttgacctcctttccagtgttcttgtcatttacactgctgtagccactcatatgcatagtcatatactagatcttatcatttgtaataattctattcaattttaagcattcctctctgtggccacatctgttactccagctcattctgcttagtacgaaacttctacaattattcaaccacacagtgacttttattttaatccattgatcctactaccctttcactttacctcatccctttgtgatctcatttaactccttccttatttaatgtcatagctaatcagtttaatcactcccttgcatttagccttgactcccatatcccactttttgaattcacttggcataactacagtcctgattaaacccgacttccttcctatcatattttgtttatccagctgaatatcacaggagaaaaacacattctagcataatgataccaataggtcacattctcaattcctgaccacttccctcaagtagaccgttaatgttgtctggaagtcatattgtatattcatacctttccctcttttaaatgtcaaatacttcatcctcactctgaaatactggcatttgcttccaacttcactgagaaaattgaagctatcaaaagagaactacagactccctctaccacatctacttttccaacaagcacctgtacccatatttctacatttctgttatcttagatgaactctcttcctttagaaagctaatttctctacttatacactgagttccatcccctctcatgtagccaatgacattgtttcagaaatttgcccttctttctgctaacctgtcagtttttcagtctctaacaattattcctatatttcagtatgctgctgtttttcttccatttttaaaaatgaaacacgaatccttctctttaacttcctttccttgccatcagagctgtccctgaaaaacttcttgaaagaattgcttgtaattatggtctctaattcctcctgtcccattctgtgtaaatttacatgcttttgactgtcagcattgtaccaacattgctcttttcaaggtcatgaataaccactacatgactaaatttagaagtgttttctcagttttcatcttgataccttattgtatcagcagtatttcacatgtttaatgttccttttaacacatttatgtacttggctaccagaagaacacattgttttcattttcttcctactaattactgattactttttctcaatctcatttgcttattttgtttgttcttctaggttggatgtacgagggtttacaccattatctatacgtatagtcttagggcttaaaataccatctatatgttattgatttccaaatttatatttctagctcattgtttattcctgaactttcagatttgtctgccctacagactctgacatctcccacttgaatgtctactttttcaaacataacgcttccaaaactcaactactgatcactttctccaaaccttttttcactggtagcctttcctcatctcagtttggcagttgcattttttttttcagttgcataggccaaaaatcttggcaccatcctcgactctacttgtttctcatacccaaatccaaacttatcaggaaatccttttggcttcaccttcaaaatatatcaccaactcctaccacgtactacctctgttgcctctaccctggtctctgccaccatcatttcttgcctagattactgcagtagtctctatgcttctaatactacctctcttccatttattcttaatacaactgctagagtgaatcctaagttgggctgtatcactcccctgctcaaaacctgcagtgactcttcagtcaatctttatagtggctttaaagaccttatacacgcattttatctgctactactctgcctatccctccatctctgctacagctacactggctttcttgctacttctcaaacatttcaaccttctgggtttaagcaatccttctgcctcagcctcccaagtagctgagaccacatacagctaatttttgtaatttttatagagatggggtcttgccatgttgcctgggctggtctcgaactcctgggctcaagtgtgatcctctcgcctctgcctcccgaagtgttgggatgacaggcatgagccaccatgccaggctcctttctctgttttttaattggaatgtataatcttgttatatttaatataacttgtgatatggttaaatctaccatttagtatttgttttttatttctctttttttgtgttttgttcttttgttgtctctttgctgcattattttaagtttataaatagtttttggtgttccattttacatctactgttggctttttaagctgtactttattatttttagcgattgctgtggggatagtgatatgcaattttaacttaatgtctacttaaaatattgtatggttttagtaactttacaaaaggattattcattttactcaattactatcctttgtactattgccacatcatttattcatgcattatataccttaacatacaatacttaaaaaaaaaagctgtcttttaaggaagttatgagaagagaaagtaaaagctggtgtttcatatttaccaatttattaccatttctgtttcactttattccttccagtatatatgagtttctgtctcttatattcctttggtctaatgaatattctccagcatttcttgttttgcaggtttgctgacaatgaatactctcatcttcttgtcatatgaaaatcctcaatttaagctgggcacagtggctcactcctgtaatcccagcactttgggaagctgaggcaggtggattgcctgagctcaggagttcgagaccagtctgggcaacatggtgaaaccctgtctactaaaatacaaaaaattagctgggcgtgggaacatgtgcctgtagtcccagctacctgggaggctgaggcaggagaattgcttgaacccaggaggcggaggttgcagtgagctgagatcaccccactgcactccagcctgggtgatcaagcgagactctgtctcaaaaacaaaaacaaaaaaaatcttcaatttagaaggataatttgctctagaattctgggtgggcagttttttctttcaacattgaaaagatattgatattactactttgtattctggcttccattgttttggatgtcactcgtattgttccttcctgaatgttttatggcttttctctggctgctttcaagatttcctctttttctttggcctttcccttttgaccatggagtttttagatatgtttgtctttctgtttatcctctgtggcgttcgctgagctgattttcatcaaatttgggaaattggccattattcctcaaaacagattttccagccagttgtggtagctcacgcctgtaatcccaggaatttgggatgctgaggtgagaggatcactttaccccaggggttcaagaccagcctgggcaacatagtaagaccccatctctaccagaaaattttttaaaattagccaggcatggcagtgcttgcttgtagtcccagctacttgggaggctgaggtgggaggatcgcttgaggccaggaggttgaggctgcagtgagctgtgatcatgccactgtgctcactccagcttgggtgagagagtgagacctatctccaaaaacaaaaaacaccccaagtctcctaggacttcagttacacgtatgttagactatttgattttgtcacaagggtccctgatgattgttcatttttcttgaatttattctctccctctcttcttcacactggatactttttattgatgtgtgttgatggtcacataccctttcttcagacatctcccatttgctgctaagtccatccagtgacgtttttcatttcagttattgtacttttctagaatttcctttttttcttttagtagtttccatctatctgttgagatttcctgtcagtttgttcactaagaacctatgttcatttaaaggtttgaataaatatacaatagcccatttaaacttttagctcattacagcatctagatcatcttggtgtcaatttgtattgagtacttttttctttgctgtgagttaggctttcctatttctttgaatgcctgataattttttattgtgatttggacattgtggacaatacactgtagaaattctagaaattttatcttcctctgaagacttgattgttcttgtaggcatttaaattactgtaagcttgtgtatgcttggttttatgctttgttagggaagatctgtagaaagcccaagtcatttcccaagcctttctaagttggtggtacccaatttctgaaccttgtttcttagacgatcttgtcaaggcttggttttatttaggttttgttaggacaggcctaaggtacagcttactccagggtatagtcctttaagggtgacctttctggtttctcaggtagatcccagggagattaacaaagtctgtctcctctgaagatagaattcaagctgagttcttctagaaatccatgacctctagttcttctcttccagtgtcaactttatagcaacggcagtctgctaaactttgtgtaatctcaccctgtcatatatagcccagactttgaccaagaacttgtgaggaattcacacatattcaatatcttctcttccctctatctaccctctgttccccattctcatcctacatcattccctccattccagtgccctgccccgtggatttcagccactcatgagcccacaccgtgatttttgcctctgctctacttcgcctctagccccctgttccagttatcataaaattgtctacagacagagaggtaggatgattatgatgctctttaaaggaatgtaaatttttgtctgcatgtggttcagtgactgaatatagttgcctcatgtatttctgtcttcttttatagtttttggtgacaagggctagtctggtaccagtcactgtgtcctggctgaaagtgaaagtcacctttgttccaccttcatacattaattttttttttttttaagaaacagggtctcactgtgttgcccaggctggtctcgaactcctggcctcaagtgatcctcctgccttggcccccaaagtgtttagattacaggcataagctaccacacctggctccaccttaatattttttataccctattgcagttttgtgtatagttagagtagagtaattttagattgtttttgaagatactgtttaagagagagtggctacttaaaacctagtatcagatatttttattaaagagtaagatagtttatgatggtagttacttgaatgatataagtgaggtttctctaaaatattttcttaaagaaatagcttttcatcagggtgcagtggcccacgcctgtaatctgagcactttggaaggctgaggctggtggatcgcttgagtccaggagttggagacaagcctgggcaacatggtgaaacaccatctcattcattcattcattcattcattcattcattcattttgagatggagtcttactctgtcacccaggctgaagtgcaatggcatggtctcggctcactgcaacttctgcctcttgagttcaagcgattctcccacctcagcctcctgagtagctgggattacaggtgcatgccaccacacctggctaatttttttgtatttttagtagtgatggggtttcactatgttggccaggctggtcttgaactcctgaccttgtgatctacctgcctcagcctcccaaagtgctgggattacaggtgtgagccaccgcacctggcccccatctccattatttaaaaaaaaaaaaagggagagaggaagagagaagggaaagaagaaaaggaagggaaggaatagcttttcttagaattggacttttgaattaagattttgtgtggataaacttgagagcagatattcacaattctaaatttatattaaaagtagggagatttaaaaaaatatattgatgcctcattcctattccaggctagttagataagaatcttatattatggcctggatataaaaaattgtttttacaatcttttaagaatactggtaaatcatcccaggtagtttgcattattcatagctttaaaagaacctttgctgaaactcacttttttagttcttccgtaaattcttctaagagttttttttttctttttttttctttttttttttttttttgagacagagtcttgctttgtcgcccaggctggagtgcagtggtgcgatcttggcttactgcaacctccacttcctgggttcaagctattctcctgcctcagcctcccaagtagctgggatcacaggcgcccaccaccacgttcggctaatttttgtatttttagtagagacagtttcaccatattggccaggctggtctcaaactcctgacctcaggtgatccacccacctcggcctcccaaagtgctggggttataggagtgagccaccatgcccgaccctaaaaattctttcagatgcaatccaagtagttgaagaatctgaatacattttttgtagaagtgataagtaaatacatatctactgtcagtcctcttagggagctagattcagagctatggcaacaaataaagatttcctatccaagcataattttttcatggggtacacttattgtcagacaaaatggtttgtttattgaacttcactcaacaaatgagtattcattgatctcatttgttcggtagatattcaagtactcatcgtataccaggtaccttgctaggtgatagctatacaataatgaaaaaatgtgctctgtccttgctatcttggagttgtgtagtctgtatgagactgatactgagtatttggttccgtaatagttcatcccttgagtattctttaaaatttgaattaattcatttgggtattgctgaaacatagcctcattaattttcatattatagtttctgatcctattaggatatcaaactatctgaagagcccataggttcaatgagtcagttacccagcagaatcattgcttatggctagaaggagaataattccatatggctaagagttaacttgaaagagaagaatatcaggagagaagacttgaggaagaaacacattcagagtcgttagtttcacagataaaagttacccatttggcaaagagggcagatgggttgagaagtatcccatgtgaaaattttattaaatggcaaaattattgcaaagaataaaaccaattggtcattttcctttgcaaaaatgcagctttacctctgattatttacagctcatctgttatctctctgtgcatgcctagttcctatctttgaaataattgtacgttgtcatcacgtcttcaagagttcccttctgtgcatgtatccaatgtagaatgtttagccacttaacgtcctctctatcacatcaccctattcaaatttttgttttctccttaattaaaatgtaaggaaaggaagaacaggaccttattttaccttatttactgtggtatccctaccctttgaatatttcttggcaaataggcaaatttagttcatataaataatgactacatacttttttatttttaaggggatgaggtctcactctgtcaccaaggctggagagcagtggtgtggtcatagctcactgcagcctcaaactcttggactaaggtgatcctctcaagtagctggaagcacaggcatgtgccaccacccccagtcattttttaaaatgttttgtccagacagggtctcgctttattaccctggctggtgttgcacttcaggccgcaagcgatcctcccacttcagcctccgaaattgttgcggattacggggtgagccaccatgcctggcctttgtattttaagagtcttaaaagtcttttaagagtcacaagatacgtaatttatacacagaagtatacctaaagaaactgtgtaaagaataacaaagatgtctttaaaaatgtgcgttgtgattgtgtctttcaatcagtaatctcctcacatattccatgtgttgcattctttgttggtccttcttctggaattccagttagatgtatgttagactcccctcaatccattctccatttctcttaatgtttgtattccccccctttttttacattgaaaatgcaaaacagggagacacttttctctgaacaatctcagttcacaaatactctctttatgtctaaactgccattaaaacccatccattataatttaaatattttaaatcagccagctcctcccccttttaaaaactttatttttagatagcaaaaaaagttcaaagaggtcttttgtatacttcatctaaaattttaaatagttgcctgaacattttagctgtgttttattctttaaatagagtacatgtatttattttgcctctgttagtgagtcagttcttcctgttatttctgttgattcttgcttagggtgctgtttttccttatatatgtagtcttttaaaactatgaactttcctctttccttgaaaaattatgcaatttttttttttttggtctaaaattaagatactttctttccacaataaaggattgaatttcctgttgctattgcctagaagcactaccagtttccgacagttaaatttccggaatgaagttttgaaccaccaagatgatgtgcacttggtctgaaaattcacatgtgaagtgttttgtggatacaacttctgagggtctcccccctcctcttccacagaatcattgttattgtcattcagtctttttgaggtgatagaggggcaggttactcttagtatacccttatgttaaggtcataacacttttggatctctgctttgtagtggtataggttttagatctctgctttgtggtgacggactgtgaatccatcatcacagtcaaaatagtgaacatctttatcactcctagtagtttcaccttcatgttaacttttctggataaataattcaaggctgaaagttttctttaagtagtttaaagatgttgctccactctcattgtttccatcaagaaatctgttttatttttgttcatttgtatacagtgtatcttttttctcttctggttgcttttaatattttctctttatcactggttttaaacagtttggaaattatataccttagtgtagtcttctgaatgtttcttgtgcttgggggatgttgagcttcttagagctatagatcatcaaatttgaaaaacttttatccgtaactactatttctaatattttttctcttcctctgtttttctcctttggggatgccaattatacatgtattaatgtactaatgacttttcactgctcactgttttttttttgatggagggcttcattttgggtaggattaacagagattagattttttttttttttttttttttttttttgatacagagtctctctctgtcgcccaggctggagtgccgtggcgcaatcttggctcactgcaatctccacctcccaagttcaagttctcctgcctcagcctcctgagtagctgggattacaggcatgcaccaccacacccagctaatttttgtatttttagtagagacggggtttcaccatgttggtcaggctggtctcaaactcatgacctcgtgatctgcccacctcggcctcccaaaatgctgggattacaggcgtgagccactgtgcccagccagaagattagatattacaggagaaaagataaatgattttgaagacagcaatagaaagtgacatcctgttctaatgaagtcttaggtaattgaaatatcaggtgatgtcactgtgatttttgagatttaattagagttagcttttgctccctgttctatttatgtgaggattttaatgtctttctcatactttatagaaatttctaccctttcagattttcctcacagttgctcacatttcctactctctgtccctttcctgaactcttatggttgttatcatctccccttcatatagagctttaaataaggaacaatatacatttgcaacaagataaattctaacagtataaatcctttaaaattactgctaagaataacagtgatagcaagcattaaatccttagtatgccttaagtgctttgctttgtgtgttttgaccagtttaattcttaggacagtcctgtgcatgtatatatgatgattgttctgtattttactggagaagaagtgagacacagagggttgtcaaagtcatctagcttttaactatgaaaatagtagtagtatctaagtcattaagtttttctaaaggttaaatgagagaatgcatgttaagatacttagcccagtgcctgaaaatgtagtaagttatcagaataggctattgccatctatagattgagaaatgtttagataaagtatgatgtttggagttttcttcacagtagtctaagggatggagtgagtgggtgtatagataaaatcagctatgaatggatacttcttgaaaatgggtgatcgattcagtggaattagacttctaatacatgtttgaaatttaatgtaatttaaaaaaatggaataactgaagaaaaatgaaactgggttttattaaaaaggttctcttattcagtttggatataaagcactatgatgcatttttccctagatgtgccaaaatcaaaacttaatatatacagtgacaattactaagaatagtactgtatcacttggcaagtagagtagtagggcacaggacttagtaagaccataatgtacattcagaagtttgaagttattagctaagtgattctcagccttttaaaaaacacccatccatgtatatttgtatgcatgttgcccagactggccttgacctgggctcaagtggtcctgttacatcagcctcttcagcctcccgaatacctgggacttacaggtgtgggccactgtgcccagcaaaaaacacccttttattatttatctcctaccctttactcatgagcaccatattttcataaacttcttacaaaactgtattaaatataatttatatctcaataatttaaaaaagctaagcatgctgattaattctgatcaaaaccagataattttaccaggtttatataattctagccagaagcacaaaaagttttacttagtctgtcctaactaaatcctgggcatacatcatttttactttattttacctattttgaaatatggagaatagttcattgtgactaagaaagcccacaagaattactactttagactgggtgcggtggctcacgcctataatcccagcactttgggaggccgaggtgggtggatcatgaggtcaagagactgagaccatcctggccaacatggtgacgccccatctctactaaaaatacaaaaattagctgggtgtcgtgactcatgcctgtagtcctatgtactcgggaggctgaggcaggagaatcgcttgcacccaggaggtacaagttgcagtgagccgaaatcgtgccactgtactccagcctggcaacagagcgagactccgtctctaaataaataaataaatactactttaaaatgcaagattaaaatctaagaaattactttgaagtatttatgtattaatcaaaactacatttagttcatttgttggttattctttccccacatttcagctgtaattttgattaaagaaaattcagtttacctaggtatatcatatttaggaaaatagtgtgtgtttgcttgtttcttgttcacatgaatgtaacaagatatatttagaaacaggactttgaaaaatatttattttgggataaggggaatttgtacatggttaaattttatgaattagaattttgtgaattttgatactagttaacctttctatcaaatgcgtatatgttgacatcatcaaattcttcaaaaagattgtttttcatcacaatgtaaataaagctaagtcaaaagggttaacatggaatcctcatatttctgctttatttgttcagatttaacatagtaatagtttttattggatgtagagaaatcatagtatgtgggataaatcaaatgttgctctttcacgaaggaacaaacttcgggtcccctatctaacagtaaagcctctttaaaagcctcttgccaggagtggtggctcacgcctgtaatcccagcactttgggaggtcgaggtgggcggatcatctgaggtcaggagtttgagatcagcccggccaacatggcaaaaccccatctctactaaacatacaaaaattagccaggcatggtggtgtatgtctgtagtcccagctactcgggaggctgaggaggagaactgcttgaacctgggaggtggaggttgcagtgagctgagattgcgccactgcactccagcctggacgacagagcgagactccgtctcaaaaacaaacaaaaaaactctctgaaaatattcacgtgcttttttgtgctattagtatcttttttttttttttttttttttttgagacagagtctcactctgtcaccaggctggagtgcagtagtgtgatcttggctcactgcaatcttcgcctccccagttcaagcaattcccctgcctccgcatctcaactagctgggactacaggtgcacaccaccatgccgggctaatttttttgtattttagtagagacagggtttcaccatgttgtccaggatggtctcgatctcctgacctcgttatccacctgcctcggccttccaaagtgctgggattacaggtgtgagccaccacgcctggcctgtgctattaatatcttatacaagttataatgttgctcaacattgtagacagttgagctttaaaaatgttctccttaaaaatggttaaattgggctggatgtggtggctcgtgtctgtaatcctagcattttggccgaggcaggagaatcacttgagaccaggagttcaagaccagcttgggcaacatggcaagacttcatctctacaaaaaagtaaaaaaaaaaaaaaaaaaaaaaaaaaaagcgggtgtctatagtcccagctactcgggagaatgatgcaggaggattgcttgggcttatgagtttgaggctgcagtgagccgtgatggttccagtgcattccagcttgggtgatagagtgagaccctgactcaaaaaaaagttcagacggataaattttactacgtatattttaccacaataaagtcagtgcaccagcagttttctataacagaaattcccatattgatctacattttctctcctactgtcctccattcttcttgtacctcttgtatcccactactaagtaaacttccctttatcttaacaaactttcctttatgttaacaatttcatagtctttcctcttgtctgccttagctgagactttcattgaagaaacaatggacatttagatgctcatagtattattacttttgtgattttagtgcccatatagacaattacacagtaattgtgaactcatttccaatgatttgtttcttgactgtgccttagctaggcatttagttttcaggttgtaccatggaccttgccataactgacacataacctctcaaatctgctgatctcactgataaagtcagttccagcttgtttgtttggctgtaccaaccagtactgtaccctgatctctgatatgagttactgtcttagagttttagctggtctttcccttctattcccttctttgggtcttttatatttctgtttgatgattttcctagaatgtaaatgtgattattacattctggttagaattcttcagaggttttccattacttagagaattaaatgcacaaatagtgtgctatacttggcccttcacagtttgcctctggattttatcagttattgtctcatattctgacttttgtatatttttctttggccatattgaagtatttatgtgtggattttatcagttgttgtctcatattctgacttttgtatatttttatttggccatattgaagtatttacatgtctcaaacatgcctctgtacctagcataagatgctgttcttctctgctgtgcttttcttggtattgaggccgatttaggcagtggtttcttgtaaattatatatacgtgaattatatctcttgtcacagtatggtatcattttgtatttgtgactatttgttagtagtacaaacaataatggattctttagtccatgtaaaaaggacatagaaaaaaactaaataatatttgttgacttaataacttaaaaacctaataaataatttacaaaaaggaaataaaagtagcaaagaaaactattattctagcttcctagtagccaaagaaatgttattagagtctatatttgcactattatgattagaaaattttaacatatagcattcatgctgacaaagtaaaactggtgttgatgtgatgttttttattgatttaacccttgtggaaagtttgacagtacatggcatccagaactgaaaaattattttaagtgtaattataaagacaagataaagaataaaagtcagatgtaaatttgcatgttcattattattataattgcatttaaaaatgcatagttaggccacatgcagtggcccactcctgtaatcctagcactttgagaggccaaggcaggaggattgcttgagaccaagagtttgagaccagcctgggtaacatagaccttgtctttattaaaaaataagtaaataagtacatgtataattaaaagattaaggaactatatattacagtggtagcagtaattttgtgatgttggaactatgggtgatttcccttccttttatagtattttctataatgtggttacgctttatgatttaaaatgtatacaacttatgccaatatttgaatttttaaaaagatgtaatcctgaatcaacactctaatataagagcactcaaccattatctgagtaatttttttctttcataatggcctttcagggtcagagttggagggagatgggtgattgccagttaaaagttgctgttgagataaggtatgagtggccagcatagagttgatcacttaattaaggtttcaagattgactcatttagctgttctttatttccaaaatcttaatcataaatgttttgttttaaatgtagttttgttttggttttaaggtatcagtttttggaagaagcttttcaaaatcagaagggtgcaattgagaatctactggcgaaacttcttgagaagaagaattatgttcattttgcagctactcaggtgcagaataggtaagtttgttgccttaaaaccataattttaagaattactaaaaagaagtgggtccagtttaaatctgtttttctgctatattaagcatataaagaaaacatttttttgagggggaaatggtatgaatttgggattataatatttgtcaattaaacaaaatttaattgaccaaactcttgtatacccttttaggacacatctttgtctattttaataagactgtggtctgtgttaaaccttaaatgtggaaacaaataaattaatatggagagagttgacttataaaatttaaagtggagattgtgtggaagatacagtatagagaagagagtatcacgggtggaccaattatttccccatttgtaaaacaagcattgaaaacagtgcttatcttaatgagtagcattataagatgaatacatgatatagtttctggtacatagtaagcagttagattttagctgttgctattgtatttataattatcatcaccatttattatttaaaaagtattctactttggtatatttctaagtaaatttattgataagtgagagtaggttccataagagagcagattaacaaagttatgactcttacaccagaaagacaaacactttgagctggcataattaaaactaaaattcttcggggtatgaataaggttaatatgtgtttatagactcaaaaatattaggacttctaatgaatattaaagttcattaatttatgattaaaatgacacatagtagatgctcaaaagtattaaataattgaatgaatgaatgaatgaaaatagtactttacacatggtagaactttttttttttgagacggagtctcggtctgtcgcccaggctggagtgcagtggcacaatctctgctcactgcaagctccaccttctgggttcacgccattctcctgcctcagcctcccgagtagctggggctacaggcgcccaccaccatgctcggctaattttttgtatttttagtagagacggggtttcaccgtgttagccaggatggtcttgatctcctgacctcgtgatccgcctgcctcagcctcccaaagtgctgggattataggcctgagccactgtgcccggccagaactttttatcttaagtaacaccaaaagaaaataaaaggctccttagagcttgtagattgtacacacacacacactccattggtgggtttttgtttttggaaatgttcagttgttttaggttaaactggtgatacagttgatttggagaagactgtttctcagaaatgatagatggatgtctctttcaaaggaaatgtagtgagttgattcatatggcagtcccatatttttatacagatgttttgtgtgtacattgtataagtattttttaaatatattttgtacacgtgttccagaatctgtatacaaaagtagggcaagaggtttacctgttacaagattgcacggggttgaggagattgatttcatctgtagaaagtttttaaaaaaacagtattaaaatctctgataacttccccttttagacacatttttcactgacctatctccattattttttaatgtacatttttttctttcttcaaaactgaacatacagtagacttaattaaatccaataggagtctgactgagactaactactctctaactactctctgttttcagcatgcttagtgatttctatcttcagcccaatcattttatatttgaaacctatatttcttatcactagttattagtacctttatatattaaaaatatcttccactcaccttagtaagataaggacaaaactcaaaattttcaagtaagtgccaaacgatgtacagagaaggaaaaaaactacattatttcttggagtgtattaaagttaactaaattcgaacttggcaaatgaaaggcagtttaggagctgaaagcatgggttatagtttttacagaagtagaatgtataaaaattgaagctatgtcttatggttggtcgttgacattttatatatttatagtggtgggattatccacttcctgttttgtaaataccaaagtatcagccacttcatatttgcacctaaaacttccataactgctttgagtgcttacacctacttataaaacatctaaagctattcttaaaaatggattgaaaatgttttatgccctttactgtatacaaagggaaaccatattaagagtaattttgaagggagtgtatcagaacccatgtttgaagtggctaagttataaatgaaaataaatgcttctatgtttaactattatcctttcaaaagataattattgcttgtgacattgtccttttgcacattgttcttggaaaacgtcaaggttaaacagaaccaatgtgccacatttgacactatccagaagtcactggtgtttgtgcatcacattcatgtcatagttacttaagtagattgccatccagcttaataaactgtcctttatgagcataatttaaaattactaaatattagtttcattatttgtctatgtacataacttgtttggaccaaattggtcaggtctgctgaaacatgagttgtacattttgacaaagttttcattttaattactcggttaagtgcccagttggatgaatttctgtaacagttgatgattcagagacctaggataagttgataacctaatgatgcatttctcttattcaggataaaagaagtaaatgagactaacaaacgagtagaacaggaaattaaagtggccattttcacccttatcaatgaaattaataagaaaggaaaatctctcttacaacagctagaggtatggttcaaagccaaaataaaacaaaaactgcttctcttgctctttagctgtttttaatgtttattgaaaactattttagatggattggggggtatggaaataaaggaaaacgtaaaataaggtttttaaaatttacttttggaagagaccttttctagttagttactttgcggcccaatttaataacactgactttagctgtataccttaggaaatagtgatgtcctcttagaaatcaaataattgttactaagactgggtatggtgactcacacctgtaatcccaacactttgggagcccaaggcagacagatcgcttgagccccgggatccagcccagcccaggcaacatggcgaaacctgcctctacaaaaaatacaaaaattagccagggtggtggcatgcaccagtagtcacagctactcaggaaactgaggtgggaggatcgactgagcccgggaggtcaaggctgcaatgagctgtgattgtgtcctgcactccagcctgggcaacagagtgagaccctgtctccaaaatgaaaaacagaaaaagaaaaaagaaatgttactaaaatgtgatgtacgtaaaggcaaagtagtcccaccacatttcttccccacccccttaagatggggcctcaatttaattttaccatatagattcatgttgggcttctgcttgagtcatttgtgtattttaccttattttaaaaatatttccatagttttgcagaaaatgctgctctttttgaaatttataaaccttaaacttagtgaaaattttgtgatattaggtatttatattgcatattttgaagtttatttgtaggtgtaagtttctagatgaaaatctagtcagttcatgaaatctaaatttttaatcaaagtctccactgccgatttgatttatttttagcaaatttcaaataggagttttctgggaaattgaagtttcagaaagagaaatgtttcctgattgaaaatttcatgctctggaaagttgaaattttggaaagagaaatattttctgattgaagatttcatgctcttaactaggttcagatgatatggggattattttttctgcaccattgaatagtaataatgaaatgatttatttgattatttccattaacctcaaattgtcaatagtttttttttttttctgtcccatctcttcatagaatcctttaaaaatattaggtgaataattacataaaaatgaaatgatgtcagtagaatgttatctctgaatggaatacatctttccagtgaaacacaatttgtgagattaaaagtactcttggccgggtgcggtggctcacgcctgtaatcccagcactttgggaggctgaggtgggtggatcacaaggtcaggagttcgagaccagcttggccaacatggtgaaaccccatctctactaaaaaaaaaaaacaaaaattagccaggcgtggtggtgtatgcctgtaatcccagctactcaggaggctgaggcaggagaattgcttgaacccgggaggtggaggttgcggtgaggcaagattgcgcctccgcactccagcctgggcgacagagcgagactccgtctcaaaaaaaaaaaaaaagtactcttgtgcagattgttaaagttgtgggtcccttttcctactgtacaccagtctgttgcatttaaccctaataggtttttccccccaaaaggacccatgtgaatagagagcacttagtaactatttttgatacacttaaacttactgtaatacatttgagctgtacgtctaaaatagtatttgtaaaaccatttcaagagtttctgaattaaaagatgcttcttaagatcccttgagcctgggaagtggagtttgcagtgaaccaggattgcaccactgcactccagcctgggggacagagtgagactctgttaaaaaaaaaaaagcctcttaaggctaaagtgtatacaaatacctaatggtaaatacgccacatactactaacatgatgataaatttaaaatagatgttttctagtgtaatatgttcttatactttgtagaagaaacgtttttctaagctttataaaagaaatgtagtaaaccatacttctctcagttgaatactcttatccattgatttacattataaaatgaacagcttctttccttaggaaaaatattgtccagaaaaaccaacttgagtcatttttgggagaaagttcttaagaaagtagtagatgagttgttcagcatgctgaatgtcaaaagtatgtaggacattacccatccctcctggggtgattttagttcccataaagcagtttatttttcctttgcagtgtttctctgaaattggtttttgcagtttggtcagtccttacttctttgttctctgtgaacttctgtgatatcaaaagtttccctaattctactcttagaactctggaagttatctttttcattttgtcttatatatttaagagagattttaacttcattctcatgccataccaggaggtggcactggtgacacaaaatttttttggcctttaaagtatattaagattacataaatttatttctaaagttagctccttatgctataaataccatatattagattaatctaataggaagacactatttttaacagacatgttgatagaaaagtgacattaactaacattcatttctatatgtggaatatcctttttagcttagagaactgacttttagtcccacttttgttagtggcttttcctctgatgataggcttgctaaataatcatggagcttattcacttagcccatttttaaaggaagtataggtattgtgcccatttgcattagaaatgtggggttgattttttttcatatggaattctacagcgaagctcttgttctgtttcagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactggtgagacacatactgtttttatttttctttaatggactttattaagatatatattcagtgaattgcacctgtttaaagtatacattttaattttggcaaatgtaaccaccaccacatcaagatacagaaaacttccaccaccccccaaagtttcctcattccactaggcagccactaatctgatttctgtcattttttagaatttcatataagtggaattatatagtatgtactcttttgaagatacctagtatcttaatgcactttattacccaaaatggcagaaattcaagtatgtatatttgatttgattgctaatttaaatgttgatgctgcctaatctgaggctgacactgtgggaatatatgtgcttttttttcttaatgtctttatcttatgatttcccaattgatatttaattttgagactaatgtggatttttttccctttaagattactttccagttgcgtcatattttgaaagcacggtgtgatcctgtccctgctgctaatggagcaatacgtttccattgtgatcccaccttctgggcaaagaatgtagtcaatttaggtgagaaataatgagttttatgaatataacttggaacactgaattagaaggagaaaatacttaaagcaaatttagataaaatttttaactttataaaactaatgttttacattttatgtaaaaatatgttgttattcattggaaactcactttagctgtggttttgtgtggctgttattacatcttaagaaagttgagcgtctactctgtatattgttttttaatgtgtgctgtttctagtcccccgaccctccatcttttaaatttatattgactgtttcatatagaaatcttagcaaatgattcattgtctggaataatttcatagatttttagttgtttaattaagccaaattgtgcattagcaacagacttttaggatgctaatgtgtccagtagttaggtcctgaggaatgtttgaaagataagagtagctcttttcacatggaagagaaatggattttccttttgttacagcgtagtatggacctaaagaccatagatgaaagttacagagagctcagttaaaacacatgcacacaaacttcctagcaattagagagctatttacagattgagtaaactcactttcagaacagttaagtcctaaacagtgggaattgtaaaagcagaggctggttgccctttttttttaaaaaaaaaaaaaaagtaatctttgcatataataaaaaaaaattatattcaaatttagctatagccttagttctgacatcagccagctgtttttgtgtgacgtagtagctaagaatggtttttacattttcaactggttgtaaaagcaaacaaaaaccaaggactgtgagacagatcttatgtggcctgccaagcatgaaatatttactctatagcccattacagggaaagcctgtcaacctgtgccttaaatcacatcttcctaaaatttggcttctatccctagaaggcaatggctccataaaaagcaaggaaaaccatcacgtctaaggatataagttgtttaaagcattcagtatttccacagaagacgattttgtgacattgtaatgctctgccttgcatattttggcaattcaaaggcagatggaatcagtattggcaatcttgagtatccttgagtaagtcttgtcatgggagaattgatttagattgattagataggcctcttctaatagataatctcttttactgtcttaattttctgtatgtctaagtaaaaaagaataaggacagagagtatatttttctgaataaccaaacgtcatttattcagctttggaatgtattaagtttctgatcatcatcatcatctttaaactgactccattccctgctgtactgttggagctttgaggtgctgatagttgtcagaggaaagaggaaaacatggtgattactcaacaaagtagatgatttagttgattatatgcaaattctcattttttaaatttttcaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacaggtaagtatcgtgttactacattattgatagaaattatgaagccctcaacactacactttttcctatataattaagttacacatttcaaagttactagcaagactgagcagagttcaaaagtcagagtttaaatatttgctatggttatgatggtgatgtaagggagctgtgaagaaaggcagtaagtaaattgtcttgggaaacaaaattaattcactaatactctgaaaggatgtaagttctcatcctttcacatcaaatcttttttgttttccacgtataattttgtggaccaaaggaccagactgtttctgcctaggatctgatatgttccttaggcatttgttcagatctttcctatacctgtgtgtcttttgctctctccactgccatcccaatcaaaactattactccaggatgggatacgttaatgttgatacgctttaaacacacatatagagaaaaagagggggaacaggtaagagagagagagagagacaagggaaattagggagtgatatacaaactagtcattaccagtcctctggggattggggctagcgataagaattatttatactttttactttatacccttttatcttgactgaattatttttatgattacattttataattgagataaatttattttaaaattattacataaattgcaatttctactttttgtagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaagtatgcctagagttacatttgtaagaatcctacaattttaaaattaaaagacgtcattttcttaatcactttttgggagcaggtcattgatgtgtttgagaatttgattaatgctgtatatcctcttgtcccagaaaaataaacatacacatgagattttgtatttaattttaagagcttttaaaaaatgctttaagtgcatcatatactgtgggttaagaaaccctgatgtagttaacccattcaatttgcagaagtgaaaaaaatctaatgagctggtgattttacccacaatcacaaaaagcaatgataaaatagcaagaacattagtttcctgaaaatgctgctctgctcttttaatgtggctttttgatcctaatatataaaaagggctttgagagtaacagagctaactatatgtattattattattatttttttttaccttttctctactcaaatattcttccttttaggatgtagatacgctttaataagtgtgtttagagacatgttttataatctttgcctggttatgtttatatgggagatatgagtatacagtgaggccactttttcataggatttctagttataatagagtttattttttaactcttagaatgatgtttctcaaaacatgttttaaagaccatcagaatcaccagtcagctttggtggagtgggcaaccttgtcagaatggattcctagccataaccactgaatcagaatttctaggtggggagtactcagtaatatttaaatttgtattaagtctctcaggtcaatctgcgtactaaagttggagaaacactgtcctagaacagtggtccttcaactttttggtccatgtacgcccagaaagagctttttaaaataatgcgcttcttggctgggagtggtggctcacgcctgtaatcccagcattttgggaggccgaggcaggaggattgcttgagcccaggagtttgtgaccagcctgggcaacatagcaagaccccgtttctatttaacaaaaaaaaaagaaagaaaaaatatatactcgctcacatttgaaggctttcatttaaaatttccattataggtttaagtttaaatagtttcaaaagctgtactttatagcatattgtaaatattgatgctataaagttaaaaaaacctttgcattattttaaatgaatccgctggaattccagataccctagcaagctctccttggacttgaattacacttctacttcttcaacagagttttatcttactgtaagatagctttatttgatagatatagattagcctattgtaaatttctgcaggaaaaaaatttttttataataaattgttaaatttccagtgacaatagggttattattaagatttgaaactttttctgtggaccgaattatcgttatatctccacaattgttgaaacaaaatgggtgtgtttacatggtttaagactattagaagatacaaaactcttttggatatacatttctttgagctagatggagactttttacctcctgcttctggttatgtatgtttgtatgctgttacttatttttaaaataagtcagaattcaacattggtttttattactagttttttgggatttgtttttatgtaatgcttaggaaacgtttacaaaatttacaaattacaaaaatacataatttacaaaattatgtatttgggaattaaaagaattttattatagtaatatccctcaattctttgaattttttctaggttataggctgagaaaacgatctatcaaaactatttaaaaactttttgtcagtgacaacttcatttttgttaatcatcaaatattcgaacccatttgaaggtttgttacccaggttttggagtcagacacccaacatcgttatttccaattgtacctttgattatttctacaggtttttttttttttccttcctggtgcagtgtgcctagaataagatttaggaatggtcaaaggtgtagtgttcttttgtcaaggatggaggaagggcagttgcgaaagtggtggaaaaggagatccagcagagcatggcacattctcaggcaaatcagattttttttttctttttaaagagcacatacaaaagattgatggtctgaacatttatttccttcacacttttcacataatcatgtaccccttagttcatggaaggccttcaagtatttctaggggccaagtacaccttgtcagagcgcagaagctacacagtcagactaatgaatcatctcagaacattttccttagactttgggtatacctctacagaaatcactggatgttattaagcctttttagtttttaaatatttcaaatgatttatttatatgtgtagaattcgttttcttaagattttcttctatattgtcttaaatgatcctcataacagccctcacaatgaaacaagtgaggtattgttatccacatttctaaatgactgagattatgtgatttgtctaaggtcacacagtattagagtcaggacttgctgccatttttcttttctgtaaattcattgttctttctgccacttcaagctgcattatatatcatttttattggaaaaatgactaaaggtcgaagaggaataatgaccgaatggtagttctcttaccccggtgtttgaaaatttggaggtttacagatcctctattacatacttccttcttctgaaataagatcatatcaccaggctgatgtgttgggaaattattggcaagtctgcctttccctagatactatacaaaaatgaatagaaaaatgaaaaggctgagtttgaactgttcttctcctgaataagtttgaaagggcccacttctttgtttcttctgtttccttcctaaactaaaaattataaaggtatagtttatattcagcgattctggcagatcaagtaatgataatgtcttctttcttattagcactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggtttgtatttgagttgaatgaggcttcattaaacttaatgttaattacagagttagagtatttatttcagagttttttttttttaattcaggatcaacatttccttgaaatttctgaagagtaaagtctaaatcactaaaagtctccttccagtctaagtgaaactttcatcaacatcctctctttccgcattccccgcctaccctctcctctagcctccagttaaccatctttctatcctctgtttctatgagatggacatttttagattccacatgtaagtgagattagtcagcatttgtctttcggtgcctggctgattatacatagcataatgtcctttggttccattcatgttgttgcaagatgacagaatttccttctttttagaggctgtatagtatattccattgtatatgtctaccacattaaaaaaaatccattcatccattgatggacatttagattgcttacatatcttggctattgtggataatgctgaaatgaacatgggagtgcagataatttctctgatgtaacaatttcagttcttttggatataaattttagtgatctcttgcattgcatggtgacaacagttgattgatagtgtattatatatttcagaattccaaaaatggatttttaatgttctcaccacaaaaaaatgatgagttagtggagttagatatgttcattagcttgattcagtctttctataacatagatcagagcattacattgtataccacaagtacacacaattgttatttgccagttaaacaaaaaagagttaagtataaatatttgagtcttgaaaagttatttagctaaaaccagcattcctcaatattttaaagttctggggaattgaaggtcgtatgaatagcaaattatgggaatatctaaacagaagtacaataatggtggattaatatcacttttgctaaaaggctagttactccctttctacacctgccacaggcaaacgttgttccgatgatgcactcctggtatgagtttggagccagagagaagacccaggaccaaaatgtggttagatctttgttgttcttctgttagatccaaaggggtagtcagttgggctgagaaaaggatggggttagaaggccaagatagtagacactttgaggcttatactgagagggggaaatgatggagaacaggagtagatggaatgtgaaggacctttgagtgaggccttttgcccctttcaaccgaagaaaagtatcctttggatccttctgaaatttcaccaatttgtttcagttaaaagcattttcttttaaaacgtaaatataatctgccagcgttatactgaatttagttttatgcattgtatgcgttactttcatatcttggagtccggggtcaccataggaacaaggagcaatgaaactgttgtaacagtagcacccttgattctttctgtggctgcagtttaatattttgttttagtgggttttaatgggcttatgtaaaagttttaaaagatatttctatagcttcaaactttttaaaattttatttaaagtaagtgtgtatatttaaggtaacaacatgatgttaaacatatacatagtaaactggttactatggtgaaacaaattaacatatccctcatctcacataattacccatccccctgctcctgtaagagcagctgtaatttactcatttaacgaaaactttgaatacaatgcactgttaacaaaattgttcagaaatcactaacatattgtgaattctcttaacctgattgcttccctaatactaggagaagtcttttttggctgagggaatggtagttttattggtgatgagaggactggaccatacagaatggaaactttttaaatataaattaaaaagtaacatttctaagttaacagcttatagtttgtgaagcgctttcacaggcaatatataagtttaatgcttaaaatcacctgatatgtaatatccctgttttatggataagagtaagagaggttcgtataaccgcctgacgggttatctgcccaccacacaaacaaaatcaattcacggagaccatggcactgcagtaaagagtttaatgacgcgaggccactcacgccacgcaggaggtggagttattactcaaatcagtctctttgcaggcttgtagtttaggagtttttctttttctttttctttttcattctttctttctttttttttttttttttttttgagatggtgtctagctctgttgcccaggctggagtacagtggcgcaatctcgactcactgcagcctctgcctctgaggctcaagctgttctccttcctcagcctcccaagtagctggaagcacacgcccccaggcctggctaatttttgtgttttagtagagatggagtttcatcatgttgaccaggctggtcttgaactcctgacctctgccttggcctcccaaggtactaggattacaggtgtgagccactgcgcctggcagcttaggggtttttcaaaggtagtttggaggaaggggtgggggcagtaaggcaatgggtgcttgctgctgattggttggggaatgcagtcataggggtgtgggaaaatcccccttaattgctgaatcgcttctgggtggggccacaggagggcttgttggagggcttgttgggtccaggtggagccattgtcagtgtcagacatgcgagaaacctcaaaagatatctaaaaaggccaatcttaagttcagcaatagtgatgttatctgcaggagtaattaaggaagttgtctatattatgacctccagagtaatggctggcagtcctttatgtcaacaccttagcagaattcaggctcctttcctcctcctagcctggtggtctctttttaactttacaaaggcagttgagttttggggaagggctattatgtaaaccataaactaaatgtctcccaaagtcagcttgtctcaagcccaggaataattaatatcagcatgaaggttaaaggcaaagaagagggaggttgactagatcagatcctccccgactctttcactgatagaatttttgcaaaggcagtgatacagtttggctctgtgtcctcacccaaatctcacctcgaattgtaatccctactggtcgagggaaggacctgttaggaagtgattggatcatggcggtggtttccctcatgctgttctcacaagatctgatggtttttaaagtggcagtttcctctgcactcactctctctcctactgccttgtgaaggtgcctgcttcccctttgccttctgccatgattgtaggtttcctggggcctccccagccatgcagaactgtgagtcaatttaaaccgcttttgtttataaattacccagtctcaggtagtatctttatagcagtgtgaaaacgaactgatgcagtttcattggtgactttcctagagtcacatgatagatagaaaagttggaattttaggctgggtgcagtggctcacgcctgtaatcccagcactttgggaggctgaggcaggcagatcacctgaggtcaggagtttgagaccagcctgaccaacatggagaaaccccatctactaaaaatacaaaattagccgggcatggtggtgcatgcctgtaatcccagctatttgggaggctgaggcaggagaattgcttgaacctgggaggtggaggttccagtgagccgagatcgcgccattgcactccagcctgggtaacaagagtgaaactctatctcaagaaaaataaataaataaataaataataagaaaagttggagttttaagtccagactactaattataaatccagttctttctccacactacctgtaacaataccagggaggcagtgtgggattgtaggcctggaaacacatggtattgacagctttgggcagccagaggtatgtacagtataacaatgtcattcagtttttactaagcacttactgtatgctaaagtcctcaagcattgaggataagataaacaagacttggttctagttcttaagaaacttagaaagggagaggcaagtatcatctacttttttattgaaatacaattcatataccatgagatccactctaaaaatgtacagttcagtggcttttaatgcattcacaagattgtacaaccattaccactaattcaagaatattttcatcacctcaaaagaaatggtactcattagcagtcactcatatccttctcttccagcccctggaaaccactaatctactttgtctctgtggacattccacatgtgaatggaattatatttggcctttgatgtctggcttcttttacttagcataatgttttccaggtctatccatgttttagcatgtattaggatttcattttttatggctgaataatatttcattgtatacatatatcatttgttcatcattgaacatttgcttttcttctctggctgtcaggaataatgctgctgtgagctttcatttacaagttcatacaagtatgaacgtagtgtaccaggctgttgttgcattgctgtttataaagaaaagaggtttaattgtgtaactgttctgcaggtttacaggaagcatattcaggcacatttatggattatttttaactctttttctactgaatttggctagattaagaattcacatggagaaaacctagcattagcattagtttaagctggtgaaatagccaagacagctaagtttaagactcaaatgtagaggtgaagtctcaattttcttttgcctaatcaagaaaaacttcctcaaggactgaattatactttagtgtgtagatatgagatatatttgttggtcaagatagagtatggtatatgcaatggcttgagggagtgagaaggcacaactggagtaatacagaagtgagttgttatacaaaatagaatagatgaggaattatttgtatagcttttgattatactaagtcagatgtattaatggtgatatagttaggtaactagaagaaatatattaaaatgaagaattttagcatttacattttatttatgcaagaaggtaataggagatagtaaatggaaaacagggaatgttttgtagtatatttagtgtttcacttatggtacagtacatgtatctcattaatcagttttagaacatttctgtttgttggtaaaatgtaatattttcctgataatcagtagaacagcacctaaatatggaatccttttattaggttcaaggccaagtcttcaatactgcataacactagaacatttctggaaacttggatcactattaatgcacttgtatattttctttaacaaatatctgagaacttaccatgtattaagaccctaagtactgattatagaaggatcaaacggaaatggtccttgacctcaaggagtttcttatataatagggagacagttttcttttgttcttttttattgctgttgtgcttttttttttttttttttttagatggagtctttgttgctcaggctggagtgtagtggtgcagtcttggctcattgcagcctctgcctcctgggctcaagcaattcttatgcctcagcctccagagtagctgggactatgggcgtgcaccaccccgcccggctaattttttggatttttagtagagacagggtttcaccatgttggccaggctggtctcgaactcctgaccacaggtgacctgcccacctcagcctcccaaagtgctgggattacaggcgtgagccactgcacctggccgggtgacagttttctaaacagggtcaaaacagtgagcttattggtacaaatggatgtgtatagatgacagtgaaagaatagaggcagaagatcctacatctgcctgtggaagtcagagaataaactttatatgagataatcttaaatttggacttgaaagataagtaggcaagtgttagctagtcaaggttagttagaaggcagatattccagataggaattatgtatgctgaagcaacaaagggcatgaaaggagtgtgagattcaaagcagttaggtatactgtagatgataatttcaaatcggaggtcagattttgtgatttttcttttttatgctgactttgtcactgttttattttaagctctcttaaacctgggtgcagtggctctgcctgtagtcccagcactttgaggaggccaagataggaagagcacttgaggccaggagttcgagactagcttgggcaacatagcaagacccagtctctacaaaaacaattaaaaatgagccgggcatcttggcatggacctgtattcctggctgcttgggaagctgaggcaggaggatccctttagcccaggggatcaaggttgcagtgagccgtgatcgtgccactgcactccagcctgggcaacagagtgagaccctgtctcaaaaaaaaaaaaaaaaaaaaaaatagaatctacctcatggatatgttggtaagattaagtttggtgcctgacatataagtatttaataaatgttagttgttatgattatttttctcttccttttctttttcaccagccctcattattaaaaagtaagctttgggaggaaggaccactattacgcttttgtattatgcttaataggaaaattataagcattcatccaagtgtgttgagtactttgtacttgtcttgaggaacagtagggataagagagacctgctgtcatagagtttacaggccaggagaatgcagacatttatagattttttaaaaccctacctataataaattgtatagcattactcaaaggggaaattgtaaggcatcaacctaaggtgagtatataccaggagaacccaataaaacttagtggattgttaaagcctctttgaaacctggaagcggggtaagagttagtagggagatgtcatcagtaaattttattaggaaaaagggcagaatttcaaatcccacaaggtctgaaggaactgggcacttttgaagaacagaaaaaaggccagtgaagaacaggaaagagagaagggcctagttctgtagaggaaaatggaaactagatcaggtagggcctttgtaagctgcataaaggattttggattttatcctaaactcagtgagaaagcatttttgaagggttttggtggggtaggatcagtgtacatgacctatcagatttgcctactttttaaaggcttttatgagccatataaaaccattgtagcttttaaaaaagaaaaaggaaaaaaacaaaaatagttgtctaccccattctttcacctgactaaatcccagcactataaccaattggtgtacatcctttcagatttttccctaggaatatgcaaacacgaatttaaaaacgtgtgtgtgtgtgtgtgtgtgtgtgtgtgtgtgtgtgtgtgtgcctgtgatttattttggtttattttgttttgttttgagacagggtctcactcttttgccgaggctggagtgcagtggtgctcaagggatccttctgtcccagtatccccagtaactgggactacgggcacatgctaccatgcctggctaatttttaaatttttcttttgtagagatggggtcttgctactaatagttgactagactggttttgaactcctagtctcaagtgatcctcttaccttggtatccgaaagtgttgtgattacagatatgagccaacctggccatcctgtaatttttttaagtaacagaaaatgagattataccacatgtacacacctagtgctataaatactgtgttgcaagttttaccttttttttttttttttttttttttacagttttgcttttggactttttcttttcagaaaaagtctttttcttttcttttctttttttttttttttgagatggagtttcattcttgttgcccaggctgatgtgcaatagcacgatcttgactcaccttaacctctgcctcccaggttcaaatgattctcctgtctcaacctctcgagtagctgggattacaggcatgcaccaccatgcacagctaattttgtatttttaatagagacggggtttcttcatgttggtcaggctggtctccaactcccaacctcaggtgatctgctcacctcggcctcctaaagtgctgggattacaggcgtgagccactgcgcccagctacttttggactttttcatgtcagttcttagagctttcttgtgttttaatccatatggtattccatttcattggatgtttttttagccctctgttggtgaacttttggtttatctctcacatgttactattaaaaacaaagctgcatttgtgaaaagatgttaagatcattagttattaggaaaatgcaagttaaaaccacagtgagatgtaccacgacatacttattaggatggctaaaattaaatagacttaacattaaccatagcaagtattggtgagaatgtggaggaactagaaccttcaaacactgttgggattgtaaaatggtacaatcactttgaaaaaagttcagcggtttctttaaaagttaaacgtgtatctgtcataatgattcagccattctgcttttatttgccaaaagaaaacaggaaatatttctatacaaagattcgtactcaaatgtttatagcagctttgtttgtaataagacaaaaactggaaacaacccaaatatccacctgcaaataaatggataaacaaattgtgtgttcatataatagaatagtaactaacagtgaaaaggaatgaactggatccaacagcaaggataaatctcagttttaccaagtgaaaaaaatagatgaaaaaagcgtacagtatataattcaaattatataaaactctggaaaaaaaaactaaagctgaaggaagcagatgagtggttggttgaggacaggttgtttgagagagggattgattaccatggggcatgaggaatcttgggggtgatagatatgatctgttcactattcttgatttgggtttcccagttgtagactatgtgaaaatgtgttaaactttcacatcaggtactacactttgaatatatttagtttattgtacatcatttataccttaatgtcatttgtaaaaagctgcattgaggcacaatgactgtatagttttaaacacatatttctgtaagcgaagttggtagaagtgtaattactgggccaaaagtaattacacatttaaatttcacataggtattggcaaattgctctacaaaaaatattgtgccagcttatatatttgaaaatgcccatttttgcattgtcttcccaatactaggtaaattaatcattcttccatcttttccagtgatggattaaaatgacattattgttaactttattttcatttctttgattggtgaaattggttttcttatgttcgttgattatttttatttcttctgtaaattatctttgtcttttgtgaaatatctttgctcattttcctattggactgtgtttttacttttaaatcatgaaaattatttatataataattatatttccatgtacttattcagggatgctcaaaaaacattgctttaatgaataaatgaattaatgtctttccagttagacttctaactttatttatggtgactatccatgtctagtgaaacccacaggtgaatgcttcagttagcacctatctgttggaggttataatgacatcagggatgtcctttaatgtatttcctgtttgcctcttcctgacctgtccatcctctacccttagagttatctttctagcaaaagatacaaattgcaggtgaggagtataaaaaggagtggaaataggtaacatgggattttcatgtcagttttgaatcatcttcccccttctgtttttaggtgggatgcatccccattttcatctctggcccatattaggtactcccccctcataacaaatcttcctgttgacttgagttgcagctagggattcacctgtagtcacagctttgcaagtgcatccttggccaacagctatgaccacagggtaacacaactgctattgtcctttgattatccctccaactaacctactgcctactcctaccttcagcccttcatgtctctggcatgggttttgttttgtttgtaatcccagtactttgggagactaaggtgtgcagattgcttgagctcaggagttggagaccaatctgggcaatgtagcaaaatcccatctctataaaaaaaaaacacaaaaattagccaggcgttgtggcgcatgcctgtagtcctagctattcaggaggctgaaatggagggcatggcttgagcctgggaggtggaggttgcagtgagtcaagatgatgccactgctcttcagtctggacagcagagccagaccctgtctcaaaaataaataaaagaagaatatgaccatttcttttatgaaatagtataagatttaaggtaatattcatacttaaataattttttttactctttcttacacattttgtcatttaatcatcggagttctgcaatataggtggcatgttttaaggataggaaactgacgttcaggttgagaaccagcccagaatcatagttatgggtcttctggctttatcgtactgcctctaagtaagggaagggctcatatgtactgttaactgtgcccttttttttttgtagtaaggggccttgtgtgtcaagctaagggctttctgtgggctataagaatttttcagagtttcagagctgggtactaacataattacatttctatttaagtgaatgattgtggacactgaaatggagggatactggggacaagaatactgataaataggtcctgcagcaattttgagaaacagcagaagtgtcagagcatgtcagctattttcataatagaacatataggatttgttttgctctgagcacctagttgtttgctgaataatacagttttatctaaataaactttatactgtgtgggccctcagtggaccctaaggaagcaataataaggctcagcttgatattggataatctgttagtttattaataaactgagtataagcagtgacataaaattaataacttctctgctttaatcaaagcaaatttgtctttatcttctttctcttcagttggaagatgctggctcaagtagtttagataatctactaagtagatacatctcaggcagtcacctacccccacagcctacaagcaccatgaatccttctccaggtccctctgccctttctccgggatcatcaggtaaagcaaacgggtattaccttattttttaacaccttaaaaaaacagtgtcagtatctgtcttagtcagaattctccagaaaaacagaataagtaggaggtctacttgaagagagaaagggagattgagagagatttattttaaggaattggctcatgtgattgtgggtgttggcagggaggtgaggcaggctggagacccaggtaagagtattgttacagtcttgagacaaaatttcttctttggggcatgaggaggtaggggagagaacagggctccgtcttctcttctctcttaaaagggctttacctgattatatgaggcccacttgcattatggaatataatctacttttctcaaagtcaacttgttgaaatgttaattaatcccatctaaaaaaataccttcacagtaccatctatactgatgtttggccaaactgctgggtgtcatatcctagccaagttgacacaataacatatttttttcttgattgttctttgtaattatttttgttcaaatactattggtactctttcagtaactgaagccatattaatatatatctgtagtctacactatttggaactccaaattactcaacccttagtatattcacagtctttcatgggtttaatcttatattttacaatacagagtcagttgaagagttctttggttccaagtcaactttaaaacacttagtaaaataatgaaacattgaaaaattatttaaaaagtaagagctaaagaagggcaggttaattttcaaactgtaattttaaaataaacattttgctgaaaactattaaaatagccatgatatgtagctctcttccaaaatcccagcggttttattaaccctattactcagtgattcaattgggactcttgaatacatgattgaagcaactccaaacaggttaacagtctagaagtgttattgaatgtatttttctaacgtaaattaaatgttatttttttcttactgaaacacaccacctacttctttctagaggaagaacaattcacatgtaaatatggattttccatgagatgcaacattaacatatttttaaatcacataatttttaaggtttaataagaattatttcaggacttctgaaaataattaatgggaacctaagtagaatattttatcaaataacttgttgagggatggcagataacgttttcttggtctgttttgttgactggatagtggtgccctgaggaggattctgaggtgatgtctggacacagctgagagaaactggttgatgtctgctaatggttacacatgcgtccctgactttgtgactaggtctgatttccaataattttttagctgggttataataatcttgagttctgtgaccggtaggtagaattccaaatattcttatatgcattgatattcattttgacttactactttttaggtttatccaattctcacacacctgtgagacccccaagtacttctagtactggcagtcgaggcaggtgagtatattgataattatttttttcctttttgttaagaaaaatagcaaatatgtataataaaagtagaatattacagtgaacccctttatacttaacactcagctttaacagtgatcaaataatggccaatcttgtttcttctatacttctgccaattcctttctggtctgaattattttgaaacaaatctcagtcatttcactcgtgactgtttcagtatatatcacttaatgaaaggaactttaaaaatttataaccacagaaccatgatcacacctaaaaaaatttaacaactcattctttaatatcagtagagatccagttaatgtttagtgttcccaatttttgcaacaaatgcctttgaaaaaaaaaccagatgatttctttgaatcagatgcaaataagctctatacattgccatcagtttatttgtttacatcactatcagttaatttgttgtaaaaatgtagtttctcctacagtgttttcccgatttctccatcttgtcatttaagtacattgcctcctgtttttctgtctattttggtatttaggtcaagagggttgatcagatttaggtttgatttgggggaagggagagcaagaagacttggtagtgtagtggtggcatatacttcctttggggcgaattatgcctggttgggggtttttgtgatggcaaccgttaataatcattgtttagctctattatttttctgctggttgaaatattacattttaattattgtatcattctttatttctttagaatatttctgtaaagagaagctttctgtcatcaactattgggttataggaaagataggataaattctttctgtttatttccctgcttttgtggtaatgaattgatttccaacaccctccaacagtgacagttttattgttattacctttatggactgagatatttaaacatactttatatattttaatccattatatatgttacgtctgtatgtatgtatattgaacactgaacattattccatctttgtcctgtcaaagctttctcaggcttgctccttagtccttttgctataatcacagcagtcttttttaagcttccatgtttcctgtgaaacagcatttcgggttcattttgtacatttcatgcttcagacctggaatcagccactttcccaggaagttctggtagtgttagcaggaaagcaggaaaatagtgtttgaggataatattctagtactaatagcactcattgctactgaattgttcattgtttcttaggccttttcagtggacagagctaagaaataggagtgtgtgtgtgtgcgtgtgtgtgtgtgaagaaagtgcttcaaaccataaaatgtgtttttagggtcttctgaaagttgctgcataattttaaagagttttaagctaggctttataccacattccccttaactacattatgaggtatccttatcttctgtaaagttaattgtctattgtcttcactttagtgaacattacttttcatataattgtttttatttataccatatagtcaaacgtatgtgatctttatttgttgtttcttattagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatggtaagctcccactggagtctgacagggacttaaggacatcacttcattgattctttcagctctgagtatattaagactaagtagtgggtctagaaacatttatttttgaaatttcatgcctggcacaagccagatatctctttttctaactcaacttttttgtctaagagtcagctgtaattaatcagaaaagacttaattgtattaagtactcatttgaaattatctttgaatttgtatttagtcaatattcttcccatgatgctaaatcagattgtatcttgtcctgaaattattatttcagtagtcacattgaatctcaggccacaaaagatctttgggattctcctggacctgtgagctcagcattaagattgctgacatgaaagaaatttattgatcagagttttgtgataggaagtttgtcttttggcttacgtattactaatcattctggagttccttgagtggaacatttataaaatttctaatacagaatgaaggaaggccaagcccctcttggtttaaatattttgatttttgttttctctttctgaccgggcttctttttccttttttatatggttggcacatgggaattcatctcaaggtattggtatatttaacacagtatatatagattcagagagcaagagattcagccttggttttggagtattgttacgtcttcatccagaacttggtttagaaagtacccccataaaaaaaatgggtgccaaggttggtgaacaatttcttttatgttgttgcagccttcctacaatatagtagaatgataggtgagcagaagaatattatagaatgcttctaaaatgctatgcaaaagattctgggtgtgaaaaggggtgtgccataattagctctctcaaggaaaagtataaccctatgctcacttcccaatcaatagcttaacagtttaattaatttacttattatttgagtgagacattatcagaggagcagaccccttaaaatcatatgttagcgtgcctgaataattttggggttattgtcatttctttatggcactattgtgatctataaaataaatttgttacgtcagtatatctatatgcatattcacataactgttaaatacacatatggcatacaataaagattaaatgattcttcaagaatttgtcatcgttttgttttagttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaaggtaccagtgaaataattgatttttggtgttgattttcataagctaaaaataaataacagaagaatgttcagggcagatggccttctaaccagtgcatagtatttctataaaacagggagcctgttattcttttggtattagcttccagagaaactaacaataaaatatctaagatctaagtagtacattaatgttaaagagtagatttcatctcctggcctttagtttatattcagtataaggaaaatagataaaactctaaattaatagggggctaaggttacaaaacctgcagtctggttctaattctgtagtaagcttgagcaattcactaattatcagggatcagtttttgcatctacaagtggtaggttttggtttagcagagctgtagttcttcccttccatttattattttatgttcatgcaacctcttgtctcttgatttcagagaccataaaatagtagagtcatacttgtttttttcagtcttctccttcctctcttgtcccccaatttctttttggtgaaagtaagtcagtattcttggggtaaacccagcttttttcttgctataaattgaaaaaaaaaaaaaaaaaagatatatcttctcaaattcctgagaagcagtaactttaattgaataatagtgccctctttgaaagtgttaaccttttggattagaaaactagtagatatttaaacagtgccagaatatttttctgaagaattgtaatttcttacctaagtctttggagatagagttatttgctagagatgtaataagggccttctttttctttactcttatttagaaaagaaaagcattggcactttgatcttgaaattaagaattttcttttctttgggtagtaatatttactggaatgtcagaattttgccactgaatgccttctttcaatagcaaatgctttgaaagggttgtaaaatgttggcgtaaattagccaggtgtggtagctcacacctgtaatcccagcactttgggaggctgaggcaggcggagcacttgaggtcaggagtttgagaccagcctggccaacatggcaaaaccccatctctactaaaaatacaaaaaaaaaaagaacttagccaggcatggtggcacacaccttgtagtcccagttactcggagagctgagccaggagaattgcttgaacctgggaagcagaggttgccatgagccgagattgtaccactgcactctagcctgggtgacagagcaggactccgtctctaaaaaagaaaaacaaatagattggttagtacaatccctagatttaggatctatgtatatatctctctatatatctccatgtatctgtttatatagagagagggagtgaatcattttagaattcatagtttgataagaaatcctgataaaaacaaagtatatacttggcagggttaaaagataggaggtagccgggcatagtggcttacacctgtaatcccagcactttgggaggccaaggcaggtggatcacttgaggctaggagtttgagaccagcctggccaccatggtgaaaaaacccaatctctactaaaaatacaaaaattggccaggcatggtggcgggtgcctgtgatctcagcactttgggaggccaaggtaggcagatcacctgaggtcaggagttgcctggtcaacatggtgaaaccccatacaaatattacaaaaattagctgggcatggtagcaggcccctgtgatcccagctacgtaggaggctgaggcatgagaattgcttgaacccgggaggcagaggttggagtgagccaggatcgtgccactgtgtactccagcctggaggacccagtgaaactgtgtctcaaaaaaaatagaaaaatctgccggtcatgatggtgcacgcctgtaatcccagctcctagggaggctgaggtacaagaatcgcttgaacccgagaggcggaggttgcagtgaaccaagattatgccactgccctccagcctgggcaagggggagattctgtctccaaaaaaaaggaggtatatatacatgtgcttgtgcctgcaggtatgtgtttgtgtgttctaggttttgaccacgaaaaaagaactgatttacttgtggcattttaatacatgccaaaacagtacaagatacctgagaaactctgcaacctgtgctcttcttcttcataaataactgagtccacataatggtgatactgggatctgagagaattggtcttaggccttatgctgcaagtactgctcatcactactaagagacccccttttaatgcggaggtgccatttttataatgcattccagaaagtaatcaattgatgcgtgactaggaaaatttagaggagtttttaatcacatgacttcacctgacgagatttcacaactataaaacctcccttttttcaaaaaattattaagaaaataaaccaggccccagtccagggaagtagcttctctagagcaggctttcttataattacgtggactaattgcctatttccctgtctagtggggactggatatgcacattttgtagagatattggaaagccagaagttgaatatgattgtgataatttgcaacatagtaagaaggggaaaactgcgcaggggttaagccccgtggaccaaagggtaagtgtcaaataagttgatttgtcactgggattcagtagttgtctgcctatatatacacctttttttttcctgtgtagcatacacaaaacctgataacatttaatttttaatcctgtcatctgatggtatattgatgatttctgaagtctttttttcctctaaccctgaactacagacccttctatccagattcctcaaacttaacatgtcccaactaaaatcttaatttctaatcctctccctccaagcacaaaaccaagcaaataacgacataaaaaactgtattcctcccccagtattccccttaattgaatgataccaccattcatttctgttgctcaggttagaaacctattagaaatgaaataataataactataatatgattttcttaccttacatcataatttctcatctggactattgtagtgatctcttaactgctctccccgcttctgctcttgacctttatagtttgttttctgtattaaacagtgttctttttaaaaaagtaaacaagtctatcatttccttgcttaaaatcctctaatagcttctcatcatattaaaaatggaaactctctccttactttactcagatttttaccaatctggcctgtagtctgattgccaaagacagactcttttgcattgtcgtgtggtcattagagttaagtttggctctactctggtgtatatactggtaaaaaccctcatccactatctgtgaagacaagatacgtgtttagggtatacaaacttgtattaaaagaagtttagataaatagaagactgtgaatgtaaaatgcatttcagtttactcatgattgggtaaaaaaatatttttggagttagactgagaaggccattttcattttgaacctgactggaatcatttgaagaaaggggatgataactttcaacatttgtcttgcctgtctaaggaattaccatgaggagcaacagtgataatttatttacttatttatttattaccaagtaatttataaatttttgcacaaagtgttagatgttgcttttgtgactcccttccataaattaccttagttatcttccattcttacttaaagtagaacaaaagatagtctgaaaacaaaatgagaagcaagggaattttctttgggtgtttatgtttagttgagtatctagtaaacagggggcttgtgttcagtttgttgtaatcaaactttgttgtgatatagttctcattctcgagaatgttttattaggagaaaaatatttcatgtgctttcctttccttgtttgggccagaaatgtgaacgtcttctgctttacctctattgccatgaattaagtattgaattccaggagcctgttcctgcttcggtgagttgcctaccttagtagctcggtggggaagtctcataatacttaagagtatgggctctggcggccgggcgcggtggctcacgcctgtaatcccagcactttgggaggccgaggcaggcggatcacgaggtcaggaaatagagaccacggtgaaaccccgtgtctactaaaaatacaaaaaactagccgggcacggtggcgggcacctgtagtcccagctactccggaggctgaggcaggagaatggcatgaacccgggaggcggagcttgcagtgagccgagatcgcgccactgcactccagcctgggcgacagagcgagactccgtctcaaaaaaaaaaagaaaaaaaaaaaaaagagtatggccttagactaagttgtattacacctcagccttctggaataagctcttcaacctctctaagactcaagttttctgacacgattttttacctcattgggttgttctgaggattatataaaataacctatgtaaaatatttagcatagtctatagtcattgagttttgtaaggaataaaggctctaaaatgctgcaataaaaggaagattagaggtgtttggtgcctaataagtggggtaagaatattctacacacattttattgctagccatcagttgttgaatagtacattattacataccaggcctgttagagaatattaaatggtagttgacttgtttactgggtagcctgagaaatgaattttaaatcacaaaaggtatagacagaaggaagatgttttgtacaagcagtaatcatctgtttctggaaaatttgtctcatctttaagtgcagggattttaaagtagaaaatgactttcaaatgttttctttttatggactattaaagtagcttcttggccgggcatggtggctcatgcctgtaatcccatcattttgggaggcctggcaggcagatcacttgagttcaggagttcaagaccagcctggccaacatggtgaaaccccctctctactgaaaatataaaaattagccgggcgtggtagtgcatgcctgtaatcccaactgctagggaggctgaggcaggataattgccaggggatggaggtggcaatgagccacagttggcgccactgcaccactgcactccagcctgggcgacagagcaagactccatctcaaaaatcaattagtcaatcagtcaataaaatagcttctctaactttacttttatcccaagggtagaaatttttcgccagagttggggtcagaattccctagcgtgaacactaaatggttaataaagttagtaaatttttcttatgttcttagtcttacttcctctgttactaagtcaagacttcgtgatgtaaatgatattccctgttatgttttccaaaagacatcatattctaattgtaacattaatatattttgtaaatttttttctttaaaaaaaaaagaaaaactcctaaggagtcataaaattctggtaagtcaaatgttgcctcaaggctactggttggttacccttgctaattgctttctttccaaatcttattattaaaagtaggactttggggacttggactaaccatgaagattggcacatatgccacataagatttggttttcatgaagatgtaaagtacatacgtctatactcaaaatttgcaagcagctggctctataataatttttttccctaaaattaatatgctatgcattttcaaattaaacagtttggcatttttggagaattcttatttgccattatgtgcttattttagataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagtatgttaacttccaacctatagagtcttgatttgttagtttttgtttgtttccttgttttatttttctgctgactttaattttattaaaatttttttttctgctaaagtcctgtcaaaagtaacatctgattgtattaacagctccagtgaagaaaatttattgtgtataatttggagtatatacttaaatataataaattaagaatattatcaaatatccttttctaaatgagttgaggattggcataagtatggaaagtactgtcagtagttacgtatattttgtggaatatgattataaacagcttacgttttgggtactattaggaaagttatctgtacccatgtccttgcattttattattgacaacatgaatgtagaaccttaaaataacaaactaatctctggtgacccatcttgaatagtagcccagagtatataatactaagttttcttatttcagcagtgtgactttgattaattttggttatgttttttggtttggggagttttttgttttttgttttgttttgttttgtttttttttttttttttgagggtaagtttgagttagccatgccttgagaagaaatgtattatatacctgtttcagggaaattgtttttattagggataaaatcgattctattattgttatggaagagtttcattgtaggagaagaaaatggaatttaatgagaatccacaaaatcttttaaaagattaatactaaagtctctttattgctggtgtaatttgggtgccatatgattattactaaaataaatcacattggatcctgtaacgtattcctatagctgcctctggaagcatccagatggcattttaaaatcaaaaacaaaacaaaatcctcataaggtgaaaattctaagtcacctttatagcagtatggcacagagtatattagtaaaatctcactagtttgaagttatatttagtcccaaattctgtcttatttttcagtgcagttaaattattttcaaataaatatgctttcatgaactatagttgataagaagacccatgtttcctgcctcagtaataaatagtttatgattaacatattgctatacagatagaatttttattaagtggtttgttgaaagtttgtcagttttttaaagcaacgtttcttgtataatatgcttcacaaatatttttctcttggatagattgatgtgttcagaccaattcctattcagattgaccttgataattcaaaataagacaattactgaggtttcacagtagctttagtaacagggctttgtaaagaaaatggttccatgttctgtagaattttagaaaagcactttatctggttatagcaatttgttctccctagtatggctgacttttcgtcgccaatcctatgcagtctcataactttagaaaggattataatttccctttttttttttgactctggtatcctttttagatgatgaaagttgttcaagtttatgcagacacacaagagattaatttgaaggtaagcttttcagaccatgcaaacttggtgaaggaatatgcattaccaataggtgaatattcctatcttttgcttgcaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccat

SEQ ID NO: 15997 - DNA, 118382 bp, Human; identical to SEQ ID NO: 15996
  misc_feature (1)...(118382): n = A,T,C or G

SEQ ID NO: 15998 - DNA, 7303 bp, Human
cactctacgccagggctggagtgcagtggtacgatcactgctcaccacagccttgacctcccggtctcaagtgatcctcccacctcagcctcccaagtagctgggactgcaggtacacatcaccacccaggctaactttttgtagtttttgtagagatgggatttcaccatgttgcccaggtttgtcttgaactcctgggctccagtgatctgtctaccttggcttcccaaagtgctgggattacaggtatgagccactgggcctggccaaactgcattttaaaatagccaagcctgttccttgtgactattgcctcatccttgtattcaagactgctgtaagatcataatcctaagcaagagtagagacatgtagcacgccatgatcacttactgtctaaccaatgctgcccacccgcttcccttctgtatggctcaccacccccaccccaaactcctataggaactctgcacacactccctctccattatgcaaaactggtctcagaaaggaatcagacagaatatttctactgaaagtataaagcttaatatgttacttcttacaagaatatttgcatataacaagggaaaaaaccttaagtcatgcagtaaacttttatcttttttttttttttaacaggagtctccctatgttgcccaagctggtcttgaacacctgggctcaagtactcctcctgtcttggcctcccaaagtgctgggattacagacatgagccacacttctttttttttttttttttttttttttttcttgagacagagtcttgctctgttgcccagactggagtacagttgcacaatcccggctccctgcaacctttgcctcctgggttcaagtgatcctcaacctcctgagtatctggaactacaggcatgtgccaccacaccctgctaattcttgtatttctagtaaagatggaatttcaccacgctggccaggctagtcttgaactcctggccttaagtgatccgcctgcctcggcctcccaaagtgctgggatttcagtctgagccgctgtgcccggtctctttttttttttttttttttgagaccttgagaccgggccttgctctgttacccaagctggagtgcagtggcaggatcatagctcactgcagccttgaacttctgggctcaagcaatcctcccacatcagcctcccaagtacctaggactgcagatgcttaccaccatgcccagctaatttttcatgaatttttaattattgaaattcagacatctaagaagatgctgaggactgtctccatattcctgaaattacgactcacctattcacaaaccagcccttctagtggaattaaaatattatttgattttgaataccctactctaaggtaggcacattgccctgcgatttattatttatgaggtttttaattatggaattgttcaaatattcacaaaagtagagagactacaatgaactccaatgtagccatcactcaggcccaactgttatcagcacagtccaatcatgttttatcttcccttctctgacccccaacccatccccagtccttatctaaaatcaaatctcaaacaccatatctttgggagcctatttatttagttagttagttttgagacagagtttctttcttgttgcccaagctggagtacaatagtgtagtctcggctcacagcaatctccccctccttggttcaagcaattctccggcctcagtctcccaagaagctgggattataggcacctgccaccacatccagctaattcttttgtgtttttagcaaagacagggtttcaccatgttggccaggctggtctcgaactcctgacctcaggtgatccgcctgcctcggcctcccaaagtgctgggattacaggcatgagccaccacgcctggccggcagcctatttaaatgtcatcctcaacatagtcaatccttgggccattttttcttacagtaaaattttgtctctttcttttaatgcagtttctacgtggaatttggacactttggccttccaggaactgaagtccgagctaactgaagttcctgcttcccgaattttgaaggagagcccatctggctatctcaggagtggagagggagacaccggtatgaagttaagtttcttcccttttgtgcccacgtggtctttattcatgtctagtgctgtgttcagagaatcagtatagggtaaatgcccacccaagggggaaattaacttccctgggagcagagggaggggaggagaagaggaacagaactctctctctctctctgttcccttgtcagagcaggtctgcaggagtcagcctttccctaacaaagccctctatcctatcacccacacttgggaggctgggctgggctgcacagggcaagatgagagatgtgttgatttcatccacttgattgtcatgtagaattagatatacttgagaagttacatttttcagtagcgccttcatatctttattttagggacaggtatacaccaagcaccatctcagccacaatctgttactaacagtatgttttctgaactttggccacttaggaaaagtacagtttggctctctccaaagtgttccctgaaagtccaactttatgactaatactgtgatttccagaaactttgactatccatgttattgacaatgattactagcactgaagggcatgcatgcaagtaggggttatgaaatatttaaaacacggttctctaagatatgagcagcaaagtgtttctaccttctatgagggaaccgaaggtgccattaaaagtagagaaatctggaccaggcatggtggctcacgcctgtaatcccagcactttgggaggctgaggcgggcggatcacttgaggtcaggagttcaagaccagcctggccaacatggtgaaacactgtctctactaaaaatacaaaaattagccaggcatggtggcagtcatctgtaatcccagctacttgggaggctgaggcaggaaaattgcttgaacccaggaggcagaggttgcagtgagccgagatcacaccactgccctccagcctgggcgacagagtgagactctgtctcaaaaaaaaaaaaaatacagacatctgttgtgattctggtaactctaaattttcaaccgtctcttcactacatttaaaaaattattttctaaaccaaattagccaggtgtggtagcaggcacctgtagtcccagcaactcaggaggctgagatgggaggggtgcttgagcctggaaggtcgaggctgcagtgcactgtgattgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtgtgtaactgagaggcttgtgcctggttttgaggtgctgcccaggatgacgccaagcaaatagcagcatccacactttcccacctccatctcctggtgctctcggcactaccggagcaatctttccatctctcccctgaacccaccctctattcaccctaactccacttcagtttgcttttgatttttttttttttttttgagatggagtctcgctctgtcacccaggctggagtgcagtggcacgatctcggctcactgcaagttccgcctcccaggttcacaccattctcctgcctcagcctcccaagtagctgggactacaggcgcctgccaccacgcctggctaattttttttttttccagtgaagatggggtttcaccatgttagccaggatggtctcgatctcctgaccttgtcatccacccaccttggcctcccaaagtgctgggattacaggcgtgagccaccacgcccagcccctccacttcagtttttatctgtcatcaggggtatgaattttataagccacaacctcaggtggagaaagcttatagcatagttttgttcttccaactcttaaaactgcagtaaaatataacaaaatttaccatcccaggatttataaaggcacagttcagtagtgttaaacacattcatattattgggcaaccatcacgaccatcatctccagaacattaataactcaagttattaatgtaccaggggaaaagaaaagtcagggctagtgcggtgactttacggttattaatacacccattaataactccattatcctcagcccttatagcaatattattattttctaaatttttttgtagagacaggattgtactatgttgaccaacttgtctcaaactcctggcctcaagtaatcctcccatctcggcctccagagtgctgggattacaggcatgagccaccacacctagctgcattattttttaataacaaacttaatttccctcttcagttgccattgtacctaatggtagaacacttcatttgccagttcagcttggattccatcacatcaatgtgttgtcagccaattcaggcttttcctctccccatgtctttgaggtggcatctatgcttgagacaagtgagattgagggcgcactggcactcagggggaagaacccaggcagagtgtctcacacctgattttagccatcaggcagattccagctttgctgctggcatccacatctctgtatccagttacagatttggggtcctctgagttccaatggccagacccatgaggcagcctttttttttttgaggagtctcactttgtcacccaggctagagtgcagtggcatgatctcagcttgtggcaacctctgcctcccgggttcaagcgattctcctgcctcagcctcttgagtagctgggattacaggcacctaccaccacgccctgctaatttttgtatttttactagagacaggggtttcaccatggtggtcaggctggtctcaaactcctgacctcatgatccaccttcctcagcctcccaaagtgctgggattacaggcgtgagccaccatgcctggccaaggcagcttttttccagcctgttgtgtgtaccaccaaggatatgaggacacagtgggagctgtcctgcagggtaggaacacaggttcccttttgctctcctgctgtgcccctgctgggtcagggccacttctcctagaagtctgccaccccataggcttcacctggaaatgagcacaagtctcctctgctttctcttgccccaacctatctggtacatgaagtcctatcaggaaacctccagaatctaagttttttctctctcttttttttct

SEQ ID NO: 15999 - DNA, 169334 bp, Human
  misc_feature (1)...(169334): n = A,T,C or G
ggatttcatcatctcaggaaagctggggcaaggtaactcactgacaatgagtacccgtggctttgtgacagtgcctgtgtgctacacaacagagcagaaagccagccctgcccttcttaccagtgaggtatggattagccacgcaacgaccagtctgtaagccaggagtacagacgagccaagctgcctgcagctgagtgggaaccacaaggaggaaaagccaagtccctgccttctaagagctgacagtctggagttacccagagtgatcttctatttcactaactgttaaaatagtctgattagaacaactattgtagaattgagtgaccctttgctttgcaaaggtcatatagaaatattctgccactgaggatctcatgtcgcccagtggttctgaaaataaatagaagttgcgtaccttcatggacacccatgaatgaaagtaaatataccctaatcatcacaggaagcatgtgcggtctgcacgtgaaagatgcatctcccatcagctaacagaaccaggtggagtctatgttttaataaggacgtgttattgatcgggaagtattaggttattatgcctaggtagttgcttctgggattccagtccaaaaggatcaccaaagcatcatgggattttcaatggcttcctgtggcttggcaaatgctcactgctaactgtgatttcccagttatccagagtagcagtcaaatcaaaggggaaagcctcatgtttcaataacttaaaacaaaacaaaaaaaaaaacggccaggcgcagtggctcacgcctgtaatcccagcacttcaggaggccaaggtgggtggatcatgaggtcaggaaatcaagaccatcctggctaacagggtgaaacctcatctctactaaaaatacaaaaaactagccggacatggtggcacgcgcctgtagtcccacctactcgggaggctgaagcaggacaattgcttgaatccaggaggcagaggttccagtgagccgagatggggtcactgcaatccagcctgagcgacagagcgagactctgtctcaaaaaaacaaacaaaaacaaacaaaaaaaaaaactcagtaaccttggtttaaagtatttccttggtggccctctgggttgtgtaacaatcggatgcattaattattatggcatcaaatgacaccagcaacatacatagtcagaaataactatttgattcaggcaggtgctattatttgtttcagcactgttaaatgtggggtttttgtttttgcaagagaaaaggcggttgtgtgtggtttcaagaagaagaaaagtcagaacaacatgcagcccattagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaagtgagtacccatggcgagctgaggccgcctccgacggcgcgcggcaggggctgcgcgggcggccgctctccgggatgcgggttcgaggcccgcgtgctgaaggggagagcggggccaccggcgcgggctcctggagagaacgccagccaggagccagagtcggcagccggcggggaagcccgggatccgcccgcctcccgcccggatgtcccttctcagaggggctaaaaaatactcttaaggtgctttgcctccaccactgcccccaaccccagcttttacaaactgcactcggctcgcattcgcctttgtcaaaggcatcttcacctgtatccttgagcatgagtttcggcgttgattgtgggattctcagaatgcaaattatttgcgtcaaaataaaaagaaaagaaaaaaagagcggggagggggaaggggcgcagacaggtgatgtgatgaaagccggactcgagactctcccatcagcagcagccgccgccgcagcagcctcgcgggcatccggcggggaaagtttagggttagcaatgctgacctgaaaggtgttgctcctcccaaaagtcagcgggggtaggggcagatgagcagcctccgggccagaagccggagctggacggaggcacctaggcagaggaattgcagcccgggaggaagctggaaggagagcccgctggagaagggaggagggaagggaagaggagttggttaaagtcaggcaaactcaggtaactggagggccggcccgagtgctacggcaggggaaggcaagggctggagttctggctctttgagtagaaaactatccttttagtgacctctacctgtatcctggggaagcaacccacactgccctgaaaacaagcaacgtaggggattctatgactggacttgaaaatggttgcaaaacattattattagtctggagggatcactttgtcttcatttgtcaagttgaccgggcaagatttcccacctgaaatcgtgcttcacttgaccagggaagtgctgctaatcccaatcctgaccatcagctgtgcaaacttgggcaagaaacttaccctctctgggcttcgattttttttctgcaaagtttagggaattaattaattatatatatatattatagaaatatatataatatatatataaatgtttaatgaggtggaagtgctgaatagtgcaagagaggagcagatgaaaatattaatttcagtggttcttaaaaattaggggtgataggtccttttgagaattagctgtgagtcctcttcctgggggaaaatgcatatggcatgtacataaaattttacatgcaatccctgagggtttgtggatactccctgaaagccatgcctgaatcccaggtgacaatcccttattcctcctcctgtatcaagaccacccagccaactccttgctgctggttgggctgactgtgggagtaatccacagccttcttgggggtctggagtcagccacgctgctgaaggagacagctcccctgtcatgggtgagctccccacatgctctctccagagctctaccagcctctgactccaggggacccctcctcacaaccctttttaatgactctcctaaggcgacagtccttacccctagaattttcagtcccaccaaccctggagagccatctaaagaggatcgctgtctgaatcagagtgctcttcaggtcacctagctggatggcagggaggccaaggctttgtttggaaatgaagcagtctttgctccctgaggcatagtatgagtaggcagccatattcttttgaacctctgtactttgcctttagaggactaaggactcacatctctggggaccctgggtgttccactagcagtgccagcaaggcacatcagaaaacacacagggctttggagctcaacagactgggcttcagatcttgactcccacactgagcaagcctctgagttttcctgagcttcacttttcctgtcagcacaatgaaaataatgctgcttttttttttttttttttgcatggttgttgggagaatggaaatactatgaatcatgcctagcccatagtcaatgataaactttttcttaatattaatgtggcaccataaataagtgttcaatagtctcatgcttttaagaacagcttactctctctctcctatggggcttacattagtagaagaatgagtaaaattagttctggtctagttatgcacaaaaaggagtggtggcctcagaatacagagtcagactggctgttcgaattgtgcagtgtcaaggagagcactatgtattgccggcaagtaaagtatgtccagaccggcgtggatacttgacctgtctctcagttctcttttgacccataatcttgagtacaaaacagctagtgctgtgcctgcagctaaaaacagccaggcatggaaagaagtgttgtggctgggtccatcttcagaaactgtagagagaaatatctccattgtcatctttcacagtttggcacagatgtagccaactcagcatgtactctctctccatggggtcctggtgcctccattgcaagtggtcagatgatgtagcaatgaaagaaggaaacatcggaaacttaaaaggaaattggatatccacagagtagccaaagatctatcagtatactttggtgaggtattcctgcatgcaaagatagcaatattcatgcctactatttactgagcctttaagatgtgctaagcactttcacacattgcctcaattaattctcatagcaagattgcagagtatgagttatcatttaaagctttaccagtaaagaaactgaaacatggaaatgtacatacaccccccaaccccacaccccacatccgcctagctcaggaaaggcagaaccaggatccaagcccaggtctgtctgactttggcacccactctttttccactacccagtgctcccaagctccccaatatcaggcacttgcatcagccaaccggattaagattcttctaaaaggcaggaatagccaaatctagtgggtgcttttaagtggtgtgaacatgtgcttggcttgtgatacatattaacgggtagcaacaacaagatcacctatgggaggataatattcctgacccttcccaagcccagccattagactcaagattggcaatatccaacattagcaggtgaggctggcgctctgtcactgacttccttggtaatccttttagttaaacagagctctggaatgttcattctctaccacctttagaatcagaacaccacttacctttacctccctgtgctgagcacgttttcattcatttattcgacaagcatttgctgagctctgttttgtgctgggcacttgatgacacagtggggaatgagacacacaggatcccagcccttgtggagcttctatgccagagagagtgacagaaaacagtcgggtgaacaaatacataaataaaatcatttcagatactgataaatgctatgaagaaaatagaggctgaaggctacagagggacagggcgtgggagcaactttcaacagggaagtcagagaagactgccatacaaaggatacccttgaacttaaacccgcattttcaaaaagggagccagccctgtgaaagtctagggaaagggctaccttagcagaactctcaagagaaagttcttaaattggagtaaatgaagcagtaaagcttaaagtctgaagatgggccctttagaagttgacttgtatatagggggaattattatttgaatgcctactatactattctaagctgtgctgtatactctgtttatcttcccaatgatctggtgagttagctatttttgtttttattttacagttgaagaaaccaagagtcatcaaggttaaggagctagtccaaggttatggagctagtccaaggttatgaagctggtatttgaatcccttagtctatttcactccaaagcccacaactacttgctaacacagcatgtgggctttgagataatgtcttttggagaaagtaaggaagccgatagaaggagaatatcaaaagtaaattaagtagctgaatgctgacaacgatttgtatttgatgtcccaaattccagttagtgcacctacaactgaactgtccaatacagtagccactagccacatgtgcctattgagcacttgaaatgtggctatttcatattgagatgtactgtaaatgtacaacgcaccccagatttttaagacctagtattcccccaaaaaagtaaactgtcttggccaggtgtggtggctcatgcctgtaatccaagcactttaggaggccaaggcgggtggattgcctgagctcaggaattcgagaccagcctggggaacacggtgaaaccccgtctctattaaaaatgcaaaaattaggcaggcatggtggtgggtgcctgcaatcccagctacttgggaggctgaggcaggaaagtctcttgaacccgggaggcggaggttgcagtgagccaagattgcgccattgcactccagcctgggtgaaagagtgagactccgtctcaaacaaaaacaaaaacaaaagtaaactgtctcaatttttatattgattgtgtgttgaaatgataatattttaggtatactagtttaaataaaatatattaaaattaatttaacctttttcctttaatgtggcttaatagaaatgtttaaattacatatgtgactcacatgatatttccgttgaacagcactgatctagactaataagttgacaaatacatgataggacctttttcccccttcttccaaacgtgacttcttcctctgttcttgtgtcaggctccttctcatctgcccccatattcagttatttggtgaagcacgagagaaaagaggtccctcttccttctcccccaccctcatgctgctggttagcaggtgatcatttgaagtccactataccatgtcactttgggatctgataaaatagactcagtgattatattcatcaccaagaccaatcctctcactcaggtaaatctcaagaggctttcaaacgtcctacaatgaaagggtcattttaaatctggatttaaagttttacctttaaatcacttcctagtacattgtctttgtagttttgggcactttgtaaaatcagacgaggagacaactagagcttcatgtttttgtgcaaagctcattaaataagtaatctcatgcagtaataaatgtttctccctgtcctcttgcttaaaacagcatgaacaaaaagtagtcccagttgccagaagggctactccaggggcatcacaaaagaccacctttggtttctttcttttgtccactagctaaagtggccctcaaatatgtcaatgaaataaagatatattttttttcctgcagtttcatttatttcaaaaaaaagagcagtcagattctggtattgctggagaaagcctctgaagagcaaagacctggattctgcttttgtgtactctactggtttgcatgttaccctctctctcccttttttcccccaactttctcccttacttcctgtagtaagtttggtgttgatgagataatgccacaaaaaatgctaatggtgaaatgtgctgtacaaattggccatggttatgattgataacctgaatacaaatggcatctctagacatgtgcctgcagggaggagttgcctttatgtagctggagcaaaacattatgtaagattctcttggaataacatttgttcatttccacttgaaatccaaatctgggggaaatggcagtaaagaagctgacaagaatgaatcttagtgtatctgtcactggtagactgagttctttctctagtctgtataggttccagagagagaacacccaattgaaaaaggacaagctggttttattcactggccagaaatggaaaatgagagacctcttgctctaaaaagtcaccttctccctagctgtgggaagctgcaggattgtgatgagttagatgtggggcggggagctatgtaaacacatgcagggagaaagtacagaggcacagacacagataaacatgtttctccatgcgtcctatggagagaaaatggcggcagttttcttctagggatggggagcccagcattgtaacgctatgttaatgacctaaacggaacaaggggtagccagttctggtttgcactggtttcctgcaggcctcttgtatttggcaaaggatcaccaagctcctgcgacatcccaggccatctggagttctttaagcaagagtatctatagataaagaaactagggaagataacaatttaagaaaataatgagctttcccagctatttctctagggctgccctggtaatatttctacatcaacagcaacacatatttttcagcattgtgtaagccaggaaatctatgctagactccacggggaaaatagaagaataaaacatggttcttgctctggaggagcatagttcctagttgggaaggtggacagaaacataaaagaccagtagcatgtaaagaacattttctaagtgttacataaatgatgcaaacaaagttttgcaattctggagggcagcatgcccataacctctaaggtatattaagaaagacaaagtagaaaatgggcattgagggctggaagcctaaagacacaaggagagaaggagagagccacctcacataagaaaaaatgcacagtggtgtggcagtggaaatgtacatgggttcgggggtgcgtgatgtggaaaagaacagttggcttaatccagtggctccagatctgagctttacatcagaatcacctgagaagcttttaaaaattacaaatgcctcagccccactccagagcttccatttaattagtttaagactggggactggtctcagtggtgtttctgattgattttgttttgtttttgtttctgtctcaatttcccagaatattctaatgtgaagtcagagttgagaatcactgagcaaaaaccaagatttttatatcatagtcatgggacataaaatgaaagaagtaatcttttaaaggagattaaatggacaaccaagagtgtgacctttaatttgtagaaactgtatatacatgcacatttgtatgtagtcttttaaattcacagataattcctcgtggtgattctgtctacttggatgatgtggctgaaagcctttgtaaccagctgcctactcttgtcctctgtgtactttgggggtgtcctatagtggatcctagctaagtggggcacaatgggcatctcacaggagcttgtttctaccaggctttttgtaatcattgccaagggctttattatcatgcctaatagtgcccacagtagctattttataagcatctgcaatcttccctcacctctccaactttacaaattgagaaatggagtttaattacttgccttgggccaggagactagctggtgatgaaggtgaaatgagaattctcagggaggtgaaattagaatttccagctactgaattccacataccttattaaactcccaaagtgagtctacccactctcctgttggtgttagaatgttatttcttacatgaatgaatcagtgtcacagatcagtaggtgaagatgactggtttccctaagctgccaacactgtgattatctgagtgtcaatgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgttctgatttcccttctctgaagctcttgttcactgaaaggatatcagctttttgctacacccctgaaaaaaagaggagaaagcccagcattttaaacagctgcttttttttttcttttggatggagtcttgctctgtctccaggctggagtgcagtggcgcgatctcggctcaccgcaacctctgcctcccgggttcaagctagtctcctgcctcagcctcccgagtagctgggactacaggcacgcgccaccaagcccggctaatttttgtatttttagtagagatggggtttcaccatgttggccaggatggtctcgatctcttgacctcctgatctgcccgccttggcctcccaaagtgctgggattacaggcatgagccattgcacccggccaacagctacattttaaagaatcctttatatgtgttgggagcttctgggttcactgcccacggtgagactaggggtggggacggaggttcttctgaaggacagtgcggggaaaaagccagagtcttggcaatacagcctctttagacaaaaagataggtcaatttgtaccattcccaaatggttgggttttcttttctctgtctcaaaatccattactgatttaaaacaatttccaaaagctttagcaatagcaaaaagcaagcctcttaaacagtgttgctccacactgattgcacgtgagaatcacctagggagctttagaaacaactatagactcactgaatcaatattctgggaaggggcctggacattcgtatttatttacagttctccaggtttataatgtgcatccagggctaagagctactactggtcagctatgatccaaatcttaattacttatttgtatttcttcttttgccttgttttagagtctcatggcccagaaaaccatcaaactatatttttgttgagtagcaatttcatcattctgttctttaaaaaacatgattttgagcataatttaagtttgctacttctatagagagacctcacactcagtagcctcatcactaaaattttctgtgtgcaatttagaaatcacattgccagaagcttgctaattaattatgagactgaaagataaaggttaagctttcctgccacctatatattagatttcccaattgctatgttaatctttagttaaccaagacttgctttcttgtctcagccattttaaagccaattaactctgttcctgttcacacccttattaaaaatataattacagcagtagtctccagggactgtcattgggtaggctttaccaaggtaaattagccaagaaataactaggctgtgtaacaccctctcagaccctggaaatcattttggttgcagaagctacttagtatcagagtaggctggggtactcataaatttggatttggaaaaagccaattccaagtcatcctaaatgtggaagaatctgtgattttgagaatgattctggaatcagttatccagggtccagccaagtctgatacaccgatcctcagaaggttgtattaataacaaaaagaaaccaggtttttgtattagatttgatggaagaggctgggggacagaaggtgatgtagcattttgttttctggggtgctgagattgtgggattaggagaaaataagaaaaaagattgcaggggagaacgatggacagaggcctcctgttagtcaactatcatgggcatcagaatttctttattcactcaactaatgtttatggaggttctgctttgttccaaggacccattataggagctggagatagaaggatgaagttcctactctagtgtagtttagattccagtaagaggaaacagatatccacactaaaaacaaacaataaataaaacccaataaattagtcagtactatgaaaaaaatgcaatgaactgaagggaatagagtttgctgaaggctgctttcaatagcttgtacaagttgcactgtctgaggaggtgcccttcaagctagcacatcaatactaaaaagaaaagcatgccgagagctggcagaaagaaggcttcaggcagaaagaacaacagcaaaagtcctaagactggaaaaggtctgagttgttcaggaaacagaaaggagaccattgtggctggacccgaggtaagaagcaatgagggaaaggtgggaaaagagcaaggagggcccgaggtcatgggatggagttaggctgttaagtgctttgagagcctaacatcctaactcattgggaggttttcagcagggtaggaacatggttggcattgcctttgagagctcttcccagcttctgtgtggagaatggcttgaagactgaaagcagagggtttgtaggaggctgatcggaagtacaagcaagaggggagggtggatcatgccaaggtgacagcaagcaaggtggaagaggtgttggattcaggatggaatttggaggtatggccagcatggctttcagatggaggggaccagcgaaagtgctggaaaacctagtcctgctcaagatgattgttcctgccctacccttgttttagaccccttgttttgaactaaaacagaataatatctagtgctatttaaaaacattaggaattttaaccttaacttgtttaagcagaacaaaacaaatccctgcctggggagaaacttctgtttgctgcttttgcctcttaaccataaaaatttcatcctgtctcgtaagactattctgatggcttttgttgtttttgattactgtgcttttcgtaagtgctggaaaggtcacattcgcattactagtttatctcttttctgagtgttttgacactttggctgtgtttaccaaggccttcctgctgtcagacatttacatggggctttctacagttgatcagtttctccatataagtgctaatataatcgcaagcatttagtgggcactgactgtatgcaaggccttgttttaagaatttcatgttttaactcatttagtccttccagccaccctttataataaaaagtgtgtactcttattatcattttatagatgaggaaactgaggcaaaaaaagaggttaagtcatatgcccaagatcatacagctggtaagtagtaaagccaggttttgaactgaatccatctgtacagctctgggttcctagtaactatgttgtgccacttttctatgtaattgaagctgccaccttcagaagtagacttgtttctcctgcaaaaaccccaaggtaccactaggagacactaaaactgggccgggcttccgggagttggactggtggggagatggcataatctagaggctgaatgatccaacccccctccaggaaggcctcacatctaaaccacctgccatctgccaaggtgggaggataaaccaccccccaccccgccgccaacagggcactggctggtgaaagttgccaataccagaggagtcttgatgaaatgccctctcttttcctcaaactctttctgcctactattcatagtatctgtgttgtacccacccacctgccacttatcaaagactgaagaaaccaaagttattcaacaagccatgaagcaaattctaattgctccccacggccatctgaggctggcctttggaaacttaaaaaaaaaaaattaaaaaaagagagtcatattaatttatttgttaccacattatttgctttaaaattctggtggcttctttccagtgttttattagtagaagcgaaataagcctaggaaacacaatatttcattctgtcttctctgcttttcactgcatatctaccttcaaaaatgtcttctctcaagttacttggtttctcaataactagcgtgaaagtaacagaccttccttccttcctaatgatagtaacaacaagggatttacagaattgaagtttatataaggaaatgcattaagattttaacttaagtaagtgaactattcagcaatggctataaagacagtaattgtgatgatttgtcttctatattatatgtttaaactagttatatattttaattatataagatgcaatttttttgctccagtttccatagggtaattttcaacagagattaacatgcgttcattggaagtgttgaatttacctaatcaaatcatcaatttgtttattcaactttaattttcaaaaaaatgttattttaaaatattatatgatatgtgtcaggtatttcttacggttgacttccaaatttaaaactgcaaagaaaacagaaatccatacatatagttgcagtaaactatactcaattttggaagattgcagtggcaacatcagtgaattaaagtttgaaagctatttcaaatctttgcatattctccaaataactcagaatcctacaaaaagctaaatatttaaaaaaatttatcttcaaaccaataatgtaagtttcttctttattgggatgattttggttaaatatttagcagaaagtaagggtgaatatatatttgatataggtatgtcctaagctaaaatcaagtcatttaaagatcagagcaattaatggcagttatgtgatcacaggaatcagtctatctcctccctcagggtttgattcaatgagttttatttttctcttagcaacttttcttattttacttttcaaaggacatcattgaaaccataatagtgttcatatctgtgacttttaaatttttatttatttttatgcatggtttaaaattcatttagttcatttaaaattcaaagatataaaagagcattcataaaaatgtccccctctcctgtcctccagcctttacaaaaatataccatatatattaatatgggctaaatacccttttaaagttatctcacacgcaagatgctatgactgtgtgaagccggagcctacagactattgctgatcccccagtagtagtagcagtgactctttagtggccctggagcttcctttctaaactcaagtgtatatttaatgtggctatttagggatgaacagcagtattttcagagaaaagtatagaagaacagatgaaatcacacaagatgcacacatctgggtattggtgggcatgtactttcagcagtgagtttacaaataatctagacagagttaagtatcaggtttaagagtcctaggatctaagcctgcacgggttcagtcttctgcaggaacttgggaatgttggggttcacttaggcccccagtgttggcatgtacacccactttcaggaggctggaggtataagttcctctctgcatttgtctcaggtcatcacaggcctcagaagtttctcaacagaaaaggattgcatgggttggatgtccagaaggatacgtggagttaaacatcagtcagtggagctagaggcttgctaagacttgggaagaggatgagggaaggcaaaacctgtcacctaaaggggaattctagaatgtacttactacactcatgacattaccctaccaccttcatttatcaccttgtgtcaaacatagacttcttggtcaagaccactatgctgtaagctacctgagggcaggactatgacttattctcctttgtttaccctgccccagtgcctaacagtgtctttggaattggaatgttcaataagtgggttaaacttttgaaactgaatatttcaaataatcacagataacagatggttaaaaaccaagtccttctcagcctaactagtgccaaaccaaatcattgtccatgtctcctaaagaaatgaaagttttctaattacctatataggtctggactcaaaactataaggcagcacactgtctttggtgttgacctatgtcccaggttgtccatggtcatcacacactaatgaccacttgtatgtatttcatctagaggatcacacagagtggtatgctaggcccaaggaataagtttacctgcttatttcacttctccactgtcatcctactgtgtttcaggaagaatttcttttacctctgcttactctactaagatgccccacataagcccccaactccttttcttgtccccctcccactttgttgtctattttcttctgtcagaccccttcctcctccaaactgaaccttcctgagaatataccaaagaactcaataaaccattcagcccactatagttcaataaatgagcacttccagaatttgcattttaatagtggttcaacctcaagtctctgttggtggaaatgtcactgtgatctaggtgagggaaacattttgagagcctgtgggaacctccaatagcaccttatagtagcttcttctggtgcctgtgtaatactacaatttccagaagccttgttgatatccagctaagtgaaaagaaagtcctcagttccagagttcttacttctatttcttttttttttcttttcccttttgtttttttttgagacagagtctttttctgtcacccaggctgcagtgcagtggcgcaatctcggctcactgcaacctctgcctcctgcgttcaagcgattctcttgcctcagcctcctgagtagctggaacagatgtgcgtcaccaagcccagctaatttttttttttttttttttttttttagtagagacaggatttcaccatgttgaccaagctggtctcgaactcctgcctatccacctgcctcagcctcccaaagtgctgcaattacaggcatgcgccaccgtgcccggcccttacttctatttctaaatagcaatggattccactcttccaaggacccagaacttgccctaggggtgagggtcttttgtacatcttgcaactgagaacttttgctagaatcagacagacaacatagatctcagctctaattttccaggagtgaagctgtggagcaagtgagttacctctctgtctcactttttcatctgtacaatgaggctactaaaacatacattccagggttgctgggagaaaaagacaagacaaggtatgtacaacacttggcaccaaggaagcacacaattcatgggagtaattactatcatcctcaccaagagttcatgatttactgggggacaccaacacatgtacagtcaacagggtaaaatgctaagggtgtggggcaagtgttgagtctgagctcagtagaaatttatgagcctcaaaggccctaaaacatccttgaccactcagttctatttcacacccttcttgtacttcaccaacaaaccagcaacatgcttctggttggcagcccttataaaagaatttaccttctatagtcaagtccaaagctcttaactgcttaccacatgacagccaataagacaagatattggggcaaggaagatgactttttttcagggagccagcaatcctagaagatggcagactgatgtactaaagaaccatcttaagttgatagattgttaggctccttttatgttaggggaagggggaataggtagggggttaaggtccacagttgactggtgaccacaggcatctgggcatcagcagggatctaggaggttgcaaaacttctttgttcatggtcaactattttccagattgaccttgtttctataaatttttaagatggcattgttatttgtgtgcatactttctaatctcctcaggggtctgtttcaaaagagagatggtcattagttctgaagttaaactataatctaaattctttccatcattagcttggcctatgtataggaatgagcaaaggcagttagcctgtgaggttagaagcaagatggagtcagctatgtgatatttctcccactgttacacatctctgaatacaagaggaatacatttcttctttttgctgtgtttgcttcaagcctgtaccactgagaaattgggtgatccagggaagttttacttctcttgaacctcaggctctatctttgtaacaatggagaaatcaatgcctgcattctaggcccttttgagggtggaggaagacaatggttgagaaacttctcatctatagttgatcctcaatgcgtttgccccttttcctgtggcactgctttgtatttggatggttcgagcagtgcgtcacacatggaggaaaggcaatggaatgatgacaaatagtttgttgatttggtgctttgtacattcacccacaaatggcacagtttcagggccactgtccttgccaaatactatctgaagagctaggttatgagcctttggaacccagatctgataagcatggaggaaaactcctcaagggagatgaagctaggagattagcagaatatactttctccatttgtcccacatttgatgccagcaggcaaaccagagccagctgggcagtgtacaattcccagaaataaggaaagggtagaagcacctgtttttcctctagcaaaaccaaggcaaatggaaaagctcagaaatatatcagcaccattagcaagaggcacaacggggaaggctggaaatgtgctgaggaaaatcacattgccggtcaacgcatagctacctgctggagaagagagtctgcagacacacctcagcctggacaaaggcctccaggaccgggagctgtgctctgcaggaactgggccccaggcactgaggactgaaaaccagcccaacaaagcatacctgtttccatttgtgagagatgaaatgatatgggttttgtgactcactaaaccacttggaaggccaaacaattacaaaagcaagatgcctggcttcttctagccacatggaggggccctcagacttgagtagctgtgtgccacttgtctggggtggctgcaccaaaaggaacagtgaggtttagatgcttgttattgttcattgttcagttttggttctgtctatttacttctaattcctcaaatattattgtgattagtggtatagaaaggaaacgttcatttgtgagcaaagtgtgtaataagaatttaataatgaaattcccagaaaaaaaaactcagatagctaaagaaacagcagtaacatgagctccaaatatcttgagttgtattgttaaggtgagaatccataatgtaaagggaataatgtaaagggaatgctttgaaatcaaaggcataatccaagtgtgataacctaaaaggttgtggatttcttttaaagtagaaattacatgtggctttgggaaatcatcagctgaagcataagctatgcttatggattctcgctgtgttgtcactaagaccgattatataaagacttggcaaatccatgtacaaatgtaaaacttcccacaatggtatttcatggggatctccttttacaaagtggtcgttgatcaggacatttttcactgatatattcctttggaagcaatgaattttagataggatatgattattgtacaatgtgataggtagctctgattattcaagcagctagggcattattcagtggcaaagcattaagctactctggaatctttcttctgtgtaagcaggcagctgctgttgagactttctctttgtgggtgaatttgcccaaccaatggcaagcattcattgggagtaggggaatgacgctgatcactgttaatgacagttgaaaatgaaatgctttaatgaatctcatacttggacttggctgctgagccagagccctgtacttgaagagcttaattatgatgcctcaaaatttagatcttgaccctgaactgctatgacttcctcccaccctcagttttgagagaaactttaaattcgctaggggattcaatgttttacatgcttggttatgcaaaatgggaacagtagtgtccaaacaatggaataggcttctatattattattttcatttaggcagtataactgacatgattaccaaagtcatgttatagtacatgtatacaaattaatttcataccgggggacttcactggggggaaaaaagggaagtccctatttgtgaaaactatgattttggtttctttctgagtaaagcactgctaatctctttggtgtacaggaaagtatggtattatgttctaaaaatcagaagccccagaccttaatttcaactaatctgatgacatcattttgtactcagagtttcatttcccaacaatttcatgtttcttagtaggtggggaacccagaattgaaaggcatcaaaaacagctaaatataaccaaaaacctgctaactcaccagctttctaaaattcaggaagtatctttaacttgattgctgaatctccaaagacatgatgatcagatgactggttaatgggtattttttcagactctacatgattatcagaaatggctgccctggccaattgtatacctacgaagaggtattatgtagaagaacttatattcatctacttaatgtggacctcaaatattaaggatgttcctaatgtgttctagaccggagtcagcaatacttttcataaagagccagatagtaaatatttctaggctttttgggccatatagcctctgtcacaattcctcaactctgctcttgtcacacaaaagcagccatagacaatgcataggtgaatgaatgtggctgtgtttcaataaaactagactctcttaatgccaagtatttgctggaataacacaaattaatttatcctcaaatctgtttaacctattaatatgtcagtcaatattacattaatattttatgaatctggtatcatattatacatgaatttatctgaacatttggttaattcatgaatatttactcaatattaatactacatcatgaatctgttatcaagtcatatacagatttcttaaaaaatttcccttatttagcatacttgtgaataacatcaataagcaagtatcttaagttaactatcaggttatatagcagatcctctcccccttttgtaactctttctgttacaagggattttacattattatggtattgggaagtaagtctatttatcctgtccctatctgtcttcgtattaaccatattctgttatagcttttatctttgcagacagaatagttcaaatcttcatgatttgtccttaaacaacccccacttcctcatcctcttgaacattttatgcctccatcactgtctcttcaggtcttgtgagtccttgaagtgcagtgactaggctggaacatggtgttccaggttggtcacatcacctcttcctaatgatgccccattgtaccttttgactatagcaaggaataaacaaagtcagaagtgtgaaagtgggggagaaattgagaaagtgcaggggatttaggggagagaaaaatggactacaggaaaagaaaacattgacttttgcaaagtgctctaaactggctacaaatgcattccgtaattctttaaaccttaattgtaaccgcagttaagctttccggtgtgttggaataagaacaaaactaaaatccttctttgtatagaaattatcctgcagtaacttagagccaatatctctagttaggatgagcgcagtggctcatgcctgtagtcccagcactttgggaggctgaggcaggtggattgcttgcacccaagtagtttgagaccagcctgggcaacatagcgaaatgctgtctctacaaaaaaattaaaaaattagacgagcatggtgtcacgcacctgttgtcctagctacttgggggcactgaggggagagaatcacttgaacctgtaaggtcaaggctgcagtgagtcataatcacgccactgcactccagcctggataacagagttagacctgtctcaaaaaaaaagaggaagagatctctggttagagtttgtctctgatggatactaaccatgcaagtagtttacacaaaccacattctttctgtagaatgagaaaatcttggatataatttagcataatgagctaaataactctagactgagcttcgctgcccagacaggactctacttgtgatctgggaagatctacccttgcactgaattctctcctcttctctcctgactctgtgagaaaagtttgcatgaatttactgagattagttatagaaggaactgtgtgtcattgaaagtcttgtacagaagttcacattaaaatatatcatagtcatctttgggaatgattctgcaaaattcataaaacaaagatctctgaaaccctaaggcacactgtgctggaggctaagggaataatagtgagctgagtggtttctgcctacacagagcttctaatatattgaggaaagagatctcaatcaaattcaattgcatttataagtatggtaaggacaacaaaggagagagacattattctgtaggagaataaccctgtcaaagtgatgactgatttaagatcaaaatgggaaggtaaaattttctcagtacctgcaaaggcactgaggtgggagggagcatgccaatgtagggaaatgaagaaacccagtgtgtatgagccaagctgaataaaacatgagaagaagctggagaatgagagagaccagtccccaagctctcaaggagcaagaggaagccttttcggcatttgaagtggagggatggcatgatctcgtgcgtagtttttaaaagaaccactcaggctactcttttgagaatattgtgggaggccagagtagatgcctatagacttatacagaggttaaggcagttgataagagtataaacaatgatggtagcttacctcacatgctttttagattataggctagaaggtggcccaagcccatataccatcatggcacagtgaatacgttttccttctggatcgtggaaatgaatattgtgccacacagcttgattgacactccccaatgacttttaatactgtgggatctctggcacatacttcagaagatgagaaaggagttttaattaacctctgtttaggaattccatagacataattttcattaacatctacttggtatttcatctccatgaattctttccagtgataaagctagttggtttatcctccaggactgctcagttctgaacagtgggtcttaagtactctttggatttctttgaaggcttttttttatttttgttgactacctctctactcattttgccccagaaaaaatgtagtcatttctttgataagtgaaatctaagaaaggcttatttcatttggtacattaaagagatggaagaaagtaactttacataagaatataaatgccagctgtccagcatattacagaatagatttctaaatttgctgaaaggttaggaaaatggattcttatataggcttaaaatttttataatttttttggcattctagaatgaaataaagaaaatcggtatcatcttgatctcatcacccagaagaaaaaaaaaacactgatacatggtgaaatattttcctctctcatttttaaaaagaatcaggaatagattgtatacatatttttcaaattctttctacttagtgttatatgatagtcaataatatatgtgtatgtaagtagcaataaatcattcctgaaaacttgttttttaagcttgtataacattccgtcatatggatgtactgattttgctaatttgttaagtttaaaataatattcattttcatttctttgactactaggtataattaattttttcatacactcactacccttcatacttcttttattgatttcctttttatgttaattattaagatttctatttgactctcaacattttcttaatttttttatcattaatagatgtaaaaaaattcttaatttttaaaaaataaacccttttcatcttaaagatagcaatctattttccataatacttgttataaatatttccccagtttgatgttggtcttttaattttgtttaaagtatttttgacaaataaataagtttttgtggcttgaagtttgttcatttttttcatttgtgattacagtttagttgttgattcaacacatccttattgagtgttttgtgttcagcactaagcgagacacaagaggtaagacagaaaaacaaggtgcaggtggttttgccacttagagattacaatttaatgaggggatagacaaacaaaaccaggtcattataaaatagtatactacaagctatgcaagaggaaatacaggtgggaagaagtacctgatctggacctgggggataagggaaggcttctggaaggaaacaaccttctagctgagaatgaaggaaaatggcaacatgaatttagagagaggaaacagtatgtgtgaaagtgttgttcagtgtcctaaatgttaaaggtcctctttccccagaacatggagtgtgtgtgtgtgtgtgtgtgtgtgtgcgcgcgcgtgggtgtgtgaaggagcagggcagggtggtggtcaagtgtgagcaggaggccactggggaggctgcggcagtccgagagaaagacaatgatgttgggcagaggatgtgttgaataactcatcccttttcactggacaagcaatgcttcagtgtatattaagttcttattcatagcataccgtctattccagaataatctaattagttttattgctatatcaattcttgggccaacaccacactggttttgagtttaatgaaacgtctaaactggtaatgcatgcatcctctcatcacttttcattttcaaaattgatttacctattcttgccaatgcgtcctcccaagtaaactctaaaataatttcaaaagtcacaaaagcatacgtgtgtgtatatgcatgtgtgtaaatacatgtatatatgtgtatgtgtgtttcttccaaccatttttcagtttttggagaataagatgtttttattcaagttgctgtcagtaaatattttatattacatgacttctctatacacacacacacacacacacacacacacacacaatctcccattggtaatttgattgggaatgtgttaaatcaggagaacagacattctttttaatattgagtcagcccatcaagaagcattgaatgttttcccacttactcaattcttttatacttctttttaagcctttatagtcttactcatataggtcctgcatatttattgacggggtattcttttttcttttataattttagcttttaattatgaatggatttttcttccattatctcctctctggtattactggactacaggataaatattaatgatgtatatttactttttatctgattatttaactgattataattaattataagtgttcatagttaattataaaagtttataatcatggtgtctttaaataatgataattgttctccttccaaaaattgcatctaatttttatttggtgtcttacagcattgatcgtaacttctaatactaaataacaatgataatagtgagcgtcctgtcttaatatcaatttcaagaagaacacctcttacataacatttttaaaagtgtgttatgtggaagctaataaaataaacttgggaaatgcgacaaatgaaaattctctctcccaggcattcttaattcatattaacatattaagatgagatctgcaacaaagagatgagttcaactgagtttaacccagtatttctaaaatgtatttgactatggaagtatttttccctcatttagaattttacatcagttatgacagtcaaaattatattaatttgatcttctttctttttttagaaaaataattttcatactttcttgtcttttctgtttgatctctcttttgccatatggactatgatttgggtttacttttaatttttttcaataattgagaagctcgtcacccttctttttatttctacaagtggttacacttaaagtttccaagacatttctatccatatcttatacttagcaaagtcaaagacatgaccatacagttttctaatcaacttcaaaatgaaatgttatctttgaataaccccatcaaaagaaatttaatccatttttacttccttccaacctttcctcagtattggtaagaataatttaacattttttattcatgttactgtcagtaaatattttatattatatgacttctcttttgtgaattatgtgatctgttcagcaacataatcctttacaatacattcctgagcagttctatggttatctgatttctgtgtccataactattgtctttttataccataaatttctcatttttttactttttaattttaatatcttaagattcgccaccttttatcccatttatccttttagggtgtataatgtaggtcatctacattttgagaagtgcctgattctgtttactatagtgtcagttttaccccttactgccttcagtggacaaattagtactattatttcatttctggctcctctacaaccccttttaatctaacccagcactcttttccttccttacttttatctcataatggctacctgtccgttttccacagtattttctatttcagttgaagatgataaacagttttctgacattgacattaagatgatgtttcagttttcttgttagacaattttgttcactgtctaagctacttatttttcatgattactcgtctaggaataaaaatcaatctacttagacccaatatttttgaacactgagcatatgtaatgtgttcttaaacctgttcaatatgtactgggctctaaatgtcctggcctacagctggagggcagaatgacatgtcctagttcaatatcagcctctaacaggaatgctactgatgtagttttctgcactgagataggatcttcttttcttccattgcctattctcctggaggcaaaatagagaacataaaaagtcatcatctttggtatgttcttctttaggggctttttctttctcccagcccaacccccatagtccttacttgctagatgtgtgttccaggattcagttcaccactgcccagtcttctaacatccaatttcattgttttctgagagttgagaattttcatacagatatagaagggatgctgtgcttgtttgaaatggttctatttggcagaggatagccgaacagtttttaggcaaagaatgaactgtctacttactttctttgaagaagccaacaatttggttttgttgccaacagcaaataatatattggctaataattgtggtttacagtgacatgggtaatgttagtcataacatgtcttccaagtttctggctatggactaactgtaggtcttggagtttggtattatctagaattttccttctccctcctcccccacctcttatcttttagcatagttgaagattggaacttcttcccagaaatctagcatcttcataagtcctttccggttttaagatttttatcttatattttatatatatattacatatatttcctgtgaatcttggctgaatttctcatttaataaagtccaagttagtatgaataaataacatgtttcccgattttacacacatacagaaattcaaacacataatgaactctctggcagcctttagcatttgtaagtgctctctcaccaggaaaatcctttaatagataaccaagtgtcctggggaagaagggtgtcaggaaacttattatatttgtgtcactttcttcaaagggtgattaagtatatgtctccaaagatgtgatgttatcatctttgagtatcacttgaattcaagtcaatatttattgagaccccatgttgtatcaggtgccttactagaaagtcgacatatagagatgcataagacatgatctttttcagtgggtaatttaaggtctttcttctactgctagcattgtcatgtgtaaggctggtgggttgagtctttggaatttgtgaagattcttccaggttgtttaaaaaatcttttgattctcacaaatgtattttttctatttcttagaattatgttctttatggctaccaggaaatcctttgaaactggaattagattgcattattccactggggtaataggattggtaaggtaggagtgtctttgaagaataatgctaaataacccagacactaaggctgaatcttcagcacagctcttaaggcatcctgtaagtaccctctgctgcttattagaaatcccaaagccctgctcccttaggaaagcggcccatccccatcctcatcataagatgcaaggcatagctaaacatctcaacttctcacttgagtattatatactctcaggccaggatactttccaactcaagagtaagataacattacattctgatcttcttgtgtgtgtttttatgttttttttttcattttatttattatttttttttttgagacagaaattttactcttgtcacccaggctggaatacaacggcgcaacattctgatcttcttttgagagaaaagtttcacacaattagcctttgaaatacacattcctttaagtaccatgaaaacattgtcccatacaacaatatttctaagaaacacacatgtccctcccacaatgattttttcttgttaccaccaataaaaattagagctgtgttgtttttgttgttgggtttgtttttgtttttgttttttggtgactactgtgaccctcaaaaaatcaatccgactttctcgatcttgatttgcaacaccaaggttaccaaacaaagagaatggttcaatgagggaaagctcaactacctgccctaaatatttagtatagcaatgctgagcttttggtaatggctcaaaattctcatgctttcccactaaatgaaaaggggagctttgctactagtaaaccatattcaagaaataattcttattaatactttgcttctttcctatgaattattgctttgtaatggatgtttgacaagttactagcaaagcagtcttcgatgagcacagagacccatcagatctgtattaacacctccaaccactggagtttcattaagtaggtttctctacccctctccttcaggccacagataggaagaatgacattgggtccaaagttctggcacaaagaatgatgtctgccttcctgtgatgatttcaaattcagggtaataattccaactatctttccctggccatgatagaaagctcaagaaatcttggttccttgtctcttttcttccatccagttggtctttctaattacacactcaacacaatgttctgctgagcaagacatctgctgtagccactatcacccttggcataaccagatatttaaaggtacctaaaggagtttagctatattttgccaagatcctaagttctatggcataagaatccatccacttctctattgcctatagaaaaggacagctcagtctttctgaaagaattgttctcaaacaagaaagcatttgaggtaacatgtcaacaaggtggactggtaattggtgttcctttcagagccagttggaggaaatggccagctcagacattctcttctccccagtgtcctatgggaacaagatttacccagacacagctgactatgagaagtcttcagggatttacaacctgtctaagaacaaggccaatgggggactcactttgcaacacgtccctatttgattgtcagaggacagatactctattaacaaaggaatttgcactggtattttcagggacacatcaagtaattgccacttgaacgtttttccaggctttcaaaggaatgtaagaatggcctaaggctaaattacattcatgtctttagtgagtcattatattactggcaataaagtatattattactttactttcagatgccctcacatatttttttaaagtagaaaggagacatattatggtcaccattcttaagagacttaactaaaagacactaatttaatcttttagttacttaaaaatagctgttgctcacccactatgtgccaggctctataccaggcaccaatatgaaaaggtgagtattctctggtctccctaagcacagtctagtggaggagacagacaaaatgcagccatggccagaagggggagcagttaatgaacaagtaggcagagagtagggaggggattctgagagacagtacggacggactgagggtaagttgtacatccctgatattttgggcaattgcaaatagtttgatgaccaaatcacaaggagaagaagtgacagcaagcatggctgaaaatgtaggttggtgtcaaattgtaaaaagccttgaatactgtgctgaacggtttgatccgtgaatcaggtagaggacttgactcaggtctcttgactcaaaggtcatgttttttctctgctagattgcacttatccttccaaatgctagtggacaccacactgaatttgatcaaagatctctcaatggaaatatgtaaatttcctgtaagaagcaattggtaggttctcttattatcatctccatctcacagataaggaaactgaagtataaagaacttgagtaacttgtccaaggtcacacagctagttaggtgatcccagacaatttggctccagagtcactagtcctaactacaacaatttagcctctctttatctagaggtctttatgcatttgtctgcattctacttacgttggtattggtgagtaaagattcccttccagaataggtttgataaattgccaagtctgaaactgaaaaattaatatccatgataacagaggttttggggtcaaggagtgaaaggaattcatcccatcctgtctctaaatacttttttctttaccaatttatgggaatttgagaccagatatctggaaccaagcagcctcaccctattaagggaaagaaaaagaacagaagaaaagaggagaggagaagagaagagaagagaactaaaagtatctgcaaaaatattaaaggatttgaccgagatctctgagatgctccaaagattgcaattgtgcttactatccaagttaatggctgtaaatctaagagaattatgatgtgcctggtaaatattggttgttttgttttaagtcttcatggagaaaatggaaaagacattggcatgtaggatgaagtcacagcaggacagacaggtcctgcaagtgtttctttagatgcattgatattcataacatccaaacaggccttaaggctgtcttcttactttacacttaccaaaggggtaaaatatcattttccttggacacacaaataataaacgtactctcacaacatcacttgaatgttgtggttttgcaaatatactatgttttaaaagctatagccctcaaatcccttactagacatcaatatttgttggaatttcaacatcaaagatttattgtgaagggggagggggaggagttactccaaaggctagaaccagtgcatataccataataacaactctgcatgcattattgcttctaatcttcataattttgagtactatctttattgtcaccatttaatgaagatgttaaggttctgggggcttaagtgacttgcccaaagttacacagcttggtagaaacagaatttaccacagaacttgtgtgttaagccaaataattttctagttccatacaactaaaaattggaaggaaaaagtagagccttatgaatagagtcctgagcaagaaggatgaacaatctgcagatgaagtactctgtaaaggaaagatctgggtttgaattctaaccctgcctccgttcatctgtgtgatcttcgcaaagtctgttaactctttaaactgttggatatttataaaatgggactggtgctatttggcctgatatcttacaggggaagattcagtcaggccaggcgtatgtagggtctctctgacctggaaagccctatataaagacatggtaccattcttagtgttaggactgaaactacatccctagtgtcctgacacctcataccaatacccagaaaccctaggctcttccttcaatcccatactccttcctcagctgccaggacagcttggttaagaaaagccttgttcttggggagtatatccatgaaagtatctctatttcgttgcagtttcacattaagtaaaattagagtgcccttcacgaagaatatataattgaaagccctcccactgactgctggacaaagcacttgtcagtcaacaaaccaggtagattgagtctgccctcagagtttttgtattctgagagtgactagcaactttctctcatcctagagcaacagggctttcagaggacaggttctggggcagcgtgtagccacgatagaattggtttgcttttgtgtccaaagtcatgattatcaggagagctgccatttatcaaccacctctttgatacttggtgtataggacaggcgtgttaactatattatttctaaaccacaagataagtctgtgaagtatttttatccctggtttacaaaggaagaaatgaggctctgcgagacatgccagaaagaacatgctctacacaaccaactggttacaatgtgcggctttgtccagcactacctcttctttcttggcaatcatcagagccactcaaggcttggaggactgtgctggcaaaaaagaaatcttgtattttctaaaactcacacccacactttggaggggacaagattgagatcaaccccatttcctactcttttctttatgacagtttatcagagcattttttccttatattcactcagtcctgagtttctatttagttgtgataatagatacatttttgaatttttaataccttcgggtgcaaatttggaatctatggaggataagggagtaacaaaatgttatggaaattgaaatatataaattattaattttccctctcctctacagatttacaatcactttatttggggatatcaagtaggttatgtggttactgtagtactcatttaataatcagattttatttagagaactataaaaggtacaacttaagggggaaatatattttagatgatgtttttttttcaatttccaatttttgaagaatgacgtgtttttaaaaacttttaaagaatttctcccacatttcactccctttaaggtaaattgatagctgtgaaaatggcaccttggaaacatttctgtcataatcataggagagagtgagaattattaatattctcagccatgtagcatcataaagtagatcacagctgtttctttcagaaaatgtcatttgattttcgatcagatgtatggtccatctcacaatctaaccgcttccacatctggaatatcttaactgaaaatgtccacagcattacacggcctggctcagggggagaaaagaactagggcctgcatcgaattctgtctctcactcagctgatctgcattcctcctatagcatttccttataattaagaagagctcatagatttgggaactgcatgagcctctgtaaccttctggtgagggtgagaagctcagaactgcatttctatgcatttttccctagtctttcctgcttcggaggagaagccctgcaagagcttcctgccaagggaccctgctttctcagcagccggatccggagagccagaaatccatcttcagctcctttgaacttggctgttgttaatcatgctgtggttgtcctttaagagcaaaggcttcacggagagcagatcagctggctgtagggagggtttcagcttctcattgtaggcagatcatctgctaacagcttactgagagaaagttgaggacatgtggctgaaacactgtcagagctgctgtgaacacagtccaagtgagcaattttatgacccaaaccaagcagacactaagtgctttctagtggtggaaaaggagcagagagaaaaagaacaaagaccaagtggtggaaacaaaaaaaatatatatttctttcagcagctaacatatttttctgtttagaagattggtatctcctacttaaccacaaactacaacacataagatcaaataagattaaatgtccggtttgctaaatagcagagcgaagaaactaaggtcaagatttcagactcttacatctgaggaaagagagaggcaaagagaagatactggaaatgccaatatccagtcaatgaaataaacagaggctactgtaggcatccccagaagcttgccttttgtccagtgccatgggaaccacagaaggcactcagctttgcagcttcactcagaattggggcaatgctccacagagtcaagggcatgttattataaagtgctccatttgtttactttggcaagtggaagatgactttgctaagcgatactctgctggggctcagggccagcactgctggagtaggaaaagggagacttcctggggcaaggcttctcaatcttcctgccagcagcattgcagtcggagcggcactgaggtgtcaacaaaaggatgatgaactgtgtcagcagtgttagcaaatggctgaagtagaacggagctgcccaggatgctgccctgtcgctggggaatctgagggaggctgaaagatattgtaaaagagattgaagggctggactggctggaggaatggtgccatcggcatccatgccacaatactccaggactgccctgcctttgtcaggacagccatcagaggcggttttccctctaaccaggatgggcatcactccttgggcttgccagtcttacctctcctcatgcaattgcatgtccaaggcatgccctcaggggatggtgctgatccagggtggcaaacccaagtggggagaaaatgctgaatctcatcctctcagagatctgctgcagtcagcgactatactgaggtgcatgatctgagcagcagtcgctggttggggaggcttctttgtggagtgggtctcagccacagcctgagggtcctctcttggggatgctaccagttaattgggtcatcttcagcctccacccaaacttaggcctgtaggtccatcaattactatatcagcctcaaggactgaacaggtgggaggaaggactagtgtgagtgatggaagcagctgagctgaggagtgctggcacctgtgcaaatccagcaagaatgacatctggctgagcttcagtcattcacctaagcaccaatcgggggtcactcccagatctgagcaatgagggaaacttcccagggggaaccccgcacttgggtagacctgggggagcagccagaaggaaaggggttgaacctgtagttgattaagattcagagaaagaaaaaacaaaaacagaaaacgatcatagtttcagacactcccaatgagcctgtgacctccccaaaatcctatagccaaacacacgggtggatctggcctcactttcccattctcccacttgtgacttttgattccacatcatagctaaggtcctcggcaaattggattaaactttggatttaaaaataaaatagaattaaaataaaataaaaaagttggggacaggagaaagtggtttccaagaacctacacctctctaccctgaaatgactgaatattgtgttcccctcaaaattcatatgttgaaatcctaacccccaatataatggagcctttgggaggcttcatgaatgagattagtgcgcttacaaaagggtcccagagagctctctcacctttttccaccatgtgaggttacaacaggaagtcagcagtgtgcagtccagaaaagagccctaaccagaacctgaccatgctggcaacctgatctcagacttccagcctccagaactgtgagaaattaagttatgtggtttataagccactccgtctaaagcactttattatagcagcctgaactgattaagacactcctgagaacgattccttcggggaaggtcttgattagccttcacctagcccagtttgcaaacacactggagtgtcctgcccatggcaatgttcatgtagcagcctgggagacagaggagggggattcctgcaggagcaatcttcccaaggaggcagttcctactagctaactttcttgtcctgcttgtgctcattgaaggtccaaacctgtcccctgccctatgtttgttttcctcctaatcccctggctgatggagtcaggctttggagaattcctttaagagtcttagttggccttatggatcccaaaacacacccttctctattgatgccagattctgagcaggctgacagtgcatgcatgagaacctttcataaaataggactattttttattccctttgctttttctttgtgttatttcccctcttcactccctgtccttttaccttaccatatacatttgtcacctccttgcctggaaagcctagtgtcacctccctgccttttcacagcctataggattgagtccaaacttgccagcttggcctttcatggagtgcaggtttagtacaggactgctaaacacagtttcagaatgaaccattctcctggcctttatcattgccaatatttctctttattttattttattttattttatttagggagagccgatatttcataagagttgatggactgctttgcctggaaacttgagaattcatatttttattcaaaatcgttttcatttttttgcttagagcctgttaaagactgaggccctctctctgtcccttctactcccagccaaacccaatagacacatgtgagcaagttgtcacctgacccgaagctccagcccctggaaccaactgaaacaaaatgtatccttgcattttccagcaaggaattgccttgcctacaaaaatactctgtactttaatatgcagatcaattattaacagtaggctgtacctttcaccaggttgtaaaaggatgactgcgtagagccacagcattctccttgtcagtgtaggaaatgcagaggaggatgttacctccggcacttgcctctaagacacctaataaagatgaggaaggctccagcctgaagcgtgggtgaggtgtccagctgcccaaaggcgacaggtgagatactcaggtccccttcctctttttgctgtcagttctgattctctcctttcaatctttctcatctgtgattgggaatggcaggggtggggtgtgtttggggcatcagtggtggtaaaaatggtcttatgggcagggccatgttgaataagagatgagcatggagacagcgtattaacttaaaaggccaacaccgaggctcatttgagaccgtaggaattccagggagacagtgttgttcaggcatgggatcgaagatcaggagggcggctcaataacacgctggcccggtcacatgacagaccagtccttggagtgaactgggagacaaggaggctgctttggcatggagctgagaacatctctagatcgcactggaaggcagagagaggccagacagggaactctgaagagctgccacagcctgtgccagggtgacatcagggtgagttgagatgatttttttaacaaacttcattttttgcagcagtcttaggcttacagaaaaattgaacagaaagtacagacagttcccacatacccgttttcccccacagagtttcttctattaataacatcttatgttcgtgtggtatgtttatcatgatgaaccgatgttgatatatcattattaactaacaagtccagagtttacattagggtttactttttgggtcgtatggttctatgagttttaacaaatgtataatgacctgtatctatcattacagtatcatacagaatagtttcacttccctaaaaatcaccctcccttccttcctgcaaatctctgacaactgctgatctttttactgtctctatacttgtgtcttttctgaaatgtcatgtagtcagaatcatgcagaatgtagtcttttctgactgcttctttcacttagcaatatgcttttaagcttcctccatgtttttccagggcttggtagcttctctccgttttagcactgagtgatactccattgtatggatgtactgtagtctgtttatccatttgggcagactttccagcaagatagaaggcagaagcaatggaaagggtggatgaagggaaaactgcaaggaacacaggacaagatagaagcaagagcaggaaggttttggagaagtggaaaaacaagctagagagataggcacagaggcctaacctggggtaaggcagggccttgtaaccaacgctcagtgagagaggcagcccctcactgacctgcaccaggcctttcctgattttatagacagagtgtcatgaggtcatgagggcaggaaccatgtcagcttcatcctgagagcccagcactttgtaggcatctaataaatatttattacaccaatgaaaccttcaaagtctcttctaaaaaagcaagttctcccagacaccagaagacaaatggcctagcagcccctgagccagtcatctcgggcagttgtgagctggttgcttatttgaaccctccatgccacggggcagcatcaagcttgcctgacacacacctcctgagccaggaattcaccactttgccaccatctctgcctggcttgggagatgctccgtggacagaaccagagccgtgctgcagggaagcagaaaaaccaaaggagatgcatgccaatctaacatgccagtttaaaaaaaggcattcttgcctcagagtaagaatccagctctccatgcactcgtctttcaacccaatcacaaggcatcagaattagcccatatgacctctatgggacaagaagagcaagcagggtgatttgggtgctaagaaatagctgtgagaggatgatgcggcagctgtgccctccagatgttcggagagaacatctgtgcaacaatagcagtagctcccatgcactgatgtgagaacccagcctaaggggtacagcaatctgggtggtagggggtagctctcagagggtctgacaattcacctaaagattgcaggaccaataggaacctgccagtcagaatttcctagctcagtggtgccctccaagcaagagagcttatcagccagacctgtgtcttggtgcaacatcactgcttaaaatcaagtcctcccaaggcatggtgtccattttactttctctggatgaaatgaagacagagaatgaacccagtaagatgatagagtgctttgctttggatctgttcatatcttacccgtgtttgtgctcacatgagttacacagtcagtacaagggtagagagctcttgagaatttcttacctaagggaaagaacttgggggctgctttgctcaaaggctatttttcagtgtggggcttatctagagacatatattttgctccttgtccccactgctgttgcataactacgggagttgagggtcactatacacagacacagatggtagagatgggggcagtggttgggcaaggaatagctgccttgccacttcgaagtctcctaaatggcatctctgaagaagaaggatatgtccacagggagaagggccccatggtgactctgttgctcctaatgtgccaggctcagactcttcaaaccacaagaagtggcccagcgagttccatgtaactgcaaatgcaagcaggaaaaaaccacactcagatctcagcacagcatcagtcttggggacagctggcctttcctaatgcagcagcatctggctgcttctgctgtacctggatgtcttcagggcagttcttccacacagaggaccccaaataaaagcagaattcctaccattaagctttccgtatccaaaactttctatgtgaaagatacagcatctgtgtctcacaagaatctgttttcttggggcatctgctatttggcagctaaccaaaacagaattcccatcttattttcttgttcatttgtgctacatggaagggactggtcctgaatattcagggcaacatccagcatttggtagtagtggagagaaagagaagagaaagctctggactgtgttcctctgtctgggaatgtgactctcacacctcccaaatcctcccattcacactttttctccctgactttccagaaccctttttaggcttagctccttttatcttaccctacacgctttctttctacccacactggtgggtacttttcagccatagacattggagcacatttaaatatgctggagtccttagagaattaagaggtgggggagagaggagggcacagagctgaggatggcactagctcattcacaaggagccctgaatttccagggacattaaagaacagatgctcatgacagagcatagagctctgccctaattgtttgtaatgttgaactatgtgtcattcgttcactcatatattctctcaacattggaattgagcaccaattatgtaacagagtaggtcttggcaatacaaagatgaatgaaacataccccttgtccccaagaagtatgtggacacgacaggcacatggaccaatgatggtcatgtcaagcgtgatgaagtccatggtcctgagggacacttggaccacggcctgcatgagagggcctggaacccaactgggcggatctagaaagaattcctctggacttgattcctgaacttgaaggtagagatggaaggagaagagttctgggtagcatgttcctggcagaagaagcccactgcaagagcaaaggcactgaggaagcctggtggtcactggaaaactgggattcaagtagctgaaatcgtaagggtgcagcctagggagaagtgagacccgtggtggggggcagagccaaatctctgtatccaaacctttctatatgaaagatacagtgtctgtgtctcacaagaatctgttttcttcgggtgtctgttatttgagtgctaaccagaacagaatttctaaagatggtctttgaggccaggtaacaaggctgaggctaagaagaactatggaaggtctgttggcaggagagatgtatgattagatctgcattagcagaaggaaagttctggctgaaatctgcagagcagtttggaggggacaagacagatgacatggagaacacttaggacgctgttataataaaataggctagaaatgatgttcctcagaagtccctttctccctgcacacctggccacctcagacttcctgttcaaggggaaggcaggctggggagagaggtttcttgaaaataacacatctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaaaaaaaaaaaagaaaataacacatctgttaattggatcatttctgtgtggtcaatgtctgtaggggctttgttttggtcatcatagtataaaatccccattatgtaatatttcctcctgataaaagctcactgtgtgtctataccctaccagcttccttatagtatttgctcattaccaggttcaaggacctgtctgtgtggctcttccccagagcctctgttggaaagaagatttgtctttggttataagtagatacacagtggtcaagatgctctagcacagtgcagcagaataagatgggctcagtagggaaagatcattcacccctaaagtgtacacttattcttttctgattatgataggattatgttgaaattaaaaattgtttcaacgaaaaagcaactgattgcttaggccaaagcagaactttttttttttttcctgaggcaaagtctcagtctgtcacccatgctggagtgcagtggcacaatctcacaatctcggctcactgcaacctccatctccccagttctagcgattctcctgcctcagacttccgagtagctaggattacaggcacctgccactatgcccagctaatttttgtatttttagtagagacagggttttgccacgttggccaggctggtcttgaactcctgacctcaagcgatccactcgcatcagccttccgaagtgctgggattacaggtgtgagccaccatgcccagccagaattatttttagtactgtagttaagagggcacattctggagcaaactgcctgctaagtgttcgctgtggggcattggggaagaacttaatctctttgtgccttggtttccacatgtaaaatgggataattatattgtccccctgtactggtttgctggggctgccataacaaagtaccacaactgggtggcttaaacaacagaaatgtgttgtctcatagtgctggaagccgactcacctcagaagcatggactcccttacctccaagtccaaggcaatggggctctctccctcttgcctcttgaattcctgcatctcatttcactgggtaaacagggaggctcctgtgctccagcaggaaaaccctggactgggaagcaggatgtctactctgatcctgctgccccaaagctgtgcggctttagacaagtggtttgacctttctgggctcagtttccttgattttcactattatttgaagggcttggggtcatggaaatcatgaactcttcacactgagaggaatcttcataatccattttgtagataacgaacctaaggctgaagaggtcaggggcttgcacccagtcatagagctaaatgaggtgcaaagaacctagaactccggcgtcttgactcccacctgggacacattttatcagtaatagtgaactctcatctgttgatagtgttagaattctcacatttactccccataacaactttctttttttttttttaaacggagtttctctctgtcacccaggctggagtgcagtggcacgatctcagctcactacaacctctgcctcccgggttcaagctattcttcagcctcagcctccctagtagctgggaatacaggcatgcaccatggcgcctggttaatttttgtatttttagtaaggatggggttttgccatgttggccagactggtctcaaactcctgacctcaagtggtccacctgcctcaacctcccaaagtgctgggatcacaggtgtaagccaccatgcctgaccagcacccttctgaagtaggtgctttcagaaatctgaaagcatagtgtcggttagcagggttggatctcttctggtactgtgaggaagaatctgtgccatggctgtctgctagcttctggtggtgtgctggtcatccttagtgttacttggcttgcagaagcaccatcgatctctgctttcatcgtcgtgtggtgctgcccctgcatgcatgtatctgtgtccaaatttcccctttttataagagcaccaatcatattgaaatagggctcaccctcataatctcatctcaactaattatatctgcaataaccctacttccaaaaaacaccacgttctgaggtcctgggtgttgggatttcaacgtatgaatttggggtgggagggcacaattcaacccaaacattacctaataaagttttcaacagtaagtaaatgagttaactcctggaaagcatttaaaacagtgtctgacattcagaaagctctcagtaaacgttacattatgctgggtataaataaaaagctcccaggacagtggacggcattgagattccaccggtttgtattagtgtggcctcgccagtaatttacatcttctatcttttttggttggtcagggcttaagccataccaggtaaatattttgaataatactcctagctaaaaggtgcaaggagtagatactgtgggttctgatttttctttcccgttctccaagctgtgtacacagaaccatgcaagtcgccccaaccagggaaaaacaactgccatttcttttaaaggggaaccaatgaaggtcttgtcctgatgagctcacaaaagcaaacttctccatgtctgtcgctcactcagtgggctgaagcagagccttcacgctaagctttggagacaaagcttcttagagaatgtgcaacgtgggctgatcccaggctgcccaaggagcagctgacgagtgtaaaagtgtttgctcaccgattagaatcagtcctttaaaaaataaataaggtatgttgatcttttatgtgatgattaaacaaatcagatggcccaaaatgaattccaggtaaagaggaataaaatatcagaaggcaagctgctgaaattagcaagagctgaactcgaaaagcccgactttccaggcacggctagtttcttcctagcaagttcctgacggagctgggtggctgccccaggtgactgcagtagcaggagattaaggagacagcacctgcctgacaaaaaaggttgctgacacaataggccaaagttaaattgagctgccaagggaaaatgattggggatatgcagttaacagttgagggagataccagaagaatttgtgtccacagagagattttgatggggctgactttgccgctgaccgactcacctcagaagcatggactcccttacctccaagtccaaggcaatggggctctctccctcttgcctcttgaattcctgcatctcatttcactgggtaaacagggaggctcctgtgctccagcaggaaaaccctggactgggaagcaggatgtctactctgatcctgctgccccaaagctatgcggcttcagacaagtggtttgacctttctgggctcagtttccttgattttcactattatttgaagggcttggggtcatggaaatcatgaactcttcacactgagaggaatcttcataatccattttgtagataaggaacctaaggctgaagaggtcaggggcttgcacccagccatagagctaaatgaggggcaaagaacctagaactctggcgtcttgactcccacctgggacacattttatcagtaatagtgagctctcatctgttgatagtgttagaattctcacatttactccccataacaaccttcttcttcttttttttttttttaaacggagtttctctctgtcacccaggctggagtgcagtggcgtgatctcggctcaccgcaacctctgcctccagggttcaagctattcttcagcctcagcctccctagtagccgggaatacaggcatgcaccatggcgcctggttaatttttgtatttttagtaaagatggggtttcaccatgttggccagactggtctcaaactcctgacctcaagtggtccacgtgcctcaacctcccaaagtgctgggatcacaggtgtaagccaccatgcctgaccagcacccttctgaagtaggcactcttatacccattttactgatcaggagaccggcttgcccaggatcctgcagctactgaatagaggggccagaactttgctggtttggtgcgcttcctggtacacaccagctgcctccaatctccctttgataatcctagccacatgccaccgcgggtgctctagtgtaggctggcaccaaccccacccagcaagagccaggatctgcttcttgagggcaggcaggtttatcacacagcggggtgcagaagagtagtattcatcttcctagtgtaaccacttataactacttttcagtgaatcaaatagatttttaagcaagaacattgtaaaaatctgcttaatcaagggtggagcaaaatgagttagccagggccaccctagctcagatggggtggtagctgcctctgctccacaatgaggtatttacacttgctccccaccctctcctttgccccattatcttttagttaaagggccaggtgcaccagaacacaggtgccttgagtagcaccagcacctctcagggtcatagggaagagctgtttcctctgggtaaactgaggcctcaataaggcataaatgccttctctgggtgaagaagatatgccctctaagatctctccagggtgaatctagaataagttgtagtctagatggcttggcagcactagccagtgtgacagtaagtcttgatgaacatcagtcagcgtcatgctgagggacaacctcgaggagagggaatgtgtacttgttacaacagcacacccaatagaaatagcatgtaagctacaaatgtaactttatattttctagcaaaaaaaaaattttttaaagaaaccagtgcaattcattttaatagatcttatttgtttcaatatatcccaaatattgtcctttcaatgtgtgataatatagttattagtgagatattttccattccctttttcatacaaagtctttgatactcagtgtgtatttcactctgacagtgcacctcaatgtggtgcaataggcgagggtctatgtggtacatcccgtgcccagtgtgcacttaaaggctgtagatccatatatggcgactgtctcctagatagatgagcccagcaaggctcagtgggtgttttgaggtccatggtctctcaggtcccgttccaccccgacattcgacgaatcagagaacactaatatggttgggaacacttttatcttgctccccatagtctgaacagaaagagacgccacagaatacaatcacgactctctccctcctacggactccctccccacaagcaatcaatgggctggtctcagacaaagacacctagtcaaggctggtgaaacctgctctatttcctagtaggcctccacctgtaattctcagcagtttgtgtgtatagatagaattcctgccttctactaatgtgactgttcctgctcagagatctagagttaattattagcaaattcacagtgaaccagagctaggtcttgctgtaaggctcctgtgttttttagaagtacgttgccatggggatttttgtccccactgggttcctcctcaggaccccagacagatagatacacaaaccctgggcccataattttagttagaaaaggcccaagcctagaacctcagggaactcatttggaagctttttttttttaggaaacttacctttcctatttgacatctcaatcaaacaggtgtttggggagaataaaagcatactaccttagaagggactggggtcatctggccagacttgtggaataaagagaatttcattccttgtataaaataactctaaataatggtaagctcttaggagacttgatctactggctacatatacccactatgaaattaacacattctggaatttagatggaagaatatggaaattggtccttctcagtgtatggacgaagcatcagaaatgaagagaagggccaagcctagagagcaaaactaaagactcactggtctgtgggcttcctgcccaaggagagctgaaagctaaaggatgcttcacaatgtcctacaagttgtttttctaaagtccttccagcggttgaaactgtgtttatgcaaaacaaaactttcctttgttgctataatctagaggtggactttggcttaagtcatgccaaaatattatcattctaaaccagtaacacctatatttgttgagcatttactatatgtgtggcactatgctaaacttaactaccccttttcctcatgtgtaacagtcaggtgacttcacagctgccttgtggatacttgtgttatttgaaagattgcataaacacatgtaaaatgcttagaagtctaccacctcatcttacctacagctttggtgagtccctgctttggccaagtagaatcattccctgtgaggaggggaagaggataagaaacaggcagagttgaccttacaggtagacacaacaggcgagggtccatgtggtgcaatggatcccatgcacatgcctgattcagtcattctagttgagtaggattgtctggttggttgttattattttgttttttgtttgtttctttcttttgttttataagatggagtctcactctgtcgcctaggctggagtgcagtggctcaatctcggctcactgctgcaacctcttcctcccgggatcaagcaattctcctgcctcagcctaccgagtagctggggctacaggggcatgccaccacacctggctaatgttttgtattttagtagaaatggggtttcaccgtgttgcccaggctggtctcaaactcctgagctcaggcaatcctcccacctcagcctcccagagtgctaggattacagacgtgagccaccgtgcctggccagtttttatcttgaaagcttaagggtctcccacttaaattcaaatactcttctgaggataaccttttaatcagccaactatcatgaatctcaattatcaggaattccagttattccaattatcaggaattctttatatcatcccaggaatctaaaagagcaaggtcttataggtaagggcaaactttctgatgccttggaattcagaccctaagtagagatggtcatttgacatctagtctgatcgactgtagagttacttctatacaaataaattcaagttatcacagggtttctttcagttggggacaatactttgaaaacttttaggctctgaatgaataacttggcaaaagaaaatgttagggtccttcaaataccatacttgttgtggttttctcacagatacaccagtctataaccctgaggtttcaacactccactcagttgtgggctttttatctaaatcaaaactatcacatgcccacatgtgcatctgcagccaaccacaaatgatctaacaggaccagatttcactggagctctgtgacccttctcccagtgtgaactgaagggaaaaaaacctggagcctaagggactcccttttccgtgtcctgaagaccactggctttggttaagccaatatgatgggctcattgagagagagactcaggacctcggatcatgccacactctctggccccagaaggcataccacaggctgccagctttgttggagaacctgagacttaaggccaggatatatcaagagccctgtacccagttctgtgatgtcttaatacctttgacaagagacattggcaactcactgggtgtccattggggggcgacaaggaaacagactgatgaaaccagagaatgtgacaactaattacatgttgtttcctgtagaagagaaattctcagaggaacgtggtgactgtctgttctttaatggactgtcatatgaaagcaggagaaggagattcttccttactccaaatgacaaaactaggagcagtgaaatgagcttataaggtggccgggtttttctagcaattggagctctctgcagtgagtggacacttggcagggtagtgcctactccgcatttgatgtgttcacaccacggctagaagtaggtgtcgcaacttccagttgaagagggaattcttttccttgggtgggagaggggctagagaacgtctcaggttgttgctaactatgagcatggttttataattgtttaaaagtgggtaaacaagaagagtgtgtttatggtgtctgtattccacaaactattatttcccacattaactgtttcatatatggaaaatctgagaaacaggaatgctaacaaggttgcagtataatttaaaaatacttctgagagatcattgtatcccaaaggcagtgcccagtgaggttaagagcgtggtttgtggaatctgagcccacaggggtttaaatcctgcctctgcccttcttagattctgtgaacttggacagattccctcacttatttaagacttcacttttcagcccttgagatcccacctgctcaattatctaaatgaaatctatcactgtggaaagagcaaaggcctcctgctgttgagcaaaatgttttccagtcctttgtttctgtgtgaaataaagcagctccatcccagtgctaaatgatcaactgcatatgacagaatgagcttatttcatgctcccagtaaatacaagaccatagactactctggatggtagtttaagtttaagatgaaattgcttcttctgattgccttcttctttattgcttctttctctgttgttccttccttctcttgtttataacactaacagtcaaatctatctgtgtggaaatctatctactatatagaacgctacatcacaatttacagaggggaaaatatttttgtcggcagtaacatttcactggaagaggcactatttggccacctaactctgggatttaggctcaggtagaatcagtgcctcagtttctttaggtcagccattatgagttgttccttatttgacctagcacatatatagatggtggttaaatttagcaaaattctcttcacaaaggtttcatttgtctggaagactctaagtactgatctggtcagagtaccatcaaagccccttgtttgtcatgagaccgtggaccaacatgttagtctttctcatgtaaaaaaaaaaatcatcaacaaatgcagtgggagttggtagtcatgagtttgaggtagtacaatatccttaaagtacacactcaatcatgtgtgataattggccaactctacctaacaacagttgaagacctccaaacagctatcaggactactggaatcatgtctccagaagaacctggagaaacattcacatttgtgtggaccaaggaggaaagcaacccagacgacttctacttagaagcacaggcacatagagcctgtgttattggcacaggtatttctctcctaagagccttttctgcttaagaaggcttgaggatctattcccattaatcataaaaaagggatttgctgggctaaattattttagcctcctctttatgccttacttcacaaagaattgcagttaatctgtaaatgagttctgatgttatgaaaattggatatggcaaattgtgttattaagtctattaagggatgaagaaggactcttctaaaagaataacgtagtctgagtggcagctctcacttaatagacatctacctagaaatgtttctgaacttaatggacacatgatataattcaaaattaatataagcacacagcacctctccccataaccttattgaaattaagggttccaaatcattcttctctcccttttacttcacctgcaacatgtggctcacccttctttagactaagagctaaactctaatgcctagttaatgtaaaacaatgccaggattattaagcatgattctgataagttttaacccctaatgagattatccttggttaaataaattgaatggctagtggaattccaatgtaaagtcagcagaggttagctggttgctagatatttaactatacataccaggaagctatgaggacaaatttccatttgcacagagccttgagaattggccattttaggactaaatgtgctgctcattacttttactcaaggacatactaatgaccaatatatgtttaaatacctactatgtacaactgctttcaaaaacactttcaatcttgaattgagaaggtaggagatccatacctgtattaggccatcctcacagtgctataaagaaatatctgagactgggtaatttattaaaaaaagaggtggatgaagctggaaaccatcattctgagcaaactatcacaaggacagaacaccgcatgttctcactcataggtgcgaattgaacaatgagaacacttggacacagggtggggaacctcacacaccagggcctgtcatggggtggggagagtggggagggatagcattaggagatatacctaatgtaaatgacaagttaatgggtgcagcacaccaacatggcacatgtatacacgtgtaacaaacctgcacgttgtgcagatgtaccctagaatttaaagtataataaaaaaaaaagtggggaaaagaaaagaaaagaggtttaattggctcacggttctgcaggctatacaggaagcatgatactggcatctgttcagcttctgtggaggcctcgggaaacttacaatcatggcagaaggcaaaggggcaacaggtatgtcacatggccaaagcaggagtgagagagagaacaaggtgccacacacttttaaacaactacatctcatgagaagtcactcactatcacgaagagagcaccaagggaatggtgctaaaccaaggtccccaacccccaggccacggatcagtattggtccatggcctgttagaaaccaggccacacagcaggaggtgagtggcgggcaagcaagcaaagtttcatttgtatttacagctgctccccatcgctcattactgcctgagctcagcctcctgtcagatcagcagcagcattagattctcataggagtgcaaacgctattgtgaactgcacatgtgagggatctaggttgcacactccttatgagactataatgcgtggtgatcggtcattgtctcccgtcactcccaaatgggaccgcctagttgcaggaaagcaagctcaggactcccactgattttacattatggtgagttgtataattatttcattaaatattacaaggtaataataatagaaataaagtgcacaataaatgtaatgtgcttgaatcatcccaaaaccaccccctctctgccccgtcccagtccatggaaaaattgtcttccacaaaaccaatccctggtgccaaaaactttgggaactgttgtgctaaaccactcataagaaatccaaacccatgatccagtcacctcccaccaggccccacctccaacactggggattataatccaacatgaaatttgggtggggacacacatccaaactatatcaataccttcataaaagcaattaaataactgtacagtgtgataggcaataaatgtcaaatgtcatatgtatgaggaacatagagaggtgctgttatcaagtcactgtgtgacccactgagcactcgcaatgaggcacaggtagtaatgtacctgctcacttgcttattgttgtcccaccacgctgaattgggagcttcatgagagcagggcccatgtcgcatctattaccacaactgccttattcgcgtggcctgtagctagcaatcagtaaaaaattacagcatggatgaagctacagaaagaaagtaaatactgacaggtgggcaaaatttttagatatggatatttaatgatgggatgaacagatgaatcaagacaggaaacaaggcttcgcgtggcaaatatatcctttcatttgcccagcaaacatttgcagatccctcactatgtgctagacactgtgggcacatttctgtgtggattggtgtttttctctctcaaaactggagagattttgagatcagcctgtatgtagtgagatgaagaggtatgtggttgagatcaggagtagttgggattctgtgagggatagggctccttaggtgtagagagccttgagacctttgttgtgaggatagtgaaaatcaacaaaagaatttatgttaaggaaggttaaaaagtcactctaaaggtctcagaagtgcctatgacatcatgaggagatgtccattcctgaaaactttagccaggttacaaacactttaagaaatcctatctcaaaacttcaagaaaagtgagatctgtatttacacagatagaatttccaggactggattatatttgcacttttttgttaaatttttacttaactagtatattaatattgatagtactttgtgacttttttcataaatataacttttaaaaaatatggtatttctaaaaaggtttggtgcattgttaaaatgtggttttgatttattcacagacagaaatcttctctaacagactatacttccatttcataattcagtgaggtaatgggactcagttatactaaatttatcatagagcaaactttgctagttttcatctgttcattacattttatgtaatggcagacagtgtaataactaataccgttaacccaaccatctcttccctataatgtttctataggaacatacagtgtacattttgcagttctctacacgcagacaaattctaccagtgtgtattctgattacaagctagttgcttcataggccatatgtctatcttcagtccctatgaatcatgtaaattacagagcaaactgccgatactcagtatatgtatatgacacataagagtcaagtatactcagctcctaagagcaagtgagaagacaaagaagatctactgtgtgtagaaatacttcttaaatcatctttcctgaaggcctagtttgcaactgagtcgcaaaaatttggtttcaaaaagttaagcttgcaataataaaaagataacccagtttaacaatgggcaaagtgatctgaacagacatttctcaaaaaatgatatagaaatggccagtaagcacaagaaaagatactcatcatcattactaattagggaaatgcaaatcagaacgacaatgagtcacctcttcacagtcactaggatggctatgattaaaaaaaaaaaagacaggcaataaccagtgttggcaaggatgtggacaatttagaaccctcatacactattggtagacatgcgaaatgaaatagtcatttcagaaaacattctggcagttcctcaaaaggttgaacataaagttactaggtgaaccaacaattccactactagctatatatccgccaaactgaaaacagatactcaagcaaatacttgtacatgaatgtttatagcagccctattcacactgtccacatacttgaaaacaattcaaatatccatcaatggataaatagataaacaaaacgtggtaatttgtacaatcgaggattcagccatagaaaagagtgaagtactgatacatactagaacatagatgaacctcaaaaatgttatggtaagtaaaggaaaccagtcaaaaaagaccacatactttatgattccatgtgtatgatatgtccagaatagggaattccatacagacaaaaagtagatgagtgtttgccaggggctggggagaggtggggatggggaatgactggctgatggttagtttccttaggtggtgaaaaaaatgttttaaaattgattgtagtaatggatccacagccttgtgaatataccaaaaaccactgaactgtgtaggggtgggttgcccctccacacctgtgggtgtttctcgtaaggtggaacgagagacttaggaaagaaaaagacacagagacaaagtatagagaaagaaataaggggacccggggaaccagcgttcagcatatggaggatcccgccagcctctgagttcccttagtatttattgatcattcgtgggtgtttctcgaagagggggaggtgtcagggtcacaagacaattgtggggagagggtcagcagacaaacacgtgaacaaaggtctttgcatcatagacactgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccaagacattccattgcccagggacaggcaggagacagatgccttcctcttgtctcaactgcaagaggcatgccttcctcttatactaatcctcctcagcacagaccctttacgggtgtcgggctgggggacggtcaggtctttcccttcccacgaggccgtatttcagactatcacatggggagaaaccttggacaatacctggctttcctaggcagaggtccctgcggccttccgcagtttttgtgtccctgggtacttgagattagggagtggtgatgactcttaaggagcgtgctgccttcaagcatctgtttaacaaagcacatcttgcaccgcccttaatccatttaactctgagtttgacacagcacatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacagaactgtacactgtaaaagggtgagtttgtggtatgtaaatttatctgaatttttaaaataaaaaagaaagttaaaaaatgttaaacttggaattaatgatggtttttttgaagcagattagtaactactgaaattagtccttgatttttggaaaagcctttaaaaaatggtaagtgggagaagttataaacaaagagatgaatgagtcacagaaaattgggagacaaatagatgataacaagggacagtacagaaagactcaactgagttttatcaaatcactcaggcagataaacatgggggctgcatgtgcatccgtatgtgtgtatatgtttatttacatctaatatacacacatgatattacatgaaatattataacatataataaatatatattcatactggaaaaattctcaaagaatataccaccaaatgttaacaatagctgtccctgtttagtgggatttcaggtgacttagatcctttccccctttggcctctcagtatcttataactttgtgtgctaagatcattgatagttgaacaataagaagaagaaagtgagtgtggaaggatgttgctagagaaagtgtattcttgattatatggaggaagtgggggcagtttgtgaagtcttccttacgaatagcatcctatttgagaagaccagtcttcacactggaaaaaatgcatagagcaaggtgggcatcacttgcagaacagtttggcacaggactacctctgaaatattaaggcttaggagacttgttcttagaaactcttcaggcaaagtttacaaaaggccttttcctccttgcttagcagattctcccaaggcatccacatctacactctccgtaagtcactatatactggacctagcacacatctgtctacccatcattgtattagtctgtcctcacgctgcttataaagacatacctgagactgggcaatttacaaaagaaacaggtgtaatggacttacagttccatatggctggggaagcctcacaatcgtggtggaagacaaggaggagcaagttgtgtcttacatgaatggcagcaggcaaagagagagagcttgtgcagggaaactcctgctttcaaaactatcagatcttgtgagaattattcactattatgagaacagcatgggaaatacccgcccccattatttaattatttcccaccaggtccctcccacaacacgtgcgcattatgggggctacaagatgagatttgggtggggacacagagccaaaccatatcaactatctatctatctatccatccatctgtccatccatttatctttaattgggatacgtctacaagacaactgatacctaaaagtatgggaatttcatttgctaagtcacaaaataacttttaaaccatccttatattatacctaacatgatctgagcacataatattgtctaagtcagacccattcttgcctctctgagcttacactcttgtcaagtgtgagccagaaggagttggtccaagtagagcaagtctcacaggctttgtggtactcagggtgggggtcttacccaacatttcctcccagaagctgaaaggcagagacaagaaattcatcctgaaagagttcacaagggtaaagtcaaggtggctggtccccagacaggtcataggaataaggttctggtcatacaacaggaggcaaggagcccaagtagagggacttgggtgtggggcaagtgggagggtttcattgaaaaactaggtagaagacagggagtaatggtggataaggcaaaggacagcatctaattcaggcctgtcatcaagctagagaatgttcacagcagtgttgtttgaaagagaaaggcatggaaaacactttgttgtctatcagcaggtgtgaataatttaattgtggtgttttcaaatagtgagatttccagcagaggaaattaataaaccagagctgcatgtgtcgatgtagaaaaaaacccaaagtgtccagacatggtggctcacgcctgtaatcctagcactttgggaggccgaggcgggtggattgcctgagctcaggagttcgagaccagcctgggcaacatggtgaaactccgtctccactaaaatacaaaaaattagccgggcgtggcggcctacgcctgtagtcccagctacttgggaggctgaggcaggagaattgctagaacctgggaggcagaggttgcagtgagccgagatcgcgccactgcattctagcttgggtgacagagtgagactccgtctcttagcaaaaaaaaaaaaaaaccgaacacccagtgttctcactcataggtgggaattgaacaatgagaacacttggacacaggaaggggaacatcacacaccggggcctgttgtggggtggggggaaggaggagggatagcattaggagatatacctaatgtaaatgatgagttaatggatgcagcacaccaacatggcacattcatacatatgtaataaacatgcacgttgtgcacacgtaccctagaacttaaagtataataaaaaaagtaaaaagaaaagaaaagaaacaacaacaaaaaaaaactaccctttaaaggaatgcatataaacaataatttatttctttcacattcatttcacagtttgcttactgaagcatcagtgtgtctttcaattggatgtgatgtgttttgaagacataagaggcaggaaagttttggttgccaaaaataaagagaaacagggaagaatttagcttctgaactggatggtcactcttgccagaggccttggaggagggcaaggttttgcattttgtttgccaattttttccttaaataaagtgccctggacttcaggtcagtcttgccccttgagctgctaaatgattctgccagattctttcagctgagctgtgcggggtcctgaagacctgctttgacttcctctgcaccaaactgactcactccccagggaacaagatcaaggctgaggaagagaaaaagcagggcatgaatggaccctatacccaaaatagtaattccattttctccacctgccattctaccatcacagtgaagcttttctaaattgtaagaggctcttgtaaaaatgaagccactcctgggagatgttgaattttatcagccaacatgtatgtgggtgtccatggaaaacaagaccttggcaaattataccacaaatgggctggggcaagtgggaggagagtgataggagaacgtttgaatcaggacaaaacgagtgaacaatgtggaggcaaagggtgggaacaagatgtgctttgccaaccagacaagtttttcaaggctaatttttctagagaccatcttaagaacaattgcaacactagacaaaaagcacacaaaccaaaaaaagaaaaaaatctaaacccaacagcctaagtatcagaaaccatcttcttatccatatggttaaaaagtcaaaatgaatttattacattttcacagaaccatttcctgggccggaactcatttctccttaaataaatactataaaattttcctcagaacaaatcaagtcccctctataaccccagaagacaaagtacatcggcagtaaaaacagacacaaagtctccactgttgtcagaggtagcatggcctggtgggaggacagggagctcatgctgccgcatcagtcgggaggagggatttgtcttctccacagggcaggatccctacaggaaacaggacaaactgagaagggcttgacaatggaactctttacaaaggtgtcagcagagtattcaaaaccacaggagaattgagtgtcagggctagcaactgtacggttccagagccaacccatgtcggaagggtcagagggtgggacagtcaccacaaccccagaagggagagttctgtagaaagggccatctggagggaagcagtgaccttcagtcagcccaaggtgacagccaggcagcaaggagatgagtaccctcagcctcactccttcccttcctccaacctcctaccaagcctccctgtgggtcaagctcatcctgggagtcagaaggcaagagagcccctagatgcagtccacatagttcagagcaggttgcaggtcaggaagggtgaagacaggagaggcaaagggaagacattgggcaggtcttccagctcacggccctgtcatgcctgcagtcactgtagtacagactgaatgttcactgtgtcctgctttcagcatttaagatgcctctgagataaagagcctgccttgagtctcacgggacatgctcacattttctgaaaccatgtagcttgcactgttaacctcttcctcggtttagaggttttaggggctcgtttcacaaagctgccccagcccctcatgttaaacaacctgagggctgtgactgggcaaaaaataaataaatacatttgcattcaacattgacaaaatacacacttaagtgagacttttttgcatcacaaaaaaataagtttttacttttttcaaaaagtaaaggttctttaaaagatatcatctagagtagaattaagggctattattagaaaatcacagtggtccctaggcaagacattttgagggatgaacttaagcaggccccagactcacgtcttccatgtcctacaacccaggcataccccatcatcccataccttcaatttatccaaatacttcctgtttcagttggcaaattccactgccccaagcttccaaatgtcttccactgctggcttagccttcttcctaaatcccctccccatagtgtcctggaccccattaaaatgccagcaatgaaagcatctcctttcccctgtctagcacagccaggtacatctgttctgagtggtcagtgcccaaaacagcccagttgctaaacagtttgaccatcacctatgctcacacaggagttactgagatgatggtcctcaactgcaaataaaaaaacacaggccactctgtaggagccattagctcacaacttgctgggcaggctcaagttttaggactcagcatgctgaataacacctctatccaatggtaaatttctctggaaatgaatccaaaaacctctcagatgacagatcctgggactttcaagttgttacatagcagcaagggttgctgtcatgatttgtttactctttgattccctgctgtggctcatttgagatcttggagtgtttgctgcagtaattatggcaggatttttccagagtggttttagcatcagtgaaagaattagtgttcattactccttaattctatcactcaacaaattataggggtaaaattagatcctattaaaaaaaaaaaaaaacagggaaaaacagcaaacagaaacaagccggaaaagaggaaactaaattcaccctctaatactgataagcaattcttccctaccactaaattttaaaccttcatcagagacagtactttgtccgtttgttcaatactttattcttagtgcctattacagtgcctggtacatagttggccctcaatatatgtttatttaatgaactgattaaataaactagactcaggctctgacccttgtgctaaatctgtgctcacaatagatgttttagggcatattaaattttgaagtcagttcatctctatggaatttataggcaaaggggctttctttttttagaggtaggttcttgttctgtcacccagactagagtgcattttgcattttgagtgcagtggtgtctgccagtcagactagagtgcagtggtgtgatcatagctgactgcagcctcaaacttctcggctcaaacaatcctcccacctcagcttcctcactagcagactacaggcacatgccattgcacctggctaattttttaattttatttttttatttttgtagagacagaggtttgccacattgcccaggctggtctaaaactcctgggctcaagctatcctcctgcctttatttctattttgaagcaaacaaaatgatgcaaatgaataaagagtcctaggaagaagtgtcctctgctcttgactgtccactaactccagacttcatagtggccccctttgcttaaggcatatgataaacttctaatgatgcttgaattatatttccaccagcaggatcagttattttcctcagactcaaattttgcaatcaaaatgcacagtgtacacacggctgcttatattgcagcacatagcatctattttaccatttcaatttgtgtgatttcttacatgatggattgtgggatgacaataatgtgttctcagtgaagcctcttgactaaaccaaaatttgcatttttataaacctccatgaaacagctttacttagtaagattctataatgctatactaaagaaaattacgtggtagcttctaaaagaaatactccctccatcacagagaccgagcctcatatgaaaacagtaagcagcacacaggaaactcatgctgtagatgaatttggagagccacctcaggttatttgcattatagaatgctaaacgcagactatgcaagaaaccagccacctagagagatctatatagaagtagagaaacttccataccaccagcaattttggctttccaataaatattgagtgatgtccaaaagtcgtataattcaaaaagtctagggtaaggaacaagataaaagctaacccttgtgggtgttggtaaatcaataattaattggagatcttccatgatatttcctcataagaatcattgctaaaattgttgtaatgactacacagactcccaagattgcaatagtcaaacaacacaaactgttgaagtcatgaagggatatgcaacatggctccttggttaaccttttggtagggatccagtttccaccatcatgaagtcctgttttcaatattaatttacatcattagaatgcctgctgttccatcagcattttcttgagatttcctgggccattctcagaaaccagagttagaatgcagaaattaatcatatttcattttgacctaactattatacccagatatttataagcctgaagtatatttttgccttactgataaaccaataagaaagaacttgaatatctcataaaataaggtctttccgcaagccacacatatctagatatggataatagagctaaataatcaggtgtcgagtccaatacactgtcaatctatgtttgacaagcatccagttccttgccttgagtcattcagttcttcgttgttcttgctggaatgaaagcctatacaaaacctagcattaatgaagttaatatgaaactaattagctgcaatgctactgcgggaaaacggccaatcatcatttaatgaatgattctcagttaagcacttcagaaaagtatttcctctgccccataatcacccagcttcatgaagatcctgctttccaggtttgaggtgtgggatccagattcacttataacctaatcaggaaatgaacaggatgatcttgtactgaagtcctatattagtaatatatcaaatgaataaagaaaaatgtaaataaagttagaacttgtagtatcgttttatcaactcgcagtatgtgaaatccatgatgtacctgcaccataaataaaacaagatcttcaaacttcccagggctatttaattcttccatgatttttgttcacaaagaacaatcattgctcagcctattcattgctccttttggaatgaaatacttttattactattcacttcaaaatatttttaaatttctgttgtgattgctccttagacccacgggtttattaaaagtatattgcttatttttaaatatttagggatattttagttacttgtctgatattgattcctaattcagtttctctgtggtcagaatgcatgttctgtatgacttcaaccctttgaaatttgctgaaacaatgttatgattcaggatatggccttggtgaatattccatgagtacttaaaaggaacatacattctacagttgttggctgtagtgttttattatataaacgtcaattaagtcatttcttaatcatgttgagaaatcatctatgcccttactaattttttattttcatgtttaatcagatatgagaatggtgcgttaacatcttctatgattgtgtatttgtctatttctgcttttagtcttggaagtttttgctttgtatattttgggtctatgtaattagatgaatgtagatctttattttcctgatgaattgacccttttatcattatgacatgtcactttttatatttaatagtatttcttgcattaagttttaatttatctgatattatgtataactctaccaactttcttcagattagtgttatgatggtctttttttcccatatctttattttcaaccttcttggtccttattagagtatttaatccatttacatttagtgtaattactggattatttgaatttaaacctaccatcttagtatttctttttctgttgtctcacctattctttgtttctattttaatccctgcttgcctttataaaaattttaaacaatgacaatttttaaaatattttcatttatcttctttgttaccttattaattaggcctctgttgtaattcacctagtgctaacccagggattatagcatccatctttcactcattacagtctacttaagttaacttagtcctttagttagcatcatttctgtcttccatactactgtatgcgttttaattctacatatattattaaaattataagacatttttattgttgttttaaatagtcagtttaaaaaatgtaccctatatttactgttttcaatgaactttcttttttcccacattacatacttccatgaacacctccttttggcctatagaactcctattaatatttcttttagttcagagctgctggtatgtattttctcagttttagtctgggctcactttctgtgattctctcatccctggattattgactttcaaaactcagtcatattggcagcccctagcccagtgacactgtctcaaatcccagaacaatttatttaatgccacatctattcttgctccaaaaattggcaaatgcctcaagaagaaatgaagagaagccagtatgagactcgcctcaatctacttcccttttctgtgggatcttggatccctctcattgaccaatatctttaaagagttagatgatagatagatagatagatagatagatagatagatagatagatagatgatagacaaacagattgatgttatttttagcagcagcattagtgtgaataagctactccattttagctagaggtagaagtaatttcttcttagagaaaaagtttgtatagaattgaatttaccatcatagccattcttgaatgtcaggccaattgaactcctaagactctagcatatacaaaaaacagaaaccactatttcttatcatatgtttaagggtgtgtatttggaaccaatttagccacaaacttccagatgatgctgacataccaataattactattaaaaagcaatataatacacagggaaagcaaatatagtcaattgatatatgagctgttgctcttattgcaaggattgtaagagttctgcagtgtggccattatatgtgtgcctcacaacttgtattcattgtaagcttcctttgagaatttttatctaagaataagtctaccctcattttttgtggagtatcagagcttcttctcctatttgtcttcaagattgaaaggagaatattgaatgctgattctctgaacatctgcaataatgtattccaagatattggcaaaatcagtccaaaggctcaaccatcccagctaattaaattacctggttaactctgtggactaccaaatctaaatggatgtaagagaggaagaaatttgaaaaaaataaagattacacagttgaaaaaacaagatattctccagttatgaattcttttccccaagagtgtcttttgtgtacattgttattacaaaatccagttgtcacattaaacaagccatgctatccaaagcagagttgattgtggctggaaatttattccaatattgaaaagatgtgaaagggctataacacgtatcagacaatctagaattgaccactaggggacatgaccatgaagccttagacaataattcatatttagtttgaagtactattctgaggcaaaacaaacaaaaaagaatgattatggaggactcaatcttaaagtgtctccaagcatgtcttgttctgtctcaaaccttggcctcaacaatcaaagctctgtatcattatttgcaacacatgaatgctaaatggtatcatttctgactatggacctatgtgtagttaagttgtgtgtaggaatatgaggatagaaactattactatcaaccaaatggtaatattggacatgtttcaaagattgtctgaaagagcttgtccatggagactaacccttaacaagtcccaggtttctcctctcctagaatgtgaattccacgttcaccagcagaattcagttctgctgaaatagtcatggaacagtattgttttaatttctcaaacttttcaaccatatgtttataaaggtttataagacaaataagactatccctggcatataattctttcagtaaatacttcacatattcttccataagaattagcctcttctgtaaactctggagctaccccaaggtaagatcgtactactgtaaataagcccgaatcactagattccaaaggccaatggttacccaggcattatttgtttatgacctaagaaaataagtccatagaaataaattggcttgaacagaaccatcaaaaacccctttcaatagacatctcaaatgaaataggtggttctacttcctgagaacacctaaagaacctttgtgtaaaagaagaaatcattatttccattcagtagcaatttttgaatggtgtaacttgctatctccttgcctattggtacaatgcagagaaactgttcaaaggtgagccattcggtaaagaacgatagagttaatcagagagtctctgttatgcagctacatggaatgcaggtgttcattgctggtgtttttacccgctttgagttcttgtttgtttttgttcctatagtaggatgctgcactgatttgggcagggcaaagtggtggttgatggaagagcagaacacctgggaaagtcatccagagtaatttttgatcccaagaaaagatcagcagaattctccttgagtctctaagtcttcacattgtagaactgcttaggtaaaaactaattcaggaaatgtgcagttataaaactttaataagtcacccattaactgacattttaaatgtaaatgtactaaggggactctttatttccctctcattcgtaagtggaccatcctcaacacagagacccaaaccagaaacttaggaatcatctttgattactctctttcaatcttatcaaatcttattagcaaatcttatccctgaaatctttgtccctgaaatatatctcaagtcttacctgtcctcaccagttccaccgctaccatcctaatcctggcatcaactctgaactggactgagtcctccagcagcctggttccactgcttctattttttttccattgtctctctccatttcattgtacacacagttgccaaaataatattttaaaatctgtatcactaatttaaacgcttgtggcttttcagtgtacttagaagaaaatccacacttgtagaccctgatgcattcagcccctacctgcctccccagtcttataccagactccatttctcatatattgcagccatgcttgccttttcaacatctcaagcaatcgaagtgctttctcgatttgagactttttgtgcttgctattttcattgcccggaatgccttttctgagaatctcaagcagttgactcctctgcattttttatgtataagctttacatggttcatattcagagatcccttccctgagcacccttagtaaactgttcttggctttgttgggtattattggaacttaccactgcctataattattatgtttgtcatcaggtttacttgtttcttgcctgtgtcctccactagattgtaagccccagatatcagctaattggttgtataagtttccattctttatatagtctttgaatagtaatcatgtacttagtaaagccactaaggcaagtggccaaggagacgtggacagttatttatatctaatccaatctgaagaattattccaagcaaaaatgacgtgactgacggcttaaaatagctaaaaacttatttagttctatctcaaacctcagcttcaataagcaggctttcagccacatgttttcagtatatgaattgccagagcttcctaccaactagtcatatagtgtgtctaccttaacctggtacctttacttgggttgcatttcatcagcagccaagtccatctatttgtcacagtgtctctagtacactgcttctacatagtcagcaatcagtgaatacttgatgcctgcatgcatgaataaatgaacttctcaggaatgctagggccagagaaagttgatgtttaaaaagttagaaaatgtaggcacttgagaaggattaagaaattaacataagccttctttgaatttatcattgaaatctattattcaatttacatgtacaatttcagcaatacatatacttcctttagtcaaatacatctccctgtagcacttaccatgtctctgaccctttgccttgcaaattccactctgataataccagcagtgaatagaaatttaaaaagccactgtcctcactccttccactcatgttctaatgtaagcctttcttttatgcagcctgaatgcacaattcacttgtcattatctcgcatcctagctgctcctcatgaaatggcattcctctggatttgctgagtcctaatgttcaggcaaagtaaatcccacatcattctggcaggctttcaggaagacttagggactcgttgtctgctagtgcaaataacagcaaagtgtggtaggacttcctccttagttcagcgaagagccaggtccttgtcgcacggccatgaaaaattaggctcacagacgatttcgagggggagaaaaatgaaatttattgggcaaaaatggggaaattagaaacaggggccctctccaaagccagagtccctgctagagtacttcccacctcacaggttgaatcccaggtgccacccaggaagaggaggggccagactcctcccctctgccagcagagcaaacttctgtggctccaccccagtgtgtattcctcccagtgcgcaagtcggttggagttttctgggaaccgccttcccacctggctgtctcaaaaggactcccagttgcagaggtatgtgtgattcaacaagatccactggcagaaaatagaggcaaattaactcaaggagtccattggaatatatcaacgtactccccttccactcacaaggcaatgatttctaaaacagtgaatcattttacttacaaggggtcacaatggagacaggatagaggaaactgcccgggagacacagggacgaggcatgtggagaggtagaccttggatccagttctgcagccagtgagctgctcactcagacctgttgctcccctccagagcctccctttcttcatctggggtatgaaacaactggaccagcttatctctgagatcccgctcagctctgaccctcctgttggagaaggcttgcattctgagactgcagtcccaagtagcaatctcttcggagggcatgtatgtgattacgtacttagtgtgctcacatagtttcataagaatccggtaaaattcattcttatgctacttttgtattcccacttattttgaatggaaaatccttgtacatatttcctcaaattatggataaaaagtatacaaaatacaccctagaggccaagaagctccttttggtagaaagaatgttgagccctatgaatttgagctactcaaactttgtggtttgttttgggagccaatcttgaatataaaatattttttgatccagcagaaaggtgaaatcacattgaagtttacaaaatagtaatgctaagatagatagattttcttgtgtgccacacttatgttgtaaccagaacttaattcaccataatcattgacaagtcttttgttactggaaaggataagggttggcaggtcttgtgacaaatgttagaatttaatgcccaggatttttcttgatgcacaggactcattggaaaagcggcagctatttattgtgactatgaatcacgtccacagatgaatatgattaagtgctaaatccatagcagctcaagttttttaaagccttggaaaattggctttaaaaaatatcacctgacaaacctcaagctttttctgtctcacaagacttttggaaaagaactaggatcgacagtgttttaaggctcacaaggaaaagaatctaacacttgtaaaattatcttctgtgcaagttttattttccaacgtgaatctgggctgccaagcatactggctctagccagatcttcattagccgatccaaaaagacagtcggggcatttatccagataatgcaagccaacactaccctctgagaaaacaaaaagtaacttgcctgatgaagcaaggaacctcaccgattattccagattaatgcatctccttttactggcaccatgatcagatattttcaagacaaagtacttggcaagttggaatccagctgggtcctttgatttttgaattcactttgcttctgtgattatggccacagttttgaaaataaagtcatgtggatagagttgtgatttttagggatcaggatgcctcataaaacaacaatgctgtattcttttgtagaacaagatcctgcctaggcctctttcctagtattaatctttggtcatgatgaatgtgctcccaaccatccaacctatccctttgcaaccaggcttttgtgagatcaaataatttttagagttgaaatgaagttattaccagctctaaaataaggtactacaggagggaagtaaggaccgacaagagttaaatcactttctagggttgcgcaggtaactgggaatgaagccaggatgacaactctacttgctctttcattgtatcttatgcttctctgatgtcttccaagggatagcaatataatcaatagtcttgaaagaaagatctttgtagagaaagggtcagcagattatgtttgtaattgactagatagaagtagttttgcttttgcaggttaaatggcctctataaaatgtaattacccaatgggttcttcctgcccactacacaaagaccacagctctgcagtaaagagtttaactgacacaaggccggccacgccatgtgagagacagagttattactcaagtcagtcttatcgaaggcttgtgggctagtggtttttcaaagacagtttaggggaagaggtgggggtggctaggaaatgggtgctttccactgattggttgaagcggagaagaaatcgtaaggggtcaaagctgtcctcttgagctgattcacttataggtggggccctaagggtgatttggcaggtccgggtgaagccatctggtacaagtggagccaaccatgtcagacatgcaaaaaacctgaaaacatatctcaaaaggccaatctgcaatagtgatgttatctgcaggagtaattggggaatttgcatatcttgtgaccagcctacaccttagcagaattcaggctcctctcctccccatagactggggctctctcatggctttacaaaggtggttgacttttggggaggggctattatcatttaaaccataacctaaaagtcttccaaagttatcttggcctcagcccaggagtaattaaggcagcttgaccactaaaggtaagagcagagatggctaaatcagatctccttcactgccataattttctcactgatacaatttttgcaaaggcattttcacccactacccaactgtgtcattgtagcatgaaggcagccatagaaaggaataggcatgactgttccagtggaactttatgaattaacactgaaatggaaatgtcatacaattgtgacatgtcacagaatatttcatttttaattgttttcaactattcaaaaatgtcaaaatcatttttagcttggtggtggactggatttggtccagagcagtagtttgcctgcctctgttatagagtaacacatctgagcccatgagagaattgatcctgtaccttgggtaatgctcttcctctctggctcctttctacacctcagtcacttttcccctgcaagagtgttgtcacattagactgtaaaattggatcacttttatatttcatctctaacatgccttatttaataaaagtcattctaggtatgactaaagttccagggctaacttagaaaaggactgaagagaagaattccttctgacaaatgcggacccagccacaaatgccagtgatattgtcccaagtattggtggcttgggttgcacttgataacagagggcaaaagaaagtataaattttgcttgttaacatagctttagtggaaaatacagaaaatgcccccaaactccatgctaagatcatgaactaaactgttacaatgaaaggaattacttgggtttctataaaaacagctgcctcaaggaatttgccacattccttgggtctgcctgagctctggtggcccactgcttggataggcctggtttgtttgctaacttaacatgcttgcttaacggccaaacattcccttgaaattcaaggactttctgtcccgctgacactgtttatttgtatcagtagagtggagggctctctggtgacactctagttttttctgggttataagcagatgcaggtctgtagtttttctgacttggatggggccaatgggtctaagccaagaggaaaatgcttttttctttttcgtgtttatttccttttttttttttttcctatcttgattggagtacccttagaaggaaaaggagagccataatcgttctctggaggccaaaagaaggccgaaggatgccaaaaattgtcacagtggtgacttttggctggagccagtgcagaatgaggggctatgagtgtgtcactagaactgtaatccagatctcttccatgaggtcaggaaccctgattcgtattgctttttccatgctgtagaacatgacaccccactcaatcacttgtgctggttcattgttacttgttatagtagtcattgttatcaagactttttggttgtaagtgtcagaaacctaactcaaacagagctaagcaaaaataaatctataaataaatataattagctcaaaagtctgaactcactggattgatcttcagacataattgcatgcagtgttcaagcagcagctaccatctctccttcccttcctctctcttatctctgctttcctctgtgttaacatcctgctctgataagctttctccatgtggaatgaaagacgggctccagcctttccaggctcctaagttccttgcagctcacggtcccagaaggaaagagattgtctcccagcatctgtctccataaaaagaagccaccgtccttgcttgagtcatgttctcactcttggacttagcagagtccagaggggcttggatactctcacttggatactctcaatacgtgccagcaaggggcacatattcacccttcattgggcaaggtaagcctgttaacagtcccactcgaatcatggggagtaagcaaaaggaagttctgaaaatgaaagaatgtgggacagacataaaactcaaagctgtgcactatgctagtaaattattcttgtgtacttaatatgaatatggcttttataaacagtaagcaaatcagaagccaccctgtgaatcatcagttatctctagacatttctggattccttctttattccctgataatcttctttccttcctttcactgcgttgtaagtggaaataacacaagccaaaaagaccctctcctgctctcaatacacacatggtctagttcaggaagacaacatataaacagcaggcatacgagcaatttcagtagactgtgatgcctgcccagggtgctcgtggtctacctttcatggaccaaagacaacaggaataagagcattcatcttcctctgctattgtgagaatatagacagtgcaaagacttggatgccagtgctaacatccctgcctgacctgactttgagaaaaggaccgccattttcagcacaacccacaggttctctaaatactcaaagtgtgaggctagcagataaatttggcttatagagggagcttcataccatggttagaacacagcaagaaaggaacaaatttttaatgtattaattgaaaatcagatttctcagctgggaagaagatattagctggaacacacacaaaaaagtatttttaaaggtgcccttttaaaggctgccaaaactcacccaaagtagtattcaaatatgaagacagatgtcttttcaagacgggaaattttagttccgagtatgaaagagaattttatttatttgttttttcccttgccttttcaggcttttcactgacttcgaggggatgagggtatgtgtgcttaaagtagatgccagagtgtcttcttggaacttcaggtttccatgagtagaaggaagtgttgaatgaatgaggacccacggccctgtccagtgtggacatgccataaccctgtgctgagcttcctcatctgtgttctgggcttacattgaatatggcataagcaaccccgaagagccacaaaactctgctctgttaagggaggagggcaagtcctccctggaaggggttgtctcatcaaccaggaaatggtggtcaggatggatacagtagcatctatacctcagcccccttgaagtatcctgatgtccactccccacaaaatctaggccttccataggaagtcaagaggatattgtgctgatataaatttggaccaccagtgagtttgccctcagacctggtaagaagtgcatatttcagatataagatattgctctggcctcagctacatacagtttccataaaggaaaactttgaaggactgcctgcaggaaaagaatagcctcgtgttgatgtatctagggacagaactctcaggcaggacaacagcttcctcaagtcttgtgactacactctttttcccaagatatctcattgcatctttaatttagctcctaattcaaagccaagctcatggactgtttcaagctctggaccatgagcttagctctgaattaggagctaaattaaggatgcaacgagacatcctgggagaaatagtatagtcacaagacttgaggaagctttagtgaaaagcagacccacccagcatgtgtaattcttccatgaggtttcatctcacagtctgcatgtcttgcaagtgggcttagggccacaggggcaggagctcttggtactcagaatgttgtctagaagtttggaggagagagatcccttccaacctaggtcaaaaggcagaactggtaaaggacttgcagacatgataactttgagcacaatatctgagagagcaatccatggaagtcatttgaggaagagcattgtagacaacaggaatagcaagttcataagccctgacctcaggaacctgcccggtacattcaggagcatcaaggagaccatactggccaaatggcacaagtgtgaggaaagtgttggtaggaggtgatttcagagggatgcctggaggccagatcctggagagtcttgtaggtcattgtataactttgacttttactttgaatgagatggtaagcacttatgagcagaaaagtgtatgatttaacttacgttctaaaagaagtattctggctcctgtattaaaaataaactgaagggcaaggagagaggtggagagacccattgggaggctaacgcagacatttatccaggcaaatatcacttagacctcggtggtgcaagtaaggaaaatgagaggaaattgcatttataaaaatctcatttaaagatagagtcaacaggattcatcattggattggattggagtaaatgagagagagagggaaatcaaggatgattcaaagttggttttgtttttttttttgttttttttttttatcttgagcaactggagagatggagacaacattttaaattactttgttctttggtaacatggcagtaaacacacttataaactgtattacaggtggcaatcaaaataagcacctggctgatttgaaatatggtttaaaaaaaattacaaagtaaggaagatgaacttgtattgttctgcccatgcaaacaatctgtaaaactgtgtgcatttatatatttttcagtcattaatatttacagcgggagagaactgtttgtgaaatcatgaattatcttttgtttgaattttattttattaatgagttagaagtacctttgtaagccattgtaccttttttctaaaggtgagagcctaaaactaccatgttgcaatggaataagccctggttctagcttcacgccctgggagtgacttctattagctttggaatctccggtaactcctttaatcctttgaattctcactttctatgtcttaaaggtgatggctgcccatttcatcaactgtgaaatggcatccaagtcccaggtatcgttaagaaccaacggcttccattttaaacagaagttttgttaaacaaatatttggttttacaagggtattataattcatacccttattcattgttcttccttgctcccaatagtcgatgggttttttttttagctgtggcttatgtgatcaaagaggtgaaacaagttagctcaattggttatattctgaaattaataaggtgttctttttgcatgtgtatacaaattaacttccctctgtttcttggccacacacctcacctcagcttcacaaatgagtagaattgattacaacatgaatcagacaagagagtgtagatctatcactgttattgagaaagcagttcaaaaaacaagcattcccgcatgttagtaacatgtttttataaaagctgtaaatgtatatttattcatatgatttaatattttttatcttcagtttttattttaagttcaggggtacatgtacaggatgtgcaggttagttacacaggtaaacatgtgccgtggtggtttgctgcacagatcctcccatcatgtaggtattaagcccagcatccattagctattcttcctggtgcccaccctcccctgaaccccctcccctgacaggctccagtgtgtgttggtccctgcaatgtgtccacgcgttctcatcattcagctcccactaataagtgaaaacatgtagtgtttggttttctgttcctgcattaattcgctggggataatggctttcagctccatccatgtccctgaagaagacatgatctcgtttttttatggctgcatagtattccatggtgtatacgtaccacattttctttatccagtctattattaatgggcatttggcttgattccatgtatttgctattgtgaatagtgctgcaataaacatatgtgtgcatgtatctttataatagaatggtttatattcctttgggtatatactcggtaagggaattgctgggtcaagtggtatttctgcctctgggtctttgaggaattgccacactgtcttccatagtggttgaactaatttacactcccaccaacagcataaaagccttcctttttctctgcaacctcactagagtcagtaatatttcttcaaatatgaaggacttgacctcagatcctttatgatgatcataaatacataaatagataagttaaaaaataggaaggacagtgtgatactaaataactacaaaattagagatgtatcaaaaagtatttaggcactaaaatagttgagagatcattttcagagcctccaagagtttctatgccttgaattatttgagcatccagtgcaagctttcagagtccttgcttccttaaatataaaacaagaagtcagatacctttgcctctgacttctcagaggtctttgagcttgacagttctataattctatgagttttctacctagaaactattccttccattcagttaggaaatatattcaagtatattttatttaatcttaaactttggaatcccattttggtaagctgctgttatttgaaggtgttgacgtatcctctgggatctgagaaaattattatcaaaaccaattaaaggaatcatctattttgtgcgattggttttgaaatctgtccagtgggctctttctggaggcaaggatcctggttaccaagagactttgctgcaaataaggcaaactgggatgacatttggggttgggatccttctcaggaccaaatgggcacccatcatctttgggtctagaagactgcactggcataaagcagctgacttcctgtagccttgcagaaataacaatggggtgtgtgtgtgtgtgtgtagtgtgtgtagtgtgtgcagtgtgtgtgtgtgtgtgtgtgtacaatggtggggaacagttggcagagcaatgagcaagaaatgggaaacgacactcagaaaagcagcaacctaccctgagcaaatcaaagaatttcttagaatgcaacactagctgtgtgtatgaataattggcttgcaaatcacttcctctatttgcttgttatataataccaatcatttcagtgtcactgacgaaagcccagaagggaattaccacttaccagccagttttacatatggcttttgtgaggaataaggccttgaggatgagggtctaaatctctggcccacagatctggacaggcagatttcaagctgatcattacatatcttttgagagagacaatcccagacgaattggcctggggggcaacatgagaaggcaagacaaaagaacattgtaaagacttcacctagaatccaaattgtagttctctcagcaagttatcaagaagcaaattaactgctagattttgtaatccaaagattatttaatctgtttagctttgtgttggaaggatcgctactaatcatctcttttattaaaatatgataatgatagccatcctttattaagtgcttatgatataccaggcactttgtatacatgatttgccttattcagaataaccctgaaggatcaatattattgtctccatatcaaagagagggaaactaaggcatacaaaagttatttgctcaaggtcaaacagcatggtaagaggaactgcaatttcattccaggtcttacggataccaagtccgatgcctgccagcttgcacctgttaagtcatgtgatacttaggaaatgtacacatcaccccagtgcagaggcctttatccacttcccttcattttgcctggattgttgctgtgagtgagaaataaatgacatgaaatgatcatgtatatcactgtcttcagaggatggttagttccttgctctggattgtttttctcttttgttggatatttattttgacttctctgcaaactaaaaatatgcatgctctagtttctcttgggtacataactcccaatatattgtgaagaatgaaactggcctacaaagtttaattaagaagcagtgaactagagcttacttagacaatacttgtactagtgtgggttcatgttgtccatttgtctttagaggtgtagaaccttgaaagtcagctaattaatcactattactgttgtgtacagtattggcaatctcctatgctaaaattttttgtgatgatttgaaggtgggagggggcaatatttactaagtctctcaacctacatggcaatatctgaaacctgcttataatgtagtaatagcttaggcaccacctatttctgaaacataaatcatcccacaatataagcctcccagttttattcatgcgtcttaccatgtataaatatcttttaatataccatttatttccttgagggacagttatttgtagcataaatctgcctggataaaatagtaaaaattgctatgccccagtgaattcagtttacaaaagcttacatacgtgaatgagacattggaaatgtggtttatagttaaggagaatggatcacacggattatacctgtataacttccctagaaggttgataccactaagatattaacaccaaaaaactgaaaatagtatttttcatcttactttgttatgtaccctttgtgaatttctgaaaaacacctttctattatgatgggataaattacggtgtggtaacaaacaagcccaacctgtttgttccggtcaactagttgctttataacaaaccaccccaaaatttgtttaaaacagctatcatttgattgtgctcacaagttctgtgagttaggaaataagacacaacacagtggtcttatgtctgttgtgtaatgtctgggttctcagctgtgaacactcaaatggcttggaaactgaaatcagctggaggcttccttattcatatgtttggtgcctggctgggatgactcagattagttggggctcttgacaaaagcacctatacatgaaccctctcaggagccttggctctatggtggctggattctgagagggagcatgcagagaaaagaattccaagacaatggatgctctaagagaagctacttggccttttctgatctagtcttggtggtcatgcagcatcacttttgccacccagatcaaaggggaagaggagacagactccacctgtggatgggagagtgtcaaattcacacagaagttgtatgcaagctattcttggtcatcttgctcatctatgaaatataccctcctccatgcattgacttacaacaagggtttatttcttgctcaaagtctgctgtgaatctaggcaattctccagagcagctgttcttttgttggcttagcaatccaagctgctgcttccatcttacagcttttccatatcaactcatgattccacaaccattgctacgaggcaagagtagtatggaggatcacacactactcttagaaaccaccagctggaagggacttatatcactcctgcttacatttgatggctcacatagccatgcccaaattcagtagagcaagcatggccctcctgtgtacccagaaaggaaggagagctagaaatattggtaaatagcaatattgtttaccatagcctcagagatattgcctcgtggtgaaaccctataattcccctcaattctgatttttgccctttatcaaatcattttattcattccttcatccatccaacaaagatgttttatatgcctactattagcaacaatcagtagcttgttcctggagggaatgcagctgctccccgccaaaacaccatataattcactctagaaaactaaaatttcagatgctttgtcattgattattgtggggagaaaatgtctctttcagctccgactttgtcctgtctcctctaaggcatgtgaaataagatttttttttcctattcttacctcctatggtcccattttatggttttcatgcactactgtcagtcaaatatttatcatatgtctttcaatatctttccaatatttatcatatatctttccccttgtaggccttaactttatgacccactattaagcacgcagctgtatttccagaaaatgtagatggtttaattcaatactgcatggcaattaactgtcttataaattaaatcattttaatccatcttagagttatcatgcataattagtctgacagcacaattctgtttgttgttgttttaaaggaaatttagatatcaaggctgcaaagaatgcgtaagtctaggcagaaggctcttattttccaaaagcagagcccatcgttgcatttcaacaatgaccgcaacaaaaaccatcaggagctgtttggggcctgtttgtgctttagtcttcaattagaaaaaaatgtgtttctgatggaaaaccatagaacaatcctcactctgtggtaagaaagaataaagagaaagaagtgggctctatgatagactgaagcaagaatactattttagactaggtagtggccgggcgtggtggctcacgcctgtaatcctagcactttgagaggccaaggtgggcgtatcacctgaggttgggagttcgagaccagcctgaccaacatggagaaaccctgtctctactaaaaatacaaaattagctgggcgtcgtggcgcatgcctgtaatcccagctactcaggcgcactggctcacgcctgtacttgggaggctgaggcaggagaatcgcttgagcccaggaggcagaggttgcagtgagctgagattgcgccattgcactccagcctgggcaacaagagtgaaactctgtctcagaaaaaaaaaaaagactaggtagttatcttcctgggtggttttggctatgtagaaaatcactcttactctcgattaatttatgtaccaaatcatgctttgaaatatcccactgaaaaggtctaaattattgatatcttgggtcaagttctgacttgaaggcaaatagtaggaaatacaatggcatttattggaggcacacactacaaatattgtagtatctttaagatgtgtttaaataaacaagtagatgataaaactataaattagagtcactaagactctctagcagagacccttaccttttgaagtgcaccttaaaatggcaacaacacttatcagaaattccataagaagcttagttgtctgctactctattgcagtatcatatgtgtgagctgcatgaaaactggatattattattatcaaaggttattatcaaatggagcacaattttattaataacaatattattattatcaaaggttttaatttgctaaaactatacagcttccttaggtcttccaaactaggtcagccagttaaccctcagatctggagtaccacatttggctgagtcagaagaaataaagatgctctcaaaaccacaaacaaaactgataatagacattctgataactttaactcccacagtaataaatcttgggtcttttaaagttggtcagatgtacacagagctgcttactaattatactaaaatagttactaagcaactcgacattttgatttccaagaatttcagataaagattatgaactttatttatttggtgctttagagtccaaggcactattttacagcctaaagctgtatttctcaaggccatcttcttgcattcttctaaaacttaagagggatcatctgtcctcaaaaatataagaaattctgtaaatgtgtatttttgtgtatatatatatttgatatttaaaattctgtatctatatatacttccaagaccccttagaacttacacggtacctgtaatttgtttcttttttatacttaagtacaagtaatgttagtgatacatttaaaactaggaattaccttgtttgcaatatcaaatttttgtaaaatattgagttaaaaaagtctcctaaaattaagatttgaactattataaatggcttcaaagatcctttcgtttctaagagaaggaaggaattaggatttattgtgcatgtatttcataccaggtgctcatctacagttattgaatccttgcaacaatcgtatcaggtaaacgctgttattcttctcttacagatgaaaaatctaaaccttctaaaatgaaagtttgtccaagttaacatgaccaattaggagagcttggattccaacccaaatctgttcagtatcaaagctcactctcttccatccttgccccttctcagctcacatagtagctttcagaaaacagtagctatctaccccagataaaattaagcctttttttccttaggagaggctagaaactgaatcttctaccccctttattggcatcacacaggcacaaaaatcaccaattctcaaaaaccctatactcccaagttcaacccaaattgaatggttggaatattgttggtttgtatggaataattaacccacatctaaaaattaattatacaaagtgaagtggagattgaagcagttttctagataattaaggcaaaaataactgcaatttttttaaaagacagtttgaaatatttagaagggtagattgcaaaattatccaacttaaggtagtcatattcagggagtttagccaaaacacctctgaagttcattgccttacaaatgagtataaaacttaaacctatgattaattccctgttgtttttctatctgtattatacatataaatatattttatatattgtcctcctgagatttcaagagcaattttcttctaattcttctaatttcttctatggattcaccatagtgaatccaccgacacgtctaccctgtgacaatcttgttctccatttgattgcatgaaaaataccatatgaatttgacaaatcattggtttttttgtttgtttttctcttttgctgcatatcattgcctatgcttcttgagcactagaatatatttgtgcatgtataaaccaaggcctttcttctgaaaattaatagtactttgaatctcttctatattctggttcttttaaactgtggttgttttaagtttgcctctcttgttttaggatttattctttattttgaggccctgatttttcacaaaacatttttctcaacgaatcctgagaacactggacaatcatagcttttagctatcatgagtcccattaccctttggcctccagttaagctctgtcctgcaagacataaattgtctgattatcaactcctactttgagtgaaaaatggttgaatgaaatgaatatgcagttcatttcaacaaagcaagaaatttgctgtttaaaattgtgtttttataattcttgagatggaaatatagcagacctctgtgaatctgagaaggcatttcatgcttccagaaatgaggggagaagtggcaatgatattgctcatgaacaattggaagcaatgatactagagtatgcagcaaatctcagggagatttcagtggtacagtaactggcctcacaaaagtgggatttattgcattaaatctttgctgtcctttctggctggtttgatatttaagaaattattaaacataaaattgtatgagcagttacctatggtaggacaaaatggactgacctctaatggcttggtagatgggataattttgggaagagagagtggagctcagttcagcatcctactctcctcctcaacatcatttcccattcttggcccttgagtttagataggagttgggcatgtgtgtgtgtgtatgtgtgtgtgtggtgaagtgggtagattcctgttcccaacccaattagataactccacttccatctatcttccttgcatcttctccagctcatttgcaaaagaatgaaagaagccttgcttcaaaaaggtttagagggctaaataagagcacaaactggattttctgaaaactgacctgattgcctgggtaattaaactgtcactccagcaaaagcatttgtctccaaaaagtactgaggttgtctttcatcactctaagtctagacattctgaaacctccatcctctcctgcagagagaggaattaagtctccacatttctaaaccattgacagtctgtggggtgccccattgtgttcctgacttcctattctcagaaggagttataacgatgacaatgatgcatgcatgagacatagaggtcctccccagccctcggttaggaagtaaggcagccacccatgtactgaacacaatagtgctttggaaagagctctgttaaaagtgagtctcaaaaatgtaaaggcctttacgagaggaacttaatctccagtgtgataaaacgatgcacacattacaaggagatggatgttatgaaaacaataagtacacccaagagtacacgtacaaatctgcattgcaattgatttatttggatgcctgtttcttcctacactatgagctccttggggccatgaaattcatttgttttatctatatatactctctttgatatcccccaccctgacagctagtgcagtcctttctaaatagttgttactaaatatgtcaaatcaaatgcctacaaggactggttggtagaaccagattctggaagtgaccaagcaggtctagcttcataagaatgccatcatcgtagatttgagggtcatgatgaagttgtactaggatttatggaggttctttgtcaaccagttcacaccaccagtgacttaaggaaactatatgtcgtctattgggaacagtcctgcttaaagcaattagcagggacaattaatttggagggaagtctctctccactcaacagcattcaaataccctctgcattagccatgttttgaaaaactccaattgcctgagtcactgatagacaaacagaaatgcagactattttgtatgcagttttataaagaagtttctaaccagagaagaaaggtgttattttgaaatattaagctcttagttgttctttcatttcagtgaacatttgttgagggcctgacatgagctaggcacatggcaaagttttagagatgcaaaggtaaattaagacccctgtgttaattctcatgcgggcaaagcaagcacattttttaagttgcaataatgcaacaatggtggtgtgtacatagtagggcaaaagcatagagaaagccatggaaatcctcaagccaagttcaaagagtcctctaatgtatggcataccacaacaaggaccttcaaagggtgcatttggtaagaaaaggcaacctccaaagattcatccaatcctaaggtttcatagagtagggacttcttcccttagctggaaaggaaagaagtcatttggtgtgcagtagacataaattaggggccgtccactttttcttgcaatgattcatctaatggaggagcagaccctggagagaaacatatctcttcttgtcttcattttgttcttcttttattaaatcacccgcaggacaaccggatgctccagcaatagattatagaaaaaacagatgggtatttctgtgcagtcagaaggctcctgtgcccttttccagcataaaacgtttatgaaaatcaattttcagtgcctgctgaaccaggctgatgtgagaactagctttccacagttcataatattcactccgggatgatttgacagggctgatattttatcacgaatacaaaggagatgagcaccattctcctaatatattcattacttgtctcaccaccctggtaaataatatgcatatggtaatttgagagacacagtgttcccattgctcttttttattcccagaactctggctgtcttttctaaatgctgcaaatcaaaggcaaagttacctcacgcacctgtagtcccagctactcaagagacagaggctctagaccaggacttgaagttcagcctgggcaacacagtgagaccctatgtctttaaaaaaaattgcctaaaaatttggccaggtgcggtggcccatgcctgtaattggaggaactttgggaggccaaggtgggcagatcacttgaggccaggagtttgagaccatcctggccaacatggctaaaccctgtctctactaaaaatacaaaaaaaaaaaaaaattagccaggcatggtggtgtgcacctgtaatcccagctacttgggaggctgaggcataagaatcacttgaacctgggaggcagaggttgcagtgagccgagattgtgccactgctgtattccagtctgggtgatagagcgagactctgcctcaaaaaaattaaattaaaatttaaaataaaaaattacttaaaaatttgattttacattcctcctattctcactttctggtgcccatacaacacataaattacattcttctctatgtttacctgcatctctagggaacaaagcccctttcacttgttctgttactatagaatgttctacaataccccaataaagattcattcatttgttcatttacaaatatctattaagcacctactgtgtgtcaagcagtatgctaaatcttaagcatgaaacaaaagaaagataaaagtatctgattcagggactggttgttctgttgttctgggttttttttttttttttttggaagcttgttgaaaatctgtggcatcatacaaaacaaaaaagaatgcaaaactggtgccttaaatagaaatgtattaataatgagtgttagagctaagagaaggcaaaatgtctacagaacacatgatttcaattaacaacagtgagtaaacgaatgatctggaaaaaaattatgatcgggcccatgatttttttttgtcgttttttaaaaattttgtttgtttttctcatactcatattattctaaggcccattgattttagaaagaaaatctgttttataaacttagcatattaaaagcaaatgcatagctccattttcttagaaatgcgtgaatacataaacatgttttactgagagtaggacttaatttatatgtattaaactgtcagaatatacaagttctttgtggtcagtaattctttcattcatttaacaaatatttcttttgctaccatggatcaatcagtcattgttataagcattgggaattaagagtcctgccctcaagtttacatttaggtgagaggacaatgaaaacaaataggtgaacaaatataccagataactagaaattgcaatatgtgccatgaagaaaacaaacgaggtttgtgtgtctgtaaggaggtactttgcataaggtgatcagagggagtcaatcatgatgataggggaggaatgtcagacagaaacagaatatttacctatcgtttccagaagatagtgctgcctggaaaatagcagtatacatttatctaaattacagatttgcaaaatacagccagtggtctattttcataaagttttagaaccatttttgtaaataaagtattttgaaacacagccatacatattctttaacatatttcctatagtcgtcttcatactgcaatagcagagttttatagttgcaacaaagaccctatgggccacaaagctgaaaatatttaccatcttgccctttatagaaaaagtttgccgactctggctctaaattccttatttgcataatcataacttttttgtattttttattttgttgtttttagacttgtaagttcatatcaacaatttatagaaactctgttaaaatatacctagtgaagacagctgacatttattgggtgagattatgttccaggcactcaagtactttgcatgaaatgcattacaggtaatgcccagaacagtcctatgtggtaggtgctattatcactcaagcttatagatgaggaaaatgagaacacagaggttaagtaactcacacagcaagtaaatggtggagccaagaatcaaaaccagacaacctggccatagcactattctaaactgcctctgtcatttaatattctgtaacctcaccaccataatagatctgccgcttaatactgcctatctgttcctaatttgcaaaaggaagaagcatcgtgcaccatcttgcaccaaagaatttagaatttgtgttggagccaaattttactgttattccttgcttagcatttagaatatgaagaaggtttccaagtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaggcatccccatctaaaatcgccaggtgattccacaaaaatccccggatatgcttggcacaacctgtgcaaacccacctgaaaagtccatttcagaaagccccaattctgtgatattcagttcaacctaggcatcaaacacttagccctagccctgatactatatatctgctaatttctttggaaggtatctatatttctaggttttttgtttggccaacctattcacttctgaataggctgaagagatttgccgaaggttggtgtaagcttccaaaagtcacttgtacttaaacattttcacatccagtgaaaaaattaaacattcgagaattgccattttttccaactctgagtgtgggttatgaatagctattgagttatgacatggtgctgagcagtacctaatcacacaggtgggcaggatccctgccctcacagagtggaggagacgggaaccagttaagagaaaatgaacacgcaatgtaacaagtgctgtcatgaatgcaggatgatagagtggtccaggggcatggcatccaatgaggagttgggggtgggagggcatagtccagaaaggctccctaaagcatagacttagaaggtaaaattgactagacttagagtgtggggagggggaggattggaaatcaatgattcaaggatgacatctggtttcatcatttacatttggttgaactattagccttttttcagtatatgtttctagacacacctgaagttgatacctgtctgttcaaatggccacacattctttcattcttcatggttgcttttttgtttcaagatagcaagaaaaccaatctttcctcattttgccagtaaccggctgtgggattttggacaaactactttgctcagcctcagtcttttcatctccatagggatattgaacaaaattatgtctgtggttctctcctcatctgaaattctaccttttaaaccccttccatgtcatagtgctttcatgacccccatagattcatgcggcatttcccaattctgagccttaggatagtgtgtctgttagaattgtgttacactttgtgtcagttaccaaacctaattaaccaaggacttaagcacattaggggtttgtttttttttttcaggtattaaggaatccagatgtaagcaatacatgaatgatgaaatagccaaacaacagtgttggggacccagactccttctatctttgttctcagtcatccctgttcccaagatagctgccccatctccagcttcaagtctgtactccaggcaagaagaaagatagcaaaaaaggcaaaatcaagggccagctgaattggcttagtttgaaagagctttcccagaagttcttagtggaatttatttaaatcttattggccagaactatgtcataggccacccctagatgtaggaggggaggctggaagatgttcttttttttcagttgggtacattaatatactaagcaaaatgagggttgtactgataaagaagaaacagagaagggatgttagacaggcaactggcattgtttactgaagtttattcagatgtaacattcaaaatatttaaaacagttctggcatagccactgaccaatcagaacagaaactggccagcatgttatagccagctgaatggcagccctgatgtttttctgctttgcattatagttactgtatacagttgtcatctctcctccccccacatcataaggcctaagtccatcaaggacaggattacactttgcatgtgttctttacagctctcaagaaagattcacacagagtaagtgttcacttttgtgaaagagaattaattgttgaattattcaaattgtaatccagggatgagacaacccaaccaagaagtgttcaaattattacctagtctattttctcaggaatgaatgatttatgtgattggtggctgtatcttcccaaattccacaattgattataaacctggccaatacagatggactttgaaggttgctcaaatctcttacagctactcaaaaggattattacagactagaaaaagtattgcctgcagtgaaaagcttcaggaataatagagttcagtagccctttttcttcatttattacattgaataaaactaataaggagccaccccaataatcaaatcaagtcagttccttaaagacttgcatctggttcttccagcctataatgaacataatagcgcatcatttcttttcactcagatcttgagtaatcataatgctcagaagttgggatggagcattatagttaatttaattttcttaaaagcttgaggtcaattggaaaattcatgtgttaattctaattctttaaaaaattacatttttaatgtttgtggtttaattttcaccaatgtaattacttcaaagacttttattttctctactttgctcatttctaaatgatattttaacatctatattttttatttgctctaattctccagtttattctccattccatgcaaatcttgaattgagatgcaagtttatcctaaattatttggagaactgataatgggctaccaagaaaaaatacatacatgcaatatccaatttccaaactggctttggtaagacatatctttttgagaaatcatttccattaaaacacctctcagatgcaaattattctatggagtaataaaagttagactataatgggcattttgtttcattactttatctttaaccttttagtttggttccttttaatatttgaagtatgtgcttacatctgtcgtcttctaggaaaatccctatttttatgtttgtatctggattattttatagtatgtggggttttttctttctaccacacatcttcaattctaagaggaacttttttctttgtttataattgttgaccaggattcattttattattagcccttgttgaaaattgtagggctggcctggtgcagtagctcacgcctgtaatcccagcactttgggaggctgaggtcaggagtttgagaccagccctggccaacatggtgaaacgctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctggatgacagagtgagactccatctcaaaaaataaaaagaaaataaaattatagggctaatatgtttatccaaacctcctatagctcaactgcctacaaaatttaccttttaactgcatggaaaatattccctctcccatatcaaatttcaaaaagctatgtatttttttctttccttattttttgtaccttttgaccaatatctgtcctttctcctacccctcagtccctgacaagaactttttaaatacattttattatctttgaaattggaatacatcttataattttgggcatatcatgatttaactggaagattttttttcttggtagtaaataaagtaatggcagcagataaaacaattgatagcttcttagatgcattgaaataaagtaatctccaacagtgacagtgtcctttgaagaatttctgaatgatccagaaacctgctgtgaaccatgtattgtttttgactggtgccctattgtatcctcaccaaaatgaagtttaaatctttgaaactggaaaataagacagaataagtatatagatattcttccttttgattctctacacagggtgtttttctcaatcacacagttgaatctcactggcttgtgcctttcacatgactaatgaaaccaaaatgtgcatcattttgaagcatgtcctgttttccataaattccaatctctccacagcaattccatcacaaaacagcaaacaaatcaaaaaataaaaaacttcctgactgcccatctcctcaatgaaaatgttgtggttttaccatgatgacattttctttaattgtggtaaaatacacataacatagtatttactgtcttaactattcttaagtgtacagttcagcagtgttaagtatatcggattgttttgcaaccatctccagaaatcttttcatcttgcaaaactgaaacttccaaagtatcttttaaaaggccattcttactgaagaattctcgcatagaattgaaatagctcatctctagctcttagctatgcagcccttctaatttttgtcgaacattttcaaatagctctaagcctcaagcctgagatttagccctaacccaggccagactggaccactaaatttttaaacattttttccaaactatactctctttaagtatgtgtgtataagaacaaatggctatttcagtctataaaatgaaattaatgaaattaaacattttaatattttaaccctttattttgctttgagatggagtctcgctctgtcatccaggctggagtgcaatggcgccatctctgcttactgcaacctctgcttcccgggttcaagcgaatctgcttcccgagttcaagcgattctcctgcctcagcctcgtgaatattttaacacgttaatatttaagaatgtttcctcctggttgattcccactaaaatgcatgtgtccttccattaaaagagcccaagcactacagtgtcatttccatatctcttttcttgtcttgccttgttatttaatgactgaatgcttctttgacatcagagaataacctttcatgatatgcactcaaatgtgtagatgaatcagataaccatatccttgttaaaggagattattctgaaatatatgaaccaatgggaagacagaatttgtaagacaggaactttcttactggatttctaggaacgctggacctttctggtgatgcctccagcatgtccacaaaggacaggaggccaaatggctgaaactcactgcatgctccttctggtaccctttcagctcctcttatctcttttctgtttggagatcctccatgagattttctataaggtaatgaaagttatgctgcttaaaaaaaagtcttaaaaagtggagaaagttcagacttatttaaacagacctggattcaaactacagtccagtcacttacaacccatgtggtctttagaccaatccctaaccttctccaagccttgttttctttgtgagtagaatgaggatcgtaatgtctattgttatctctgagtcgctgtaaggattaaaaagtagagtgttattgcatgcgtcctcaccctcagtaaacgtttgctgatagtattctgcattagaaattgaagagtaccagacattattgaagcatcactttttctttttttctgtctccttctactcatctgcctctgttagaggagctcaggaaaaagtattagctaggcttttttttttttctttttctttctggaaggcaatagttctcaaagtgtggactcgataccagcaacataaacatcgagtgggaatttaatagaaatgccaaatgtcagaccccaacccagaactgtgaatcagaaactgggggtggagcttagcaatctatgtttcaagccttctaggtgattctgatgaagtttgagaaccactgtaaaaagtagagattcacgtgggctagccagctaaagtgggagccggtgaggttgagggtgggcggaggtagtcagtagcagagacaggaaacgaataggaactgggcctctcaaggaagggaaaccagatctgaggacctctgcagctgcagttgatgagtcttcaccctgatgctgcctctcccatgcatgactcagtcaacttctagggcagtgattctctcctgggcaattttgcctcccaggggaatttggcaatgtctggagacactttttattgtcatgactggggagttgctactggcatctggtgagtagactccatggatgctgctaggcaccctacagtacacaggacagcccctatgacaaaatattatccagtccaaaatgtccacagtgctgaggctgaggaagcctcttctagagattgtcctcccaagctgctcgtctctttttccttcaccaactaaggctttaccttgtacctaagaaattcaattggcttttttgaaccttatatgggttcatacatgggcctcagagagtccacaaacttgcacaattctgttattgtgtatgtatttattctgcctgttggggaagggagctttcatcaaattctcaaaggttgtattctatgttcattctgcgtatgatttccctacctcacattttctgctcattcatcacttctctttgccacactgccgtttttctacttcataacttctcagctgcttctcacattgctgctttcttatcgtggccatatttcccagttcgaattccgaaggtaaggaatctgattatcctgctctcccctattcggacaaagcttttcccaccagacaacctcataggcccctggccttcccacaccacagctgccctgggttctggtcaggtcccccatgggatgaggaaggccagtagggagtcaatgtcacccagaacaaaacatggctgcccaaggcaggctccctcaggacgggcactggctgaggcaggcatcgtgattgccgcgtctaacaaagatggtcagaaaaccccggggttaggttctggctagagaagccacaaagcacctggaaagacaggaagatactggagtcagtctgaaactccagggtgtggcaaacacgtgcagaccctcagaagcctaagaggaggttttgcagaaccacgaggaaaaaataactcagggacgagaaataagggtcaggactcaaagcagtggacataatcaggacagaacaggccgaagtgcagacacaaaacagatcaataaaacccaacagctcagcaaaggtgaggcagctgtgtctccctctggctgccttttctcccctcctctctcaccagaagccaacgcgtacacgctgagtggagaggccgcgaggacaagacagtgggacatgcgtgtgctggggaagtcgagaagcaggacaggaggcaggtctgagagatctggtttgtgtcttgtgccctggttctctctgcattccttctctgtctctttttcccttcctcatgccttttccttagctgatttccctaggacagaattattttctttttcggactgaatggtaaagaagtatttgtttcctaagtcttcatttcaaaagcaacaggatagaactctctaagaaaaaaaaaaaacacaaatctctaaatgacattaaattacatttttatttatgtagccttgaatggattgttctactttcagtcagtagatttaaaaggggaaaaaaaacatgttcctcagtccaatgttatagatggcttagatgactgggctgcgttacaccagcaccaggaaatatctagagcagtggttctcaaactttgctccacattagaattttaaccctcaggcggcaccccacgccattaaatcagaacatctagggatgggagccaaacagccgtagtttttaaagtttctcagatgattccaatgtgcatcactggggactcactgtctaggaggtgattttaataaagccctgatccttgcttgctttcttgccactttacttttccaccagtagaatgtaacaaaagacaccttttatttttcagttaattaaattaaatcccagttcattgaggttgtgctctaatttcatgccagaaggcaaccagccgggtagttgcttacttcagtcaaaacaacagaccagcattttggcatcgtgtagtcaagcaatgtttttatccactgatgagtggttgttagtttaatcttcaactttgtaacttggtgtttaaatttatccaaacacaactttggaccctggagatatccggacttatttactgcccaccaaccccctcccccactccccgcccttattcaccagagtgaccagaaagcaatatgatcttcacagcgccagatcttgctgtgataatccaaggaaagaggagccatcaagccactcaagcaacatctcagctgctcagtaaatctttcaagagctcacccaagtcccaatctcagcttcctgatttcttttcctctttatatgtgaagggttttgttgtttgttgtttattttttttattttcataggtttttggggaacagatggtgtttggttacctaagttctttagtggtgatttgtgagattttggtgcacccatcacccgagcagtatacattaaacccaatttgtagtcttttatccctcacccccttcccaacctttccccaagtccccagagtccattgtatcattcttatgcctttgcatcctcatcgtttagctcccacttatgagtgagagcatacaatgtttggttttccatttgttgttcattttttaataaacatggttgaaaagactaggctatagtaggtcagtagggcctgtttctgagtgtggtctgttttgccagcacattctcatgaccacttggcaaaaatgagactgtgacatttttttgctcccaacagatgtatttttggtagcccacaggttcttcatttgtttgtttacagtctttaaggagagaaaacatgctgtgaggaagggatcagattgaaaactgcttaatctgatgggaaaagcctgaaacacaacttattgatggtcttcaaaactatgacaggttagaaggaagaacattcaagctagttggtctctatttccatggaggaagtgagcttaaagtgcagttaattgggagtatagtgagccagagacaataactttggaattaaataacaaatttggctgctaagaaagtctatggcatctccattcctaaagaatcagtttgctgtggaatgggagtcagaaatgggtgggttacaattctgctttggtctctgactcaccaggtgttacatggcttttcagggcctgtgttagtcaacattccccagagaagcagaaccaatgggatatatataggtatacatgagaggagatttattatggaaattggctcacacgattatggaggcaagaagtcctattatgtgccgtctgcaagctggagccccaggaaagccagtggtgtaattcagtcttattctgaaggcctgagaaccaggagatctgatagtgtagctcccactccacggccaaagcctgagaacaagagagaggcctggtataagtctgagagtctaaagccctaagaaccaggggtctgaagtccaagggcaggaatagagggatgtcccagctcaaggaaggaaaattttcaccccttccatgtttttgttctattcaggcccacagtagattagataaagcccacccacattggtgagggtggacattctttactcagtctatggattcaataccaagtgtactgggtgtttctcccagaagcaccctcagagacacatcagaaataatattttatcagctatctgggcatcccttaacccagtcaagttgacacaaaattagccatcacagggtgtcagcatcctcatctatcaaatgagaagttgagctggataatccccaaagtccctcattgcatacgaatgtcctatgatatttaacaataggacatgtagccttctgccttgagaaatttaggtactaacagaaattgtttccctgaggtcccttcaacttcaacaatttagagtaattcaccaatgtgtttcctattttgaataggactaatgtgtttcctattttgaattgcaaaaaatataaacatatccatatttgataccaagaaattagtaattctgttggatgtgaaaagaacacgggttacataagaatatggtcataattgctagagatatatactgaaataggtaggagtaaaataacatgatgtctgggatttttttaaataaaataatatatatccagatttcacaagatttcctttgggctggaaaggtttctgaatatagtgcctgtgttctagaaagaggggtcaggagcctagagtatgcagatgttgatggtattgagtgttctgtacacagaaccaagagactagagactttagagaccacaaaatgcttttcctaaagacctagaacatgaaggtttaatttatttccctttttctcctccatgtgttttggataggttggtaagtggaaatcaattacccctgaataaaatagaaaccctgagagagataagtgacttttctggggatacatgctaatgacaacatcaaagccagagtgaggattgaagggtgaggtactatgactacctccctctactcctccttcccctcctgctggggaaatgccaaaggtataagtatccttttggcaccatttgtcctccagggtttctgtgtctgtcctgtatctccttattcattcttaaaactctttctagtggtcagagctctcctttaaagaaagaataacaagacatcatagcagtgaactcagagcactatcactggcttttcacaggacatgagcaactttctcactggaggggtcagggatgcttgtatggtaggtgctcctgactgtgataacttcacttgagcctaccctgagaatgaccctgtgtggcagatgcacccaaatatatgttcagagttccaagctaaggaattggaagtggccatcccagagattcattccttatctatgaggaacatctgaaccccagcccgtcccagggaatgtgggccatacaggggatcagcatcctttgtttggggttaaatgaaggttgccaggctgaggttgctagggggagggtgttaagtgaaaatgttttataaactgcatgccttttgccagcgattgtggttcttcttaccagcccactgccactggaccagcagttctcctgtccagcccgccaccactagaccctctcccctgtatgtaaacccccagtaaaaccccagtgtctcattttctagctctggatctcttcttcagcctcttgaacctagtgccatcccctttggagttgatagggattcagcacatcactgctacactagaataaaacatgtgctgtgtccacattaggccaacaaaatcccataccatccaacttttttcactgattaaaaatactattaaattttaaattggttcatataagaagttgcagaaaaggtgtttgtaggcaaatccagctgactcacatataaatcatctgtattagtttattagggctgacataacaaagcaccacaactagatggcttacaacaacaaaaatgtattttccgacacttctagaggcaacaagtgtggaatcaaggtttcagcagggccatgctccctctgagatgctgggtggagtcctcccttgcctcaccctagcctcttgtggtggcagcactccttggcattccttggcttgtagctgcatcactccgatctctgccgctgttttccaaggtgtcctccccgtgtgtctcttctctgtcttataaaaacatccgtcctattggattaagggcccaccccactccattattacttcatcttaaccaattacatttgcaaggaccctatttccaaatgaggtcacattctaaggtactggaggacttcagcgtctctttcgggaggatgcaattcaacccataacaccatccaaacaaatgacattatgagaaggtttccatttttgtcctctgttgtggttagattcctgattttacataatttagagctaaaaatttacttcctgtctgaaaagtgatttttgacaaggattgagatcacaactcgagttctgtggccattgcttgccctttcagaatcacttgtcccatcctgtgtgccatgttccaaagaagccaggtgagcagatgctggcgacacagggatgacagcatagactacagctttaagtgaaagggactcatgactcaaccctgtagcttgcccttgctatggttgccccacccctcccaactccttattcctcctgctttgctgaaaccacagctgccttgaatcgagccattttgattctgccgcaaatgagctgtaaaccaaatcaagccacatcaaacaaatccaaccaccatcaaaagcaagttagtcaatttttgttttctttgcaatggggaggggtcataaaagccttgtatatcccagggcaaatattaatctgtctgaagagtcagcttgccaacgggtaatcagcaaacaggttggtgctcatgagagctgcacagactggtagttgaggatattcggtgccaggagcaaaccccagcaggcacccttggtaaatctggcaggctctgtgacttcaccctctgcattcggaagcaagcattcaaactttgacaggcttgcgacatgcccagggtaagtcacctggcttcttggattctggacagatatccttgtgccacaagctcacttctctttctctgcttcaggactaggtccttcaaggggatagcagagaaagcatgtttgcagaatccatgccttgtgcccactcccaccctactgcttggcacttttagggaaagtgggaaggagtaaagttactctgtcactggcagaggagggacagtaaagggaagaagaaaatgggagaaatgagaaataggtacccaatgagtaaaaaaaaaaaaattgattacagtgcttaaaacctatcactacagtggtgatgtttctgaatgatagagagggtggatttggcaaagcttctggaatcttttcagacttgaggtccacctcctgtcttgagaccagttaagtttcaaccccacatttgctgtggttgatcccttgacctttgtgtaaatcctcccaactttgttaggccagaggaatgtggagtaagggttctgagttgtacagttccacagtgactcatctggccaataccttaaggatgcaggaaatctgagcagagaacaagactccctcaatatttagaaactggattgagatttcaatccaaaggatacaatttgcccatcaccttagttgcttgtacagtaaattgagcacgtcaataacactaagagaactttttctcttgatgcctaaatgccaatcacaatttttcttagttctctcaattggcatcctggttcctgtctcactcctactgtagtgcacacttacagaaatgaaagctgcctacataaccaccaccagcatccagaaaggagagaatttgacaccatctctttttatctccaccagtttctgctttttagtcattaacaaatggctctggttccctttgcagtgaagacccacagaggcagaagtccctgctctgagtcagttcagctctgattttgaacactgactgggtgctcagcagtaagggttgaaaggaaaaagagggaatacggggaaggaggcagagatggagacagatttacaggtcttgcctgagagttgtgcttgataagcagagagccaattatctctgcaactccaccttcccagcagtcaaatacttgatgggcaggttaaaaagtgaggaggtgaggacaagattaattatcaagtctcagaggaggtgaatgaaatgccttcttgttcattgctatttattcaaaaagagctgctgaacatgaaagaatattatcatttttgcaaataattagaggaaataataggcttgtattttttaagcagctttattgtgatatactttatgttccacaaagttcacttgtttaaagtacagccagccctttgtattcgcaagttttacatccatgaattcaaccaatcaaggataaaacatattctgaaaaaaaatgataatacaataaaaataatacaaaatgtaaaacaatatagtgtaacaaatattcacttgctatttacatagtattcgcattgtattcagtattataagtaacctagagatgatttaaagtatatgggaggatgtgaataggtcttatgtaaatactacaacgtcttgtatcaaagacttgcgcatctgtggatctggtattctagtattcattagatccacagatgcgcaagtccttgatagaagatgctatagtatttgcatataaccaatttgtatgtggaaccaatcccccatgaatactgagggacaactgtatacaattcaatggattttagtatacagatgctcctcaacttacagtggggttagatcccaacaaactcattgcaagttgaaagttaaaaatattgtttaagtcaaaaggatgttttcaacttatgatattttcagcgtatagtttatctggacctaacctcatcaagaagcaggttgaatgcctatctcttttgcaccctcataaagtcaaggaatcatggaactatagtaagttggagaccatctgtatttacagttgtgcaaccatcactataatctaattttagaacatttcgtcaccccaagaagtacatgacagcaatcactctccactcctttttcttcctgatccccagcccctggcaaccactcatccaccttctgtttccatagattagctttctagacatttcacgtaaatggaatcatgctatctggggtctttcgtgcctggcttctttcacttacgatattgttttctgaggtttattcgtgttgtagcatgtatcagtgcttcctttttttctatggctgaataaaattccactgtagggttataccacatttgtatatccattcatcagttgatggacaacacactagtattttaactaaagagcaaagtgccatgatctctttaatctgaattgtacacctttttagctgtacatgagttactatgacagtttctgatcttaatatcttagatttaagcgtatttagtattgataataaaaatgacttctgtttaagtttgtggagagttggggtttgcaggatgatgtaatggtgatagcacaataatgtcatgatatttacatctgtgtttttcaactatcttaatagagtgggtctgtatttaagactccattcctcccttctaataaaataacatttgaatgactggagttttcttaatggcatgcacatggaacactgcacctgcagttgtgtgttcagctgacaagttcacagctgagtgtgaagccaagctacagcaggtcttccaggggtctacttgccacgtggtcctgtctgttggcatcagatttgcccttcacagcttctggcttaagtatgaatgagaaggcatgaaaaagaggagggactgggagcaaggagttctgcaggtcttagaatcctccctgggatacatatttaggcagttcttactccaggtggcaaaaccctgcacagccattcttcttacatgaggagtagaggccgactgaaggctctacgatcctggcatggccatctcctatctttgggacattgagccagtatttagcccatctctttctcatcagcaagtgaagataataatggttcttatttcctagagatgttttgaggattcccataattcctggcacgtaccagatgtccaatcaatgttagctgttaataatcattagcatatattaattacttgctatttcctagatactgtgtacattcacaatcatccaaaaaggtagcaaaaggtagcaatagatatttccactttacaggtgaagaaataagactcaaggaacttacatgccttgctcaaggtcacaagactagatagtggcacaagtcgtatttagatcccttttggtccgattcagaatcctatacacatccagtgaaccatgctgcctatatgtaatgaatcgggtgggccaatattcacacacagtaacacaaagaaaaaaaatcctccaattttttaaaattaaaatgaatgattgatgcaattggactactttggaaaataatgtcaccaaaaccgatgagggggaaataaaagtgagaacctgggatgaagcaattgggacaaatttgggccttaaagaatctcaaagcacattatttgctcaatgctataatcttcccagctctggggagccagatcccctggcttatggagaccaaaagaaactacacatggcactctcgggctaaaaaacagtacatggactcatttccatcagctagagatgagtctatttgcccatgctaatatttcagttctcaacttaatagcttaagatgttcccattatcaacatcacttacctacccacagcacttttaaattagccttgggaaaaatgagtaaacagaagcacagtttatcattctgccaagtgcagctacccctgaagaaggcagctttggatagcaaaacagacaactagattgaaaaacagaagtgtcagccttgacacatgctactaatttgctgcttcgtaagggtcatttgctgtgttgcccaagagtgagggagaaaacagttcaaaggtcaaggacaaatggcatttagatgttccccaaccaggctgacataattggaaaactaaaacccatcgcctgctaacattcccctctcaacagtcttcctgattatgcagtgtaaaataggaacaattttggctactgatcttaaataatcctaagccctggatactaagaccaggaaatatgtattctcttatacttttagatgttctcaattgaaattaacatgaacatagcaattttccactttaattaaaagagtgtgttctttttccactcatggtattagtggcttcaaatgcttaaagaacctttacagaaaaccccttatggggattaagagatcaggacaaagataacattttaagaatgttcttaatattgcaatgaattgggaattattttttaaaccatttcctttagaagtctaaacagtgtcttttcatcactcggaggtattttttaatcactagttcccagttcactttaaattattagtgtagccctagcttgtaaatgcccctcaccatcagggaaagatggatttacactcatgacctctgaactaaactaagcagaaagtcatttcgttcaggtccactgctggtggccacctcatccccatgtccaacccatcattgtcccaatcaagatgatcgttggccaatttctacagactcacattcaggccaaagttactcactggactggaacaaccacctgtgtttcagtgatgctgatttggtcctctcatgcttgtaaaatccagctctaaactttactgttgcttgctggtcaatcaaggagacttggactttgcttctttttaaattatcagtagtgttatttatttacctccaaaaggattctaagtaacccactctagatatagatctgctaataaccagtactgtggccttggcaggttataacaataataaaacttctaacttttcagagtgtttcactgttacaaagcacttccatacaccttctcttgttaaagttattaccctcagagaacaccaattgactgatacacttctgataaagatagcagatgaaaaacattttggaaaataagggctctggacaaattcaaaggtaaccctgttaatctattgactggtgggcctagaatttcagggtgttgatccaactctaacttcaattctggctcccagagaagtctgccatcatggttatttgtcaagaacgagaggtcagaaatgccaaaaataggagttagggtgagtattctgtcaaaaattcgtacaaggaacttcttttataaaataaataaattaaggaatttggcctggatgtcagtgcctgcaaaagggacttcaatattccccagtagattactataaggatatctaaactctggactaggggttatagactacagataaaactgtaagcctcctgcctcctacagtcatagcatttcggagttgaaagtcccttttctggtcttgtagccctgatccaagttgctaacccctctaggattttacgttgtctcagcataagcatgcaccatgaggaggagctcacctcctaccagagtggcccatttcatccttggccgtagcaatctattgactggtgggccttaaaattaaaaagctactttgccttgtaatatgacccatttgttttagctctgcccagccatgggcaatcggaatgtccggtaaagaactcctctaccattttactgaacccaaatttgccttaatgtaatttccaccagttggaaggtctctcttcttgtgcctttggatacatttttttgatgactatagcagccctgaatgatttcagagacagagcacaaagctcctgagagctagtacattgtccttcccagtcttaacttctccttgtcttctatatcatctatatctttcccttttcctctgacatcttcccccagctctgttataattctttcagaaattaaacacaaattcctacatggaaggcagaggaattcagtgaaaagagcagaggaacttggtccaatccctgacaagtttccacgtttaaagcctcataaatactatgatttccctgatgggggtgggagggtagaatgacagactataagtgagtatttattataagcgtcaatgtactataaagctactgaatactttaacagtaaattctaaaagacctcaagcagcttagctccttgttttacatcagaacacattaaagagagaagcagcctgacttttccaaggaccacgggaccagttagagttagaaacagaacttagattttctgactcaaaatcccttgctccctccactgtctctctgttaaacaatgaaatcaataacatcatccaggcaaaggccctagaatagcacccaacatgtattaggtgcccaattattataggctgaataaatatgtgagtggacaaatcagtacatgaataactaggactcattttcaatgatgacattatacaagttccctccaaatgtcacttatgtttttagtcattctttaattagctccctattaagaagcttggttctcaaagtgtacttatgaagattaaatgaaataaagcattaaagtgtttagaaacaatgtctggcagccaataaatgttaactaattgctgtctttctgttttttagccatttttaaaagtaagattatgctgatgctgtcaggagtctctactctgaaaatcactttacaatccactaacgaaaggaattctggaattgcaaaaggattactactatttgtcaattcctatccttcacctgtaactaggccacccacacctaccccttgtagttggcacccatcaagacacaaacaaaatattggattctttcgcttcctcatctgggcttgtgtttactccacccctgacctttgggcactgtctcccattcccagtcaacacttgccaattggacctgacagttgacttgactttaccctatttatcttgctccctctgtctccatctcaatctcaatcaagattttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaacaaacctgcacaccctgagcatgtaccccaggacttaaaagttgaagaaaaaaaaacaagaaagaacttcagtaaattcatcaattaggtttatacctgtggttctggtgtggacaagaagtatttattatctttttaatctccatgtcttgctaaattcatcaattaggatgatatctgtgattctagtgtgacaagaaatatttattgtctttttaatctcctcatgtcttgtgatgaattaccatgtattattttctcatttgttaattgtgtatcaactcccactttattccacccagaatgtaagtttcttcagagcatggacttgacctgtttatatccacagctctatcatcagcacctaaaatactatttggcaaatagtaggcaaccaattgttattggttgaatactgagtgaatgaaagaataaatgaatgacccagaagcagaatggaattgtggttggagcacagcctttggcatcaaagagatctcggttcaagttttggatatgcaacttcttagctatgagtcttctctgaatttcagtttcttcatcaataaagtaggggtaataatagtgcctacctcatagattttggggagcattaaataagataatgcctgtaaggttcttagcatgatagctggcatattttaagaacttagtaaatgttgtgtattattttcggtgaaagtcctcaaatgttgaagcttatcagaggtaattgaattatttaatatggctggtagtgatgattgtactaaagacaaattagtacaattagtctgtcagcaagatttgatttaaagagtcaggctgacaaaaaaaatgtattggtcacacccaccatatttaaagcactatactaggctttcaggagggggtgggatgcaaggatggatatgacacagccccttccctctaggaacgtagaactgagaagatttactatgtgtgcactgtaccatgctgaagatacagaaatgtgaggcagtgttacctcccacatcatccaacttactctccatgctctgcagaaaattcttctaaaacactcagcctttgctttgaacccctataatgacaagaaactcactgacttatgaaacagatgattctctttgggaacagtagtcaccactagaatgatcttaaaattagcacaaatctacccccccatggtttttacacattgatcaaacttctgccttctgggcacctctagaataaattcattttgcactcttctatcagaggtcagcaaagtaatgcctgcaggccagatccagcctgtttatttatataaataaagttttattggaacacagccaagcttattcatgtacatgttgtctacggctgcttttgtactacagtaacagagtacttggaacatttcagcctacaaagctgaaaatatttactatttggctcttgaagaaaaactctctcaacttctgctttatgtgacagaatttggagataaacaacatgctttttcctaaagtgaggagcagggaaatgagcacagtactccaagtgggagctaatgtagaattcacagaactaagtagtactatcacctcccctgttctggatgccatacttcaaataatgtgaccagagatcaggttggtctttgactgacacacaatactcaagtatataaaagatgaaatctgtgagttatttcccccaggagcttctattaaattatgtctccccaccccataatggtatatcctcatgttgggaccccaccccataatggtatatcctcatgttaggaagtatatacaaaattttacacctttcttgcttgtccagagcaatcaggcacaatttagcacatattcaagggccatcttagggtcagacagaaaaaggatggcacgcgcagctaggattttgaagagaatgtagagactctttacatgcccaggggtagggttagaagaacaagggaatttgtcacccccctatctgcataaagaagagtggagagggaagaattttgccagggcccagtgatagctggagtcatgactgcttaactagtcttgtggtaaaagatacacaaccacggctagcaccactctctgaggcagtcagggagggagggaaatcgataccctgatatgcccatctccatgctctacccactgtgggtagaaccctacttgaagctggagggcacaggagtcagactcacagggcacagagcaggtaaagaatagacgtgggagccagggcagaggatgacaagggctaagtggtaagccaagcatttcctaaatgctgaatgaatagtagatgaatggaccaagtgggcccagggcctgtcactcaataagtgtttgttgaactgcagaagccatccctttatgcccgcctgccccgaagccctcactgctgctatctgctgttccagatgtcccacccccagcacagcccttgtcctggttctccactccctcgctgacccctcagtgtttctgccaagagtgtaaaaacagtctggatcttattttggagatgacagaacggagcaggatttgctctgaacagaacaggacaactctaatcaaagagagaactttaagttctaaaataattcttagaatctaaaatttttttaaacagaaaatttggtgtcactgcaccctatggagaaaaatgagtggctcctaagaaacgtgccccagacatctgtgtcagaggctctggatccaacagaccccttattatcaaatgccttggggctggctgtcttatgctcagatggcccttgtcacatggtagcctctgattgtaaagacttccaggctcttgattgatcgtgccaacagcagcaatgttgagaaagtggtgtgtgtgtgtgtgtgtgtgtgtgtgtgagagagagagagagaggttgtcaatggcatgagggtgctagtggccaaccacagcttcctgccagtcacctcctcctctgtccattgagtcagcatggaggatattcagcactggcttcctcaaggaataatcctgaagattctggattttgaagacttagaaaaagcattattttgtctgctactctggttagattatttgcctttgcttggaatgggcaagacaaaactggacattaaattatgaattgctgttcatatatatcgaagcccattttaaaaagtagctgtaggttgggcatggtggttcacacctataatcccagcactttgggagtacgaggcaggcagatcattgacgccaggagtttgagaccagcctggccaacatggcaaaaccccatctctactaaaaatacaaaaacttcgccaggtgtaatgacatgtgcctgtagtcccagctacttggggcagggggcgggtgaaatgggagaatcacctgagcctggggaggttgaagttgcagtgagctgtgattgcgccgttgcactccagcctgggagacacagtaagaccctgtcaaaaaaaaaaaagatccatacctctaacagttgtcccttcatgcctccgagactcaggctagtcagtccccagagtctgaaagttcttatacaaaacccagaattccagttcatctataactatgtcagaatttgttaagaaatttcattaaagtctccaggaccaaattttatgaaatctaatcccaactaggataactggcaaaatttgagtaagctctatagattaggtaataatactgtgtcgatgttaattttcctacgttaattattgtactacatttatgtaggagaattgtccttgttcttaggaaaacacactgaaatatttaggggtaaacatgcatcatgactgtgactagttcacaaataattaggaagtaacttttatatacagagaagaaagattataaatcagatgtggtaaaatagtaacaattgaggtatgtgggtcgagggtatatgagattttttttttttttttactattttataacttttctgtaagattaaaattacttcaaaataaagctgccaaaaaacaaattccagaacactagagctgtctcatgcctatcactgaggggccaatgttcagccatgctacgtactgcagagtgagccagaaatggaatctcccgttttgtcatcttggagctaaaatgaatcatttcctctttcagctaaagaactctcctattcatggaggcgaacactgaggatgctttccacatgaaccctgaaggtaagggggacttgttctcatgcccctcggtcacaccacccatctgccccactgtccgtttcatccagggcaggggctcaactatcttggtttacagaatatcatctcaaaccagtcaatgtctacactggcacattctgctgtcttcaaaggctgtttcagtctccccagcctgtccagctcagaaaaactgatgttcatccttttctgtttttctcaaagaaaataccaaagcttttaatagctgatatctcctagtggtgcaatcatgagagatttttattttctccttgtagttttctgtaattgagagattatcgacaatgactatgttacttctataatcagagagagaaatattgtgcttgcttttattttcttaagcaactctacataaattcttgccacaactttctgggccccgtaatgttactgctgtgtctccttcctcccagccctcatggcaggactcatgtgtgacaggctctgggtcttctctcatctgccagtggcaaggaaaccctaggctgccaggactgcttagcaaatagatcatgaagtattacgactccattttacagatggagaaaccaagccccctgacttccctctgtctacactacaggcaaatgggatctggacccactgagatgagctcgacatgtacgactttgaggctgtactctctcattcagaggaagttaaggagccaggaagataggaaaacaatgaagttattggttgaagaaaatcctagacaaaattttcctgggacttcttggggccatctagggaaacttactagtcttcccacattgaaacatgatagccccttgagagccatcatgccgctttggtgtcaagttctgagcctgaacttgccctctgggccagggtttctcaaacaacagtgtaggcattctgggtcggatcgttttgggtggtggggctcctctgtgcatcatttgatgctcagcagcattcctggtgtctcccactaaataccagaaggacaccaccccaccccagctctaacaaccaatgacatctccagacagttccaaggaggacaaaactccccccaacagaagtaacaataaaataatgtttccaggctttgccaaatgtcttccaggtggggacaaaattatcctaccaaaaaccactgctttaagttgcctcagcccagcagaagcttttgtttttcatggaaatcgactgaaatttatagtgttcacaataacattagcaaatacttgcagaagaagtgtcatcagtcatcaaaacgctctgggtacaagagtgccccacagcataatagccctgcccaggagcatctggtaacattggaagtggtgaatcgacccattcagacttctctgtgctttctcccgtcttggcttctaccccttcatgccaaatgcctcatgctatttactggaaggaaaggcaaatgaaggagaacagggcaatgctgagtactgagtggacctttcctttaagagtttgaagaggtcagaaagcacccagtagtcagagctgtgttgcaaagctcccggaaaatttggccgctactttgtatttgtgtgtgtattcattattcatagacatgtattcatagacaacattattgctcaaaagatttgagacatattctccacttcactttatataattttaactttttacagcaaacaggtcaccactctaaagagtggcttaaccagaaatccttttttaaaaaaaattaaccaaatagtataaagtagataaggtggcagtagcagatttatctgtggtaccaattggcaaaccaaggccctaaaaggaaattccaaagccctagggtttgtacacacacttcctattcatctttaagtgcacctcatggaccttttattcctctgattgatcttccctgacccctgcacccagcctccatcatcctccaccctttcccaacctggtgtttggattacaaagatacttctgattccagtggctatctgtgaaatcacaggcaggaacttgaaagcagttgcatggtcatccaagagaaacagaaacacagctcagtttcagggtgaaaagaacatccagaaagcaatattcatagaagaattcagagggggggaccctccttaaaagaggggattaaaagttaagagtaaaattgcaattcctgtccaagacttgacccaaagtgccgcagtccattttgcagccttttatatgatgtctggtctctctaacttaattgttaactttccagtcctgtcccagtggtaatcatcactccctaacaatcactccctcgtgccccatacccacccagggtggaacaaactgtctttgcctggcataccagattcttttgcaagagccctggcatccttcaggctctgcccattccaaccctcccacctccagccctttcccaggcccccatccgcacacttctgcccttaactctctccagactgcaagaagccaagaggagattagaagcagcccagggtcctcgggaggatgtgtccacccataggctgtgttttgaagttcatttaaagctctatacttataatatttttccccaccacttacctgttagagtttctcaaattcctatcatttgagtttctgctttgactaaattgtggcattactcaaaacctacacatgtacctaagggagaaaggccttaatttatagacagcaatttgtttatgagattgtcttgctggtgcttctctaagaagagagccttgggattgggacacaggacaaattaattttgattgcagtggagagactgaaacgattgggatattgagctctagacctgtactgtctgatacagtagctacttgtagcaatttaaatataaataaattgaaattaaatgatattaaaaatttcatgcctcagtcacattgagtacatttcaaatgtttgccagcctcatgtggcttgtggctaccaccactggacaaaggaaatccattggacatttctatcgtgattgaaagttctactgaataccatgtcttgagactgaggctggtacttccagcagagagttctggaaaagaggtgcagcccaacatcaccagctctgtgggcagggatagagaagagtagaaggaaccgaattccaaaagggaagggagccaaagctcaggcccagccctgagcaaacatgcatctgccgcacccaaactctttatgttaacaaatggaaagagaggagccactggggtcggctttgtagcccatttcctccattggatggcctctgagttctgtgggcttctgatgaagcaaaagaccccatcctgaatcctgaggcaagagggactcagagtttcactcacatacgggagccactgggctcccacacaaagggaaatctccaccctagtgacacaaggagccaggcagtctcccggagcccacttagagcaatgagtttccaagtcaaaagacatttcaaggaagaggagcatcttgtccatctgaaattaggcctccactcagaaaaatctgaggagcctggagggttccaaggagcaattgtaaccccaactgatgatggtggagcatttatcaagccttgccaatgacagtggttcacgcttcaatagcactttgcagccatgtggcatgcttgaacaaaaatatcatttatttcatcctcacaacagttgactgaggaaagcagggcacatgtgaccctctcgacactttacattaaaagatactcatgctcagaaagaggaaaagacatgccaaattcaatgtggctgatgaatgacaggaccagctctagaaaacaaccacctattctgtctctctcaagcgatggggttacttggtacctgtccaagtccctaaatgtgtcagctccaaagtgtgtgcctacccatggatcatgctgcaaagtcagttcacatccaactccaagctgacaaccgagcccttgaagacttctgctaggcctcaatgtcaagaacattcctaaaccaatcacaggcaaaaggcaagtgagatcaccatggttagcttagactgatacctcctcatcccctggggctagatgcctgatacctaacaaaactagatacctaacaaaaatgaaggcagaagtgggtgttggagaagcaaccagcagtgtctgccagacccagctatactcagggctatgataaagaagaggggctttctactcctccttctcccgaagcagcctccccaggcaacccctcctggcctcctaggccaggtcaaatctgcccgctatgggttctcatggtacctgcaggggtcctccttagcacttgcatcactcgtacattgaactgttttagtagctccatctcttcaggagactggaagtactaggaggtttgtttcaagccagacacttgtattcttagaccctacccctgcatcacagatgctcagttgatattcgttgaaggattaacagatgggtggctggtagattgatgaatggatggatggatggactggatggatagataaactggatgggtggatagataggctggttggactggactggactggactggactggactggactggactggactggacgccataccagtgggtgggtggatggatggatggatggatggatggatggatggatggatggatggatggatcgactggataaatgcgtgggtagcttgatagatggatggaaaggtgggtgcgtggcttaatggatggatgatgcatagactgggtgcgtgatggatgatgatgatcattatgggtgggtgataatgatggtgtgtggtccaccactnnnnnnnnnnnnnnnnnnnntgggcgggttgatggattgatggaaagatgggtgggtaggttgatggatggatgggtgggtggatgcatgttccagccactacataggtcaactgtacattttctcaaaatgcattgtaaagagctggatcgtggtttccctccctcttccccacaagttgctctgggagtatgaattgccccactcccagaccagcctcgctaagggccctgactattaatactctggttggacagatgacttttctgcaaagaaagggctcctgagggaagctgaataaaatggggaaaaaaagaatgaatataagccagtaagagagacaagcaattatcttgctagataaatagcccagatgttttgaatgaagcaagtctgaaagaccatattgttcatgagaggtgactaaatcaggtagacacaggctgtattggtacaagatggaccaaagtcatgagggagagagggactttgggactggtagtaatgtcaggaggtggtagggatgctcaaacccctggcaataggcaaagaagtggagttttcaccttgagcccagtgctttccctcccctagcccacctgcctttgaatttccacatcctcctgctttctcctctttctctaccctctttcccggtttaccactctttcaatttccggttcctcttgctttgcatgacaaggactagcagaagccccggggccagagtaaaacaagcacccagcttctcagagagagccctactgaatttattaaacgcctttttaataagatgacccagcccttctttgaggctctgaaaaatgagtttttcaatgaaattgccttttacccacttatcagaagtttaacaaaaaataatggccagccttaggtatttcaaataaccctaagacagacacagtgatggaattcagagaagtaggggaaaacaagtgggcaagccatgagtatcaaaagcattttaaatcattcaacacaggctaagaagcagggcacaggctcagccattcaccctgattaacacagggaggtcggctgtcagcaactgctgaaaattttgccacaaacatacaagtaatttctatcttctaacctagaggggagcttttccatgtatttgcaccactgaatgccaggttttcatttgggagttgttttgtggtgttaaaattttttgttgggattttcctcctcgattacgatagtaatagctttttattttattacaaaagtaatcacattttattttagaatcatcctcccagaaacaactactcccaatatatatttccagtctttcttctgtgcacatatagagatatgtatattagattgggatcaaaaacatctactttctgtattcaatttcttttttactttttccatgtttctatatcattggtttatcacattactttaaaggttaaataatatttcattatatgactgtaacacgatctaggtaaacaatcccttatggtttgatatttagatctcttccccatgattctgtttttataaataccaaaatgaaagcagaatattggattctagaagtaggagggtagggttctctttgtacagaattgtttttgtttctgttcatttgggataaatttctagaagcctattttgtgattcaaagtgtatctacattcttacggcttttaaaatatattaccctaaaaggatacaccaatttatattcaaaagataaaacatctgtcccacctctaccatctagcagccagaagtgtttacaaactcagtgttaccatccagaaatctcacggggttgggaagagaattaaataaaatattttatatgaaaatactttgaaaactaaaattgtattaaaatatatgttgccattattatcaatttttaaaccatccaagatggaaaaggcattacctccctcaatcacatattccaatgattaacagctctttagagcataaaattcttaccagttgccctctaaatacaactacaccacatatatttcatttattcagaaccatttattgaataccttctatgtttccagttttgcattaagcatgggagatatgaaagaaacacacacacacagcaatgagctactagcctgggatggggtgggggtacagagaaagataggtcaagattcattatcagtgccacggtaaggtcaggttctgggtgttttgtagacagggcatgatccagctttggagaacccagggatgtccatgcctgaaagagggtaatctgaaagttagcatgagaagcagcccagctttctgttgggggacaatgtggcaattcctattgtttctgaaacagtatggagaaatcacattttcctggcagctatattcctgcatagaaagacagcaatttttgtgggaaaaagacattaacaggccacatggtgggaaggctaagattccccatggggttgactttgaggaacactagatggttaccatgtctctagaaatgagcctgctcttggtgagtgagatatgcaagctgatgctgattgcaggattgcttgggactatagagagaattttattttattttagaggggattttagagcggtgtgaggaaagatgaaggggcaagatatgacaactgataggggaggaactttgagggcaaatacaaagatgcttaataaggaattttgccaagtgtctgctatgaaatgttctatagagcccctcactcctgtctactcacaatatccttgctcttatttttttttattatactttaagttttagggtacatgtgcacaacatgcaggtttgttacatatgtatacatgtgccatgttggtgtgctgcacccattaacccatcatttacattaggtatatctcctaatgctatcaccccctccccccatccaatgacaggccctggtgtgtgttgttccccaccctgtgtccaactgttctcattgttcaaatcccatctgtgagtgagaacatgcggtgtttggttttctgtccttgtgatagtttgctcagagtgatggtttccagcttcatccatgtccctacaaaggacatgaactcatccatttttatggctgcatagtattccatggtgtatatgtgccacattttcttaatccagtctatcactgatggacatttgggttggctccaagcctttgctattgtgaatagtgccgcaataaacatatgtgtgcatgtgtctttatagcagcatcatttataatcccttgggtatatatgcagtaatgggaggctgggtcaaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgatgttagggtgtcgattttagatctttccctgctttctcttgtgggcatttagtgctataaatttccctctacacactgctttaaatgtgtcccagagattctggtatgtagtgtctttgttctcattggtttcaaagaacatctttctttctgccttcatttacttatttacccagtagtcattcaggagcaggttgttcagtttccatgtagttgtgtggttttgagtgagtttcttaatcctgggttctaatttgattgcactgtggtctgagagacagtttgttataatttctgttcttttacatttgctgaggagagctttacttccaactatgtggtcaattttggaataagtgcgatgtggtgctgagaagaatgtatattctgttgatttggggtggagagttctgtaaatgtctattaggtccacttggtgcagagctgagttcaagttctgaatatccttgttaactttctgtgtcatcgatctgtctaatgttgacaatggggtgttaaagtcccccattattattatgtgggagtataagtctccttgcaggtctctaaggacttgctttatgaatctgggtgctcctgtattgggtgcatgtatatttaggatagtagctcttcttgttgaattgatccctttaccattatgtaatggccttctttgtctcttttgatctttgttggtttcaagtctgttttctcagagagtaggattacaactcctgcttttctttgttttccatttgcttggtagatcttcctccatccctttattttgagcctatgtgtgtctctgcatgagaagtgggtctcctgaatacagcacactgatgggtcttgactctttatccaatttgccagcctgtgtcttttaattggagcatttagcccatttacatttaaggttaatattgttatgtgtgaatttggtcctgtcattatgatgctagctggttattttgcttattagttgatgcagtttcttcctagccttgatggtctttacaatttggcatgtttttgcagtggctggtaccagttgttccttcccatgtttagtgcttccttcaggagctcttgtaaggcaggcctggtggtgacaaaatctctcagcacttgcttgtctgtaaaggattttatttctccttcacttatgaagcttagtttggctggatatgaaattctgggtttaaaattcttttctttaagaatgttgaatattggcccccactctcttctggcttgcagagtttctgccaagagatccactgttagtctgatgggcttccctttgtgggtaacccaacctttctctctggctgcccgtaacattttttccttcatttcaactttggtgaatctgacaattatgtgtcttggagttgctcttctcgaggagtatctttgtggcgttctctgtatttcctgaatttgaatgttggcctgccttgctaggttggggaagtactcctggataatatcctgcagagtgttttccaacttggttccattctccttgttactttcaggtacaccaatcagacatagatttggtcttttcacatagtcccgtatttcttggaggctttgtttctttttactctttttttctctaaacttctcttctcacttcatttcattcatttgatcttcagtcactgataccctttcttccacttgatcaaatcagctactgaagcttgtgcatgcgtcatatagttctcgtgccatggttttcagcttcatcaggtcatttaaggtcttctctatacactgtttattctagttagccattcatctaatctttttcaaggtttttagcttctttgcgatgggtttgaacaccctcctttagctcagagaagtttgttattgccaatcatctgaagcctacttctgtcaactcgtcaacatcattctctgtccatctttgttccattgctggcgaggagctgcattcctttggaggagaagaggcactctgatttttagaattttcagcttttctgctctggtttctccccatctttgtggttttatctacctttggtctttgatgatggtgatgtacagatgcggttttggtgtgaatgtctttctgtttgttagtttttccttctaacagtcaggaccctcagctgcaggtctgttggagtttgctggaggtccactccagaacctgtttgcctgagtatcaccagcagaggctgcagaacagcaaatattgcagaacagcaaatgttgctgcctgagccttcctctggaaacttcgtctcagaggggcacctgcgtgtatgaggtgtcagtcggcccctactgggaagtgtctcctagttaggctactcgggggtcagggacccacttgaggaggcagtctgtctgttctccgatctcaaattccgcggtgggagaaccactactttcttcaaagctgtcagacaggtacatttaagtctgcagaagtttctgctgcctttttttccactatgccctgcccccagtggtggagtatccagagacaggcaggcgtccttgagctcagtgggctccacccagttcgagcttcctggcctctttgtttacctagtcaagcctcagcaatggtggacgccccttccccacccttgctgccaccttgcagttcgatctcagactgctgtgctagcagtgagcgaggctccgtgggcataggaccctccgagtcaggggcaggatataatctcctagtgtgccatttgctaagaccattggaaaagtgcagtattagagttggagtgtcccgattttccaggtactgtctgtcacggcttcccttggctagtaaagggaatttcccgaccccttacacttcccgggtgaggcgatgcacccccctacttccactgacactccgtgggctgcacccactgtccaacaagccccagtgagatgaacccggtacctcagttggaaatgcagaaatcacccgtcttctgcattgctcacgctgggagctgtggactggagctgttcctatttggccgtcttggaacccctatccttgctcttattaatacctcaagtgacatacagttcagtgtgccctacatgtggacggagggtgagagtgaaggctgccatttagaggcagccctgcctggttactcatccttcattctgtaaggagctaagtgctactgtgttctcagaacgtttgtgctaagcagggaacccctcttttgaactgtacgggatataaaagtgaacacaatctactgctctccccatactgacccactagccttacttgggctctgttcgcctgggcacatgcacttacacagctttaaaaaaaaaaggaaaatattataataggatcttttaggcaatcaaagacattcaaaaacacattcagatgtttgtcaggccttctgcttaggcacacccatgaaagcatcccaagccatttatattttgacttgcaaataaactggcaattgctataattgagagcattggcaaagcatcaaacttcccttccaaattctattgttcttatggtaatattaatttctgtctcccaaactgagtgtagaggcatggatatgtgacaataggatgttttctaggccaaggatgaaaaaccatcatgggtaaactactaagaagagtgtttacacagataaaaagaaattgactaacattttgagttttgacttcccaatctctttttttaaacattaatgatttcagagaggaatgtttggaagacacatcattgattatatgctgtacaaagtgatgctctttttattgtaaagcagtgagtcaatgaagatttactgggatctgccaagccaatattctagtggccaaatgtgcagacatttgcagaagcccactctacttccattggcccaggaagcctagcaaccaacggggagttagctgtaccctttgctgatatgcactagtggtatggaggacttattaagaaaaagagagagccttttataattgacaatagcgcttaccttttaaaatgttaaacatactataccatatttttctaagttcagtagtcttactttgggacacagaaatgcatcactatttaaaactcacctatccagcaaccttaactatctggaacatatatgagatccaggaagcaaggtaaataggtttttgagcaaaatagatataacaaaatctatttacctacaggtttggtaggaaattccttcagtcatcactcagaacctagttattcttatttgaaaccaccttaattttctaaaatttagttattgggttttttaattcacatcagatcagaagcaacaatagagtggaaggggctagaagaaactatcttgagtgatctagaagggagtcagctaacaaaagtgagaactattagctgttaaattgaatgtaaagaaaaagacattaaaaaagaaaaaagccgggcgtggcagctcacgcctgtaatcccagcactttgggaggccgaggcaggtggatcacctgaggtcaggagttcgagaccagcctgaccaatatggtgaaaccccatctctactaaaaacacaaaaattagctgagcatggtagtgtgtgcctgtagtcccagctactcgggaggctaagacaggagaatttcttgaacccgggcattggaggttgcagtgagccaagattgggccactgcactccagcctgggcaacagagcaagactccgtcaaagaaagaaaagaaaagagaggagaggagaggagaggagaggagaggagaggaggggagaggagtggagaggagtggagaggagacgggacgggacgggacgggatgggacaggaaaggaaagaaaagcaaagaaaagaaaaggaaaaagaaagagaaaaagacactaaaaaggaaaggagagaggagagatgggcaaaaggatggagcgagggaaggaggctataaaaagaagactcagaatcttaaaatgctcaagtcctaggcatttgattttggcaacaagccttgatctctaggagcagctgagcacatcctatatccaccatatcacaccataatttttatgttcataaatgaccccagtactccataaaaagtttcaattaggaaatcagagaagcgcctcatttttagaagtgtgcacccaatagattaaaagtttggccgggcgtggtggctcacgtctgtaatcacggcactttgggaggccgaggcgggtagatcacgaggtcaagagatggagaccaccccggccaacagggtgaaaccctgtctctactaaaaaaacaaaaaaattagctgggcatggtggcacgcacctgtaatcccagctactccagagattgaggcaggagaatcatttgaacctgggaggcaaaggttacagaaagccgagattgcgccactgtactccagcctgggtgacagagcaagagtccatctcaaaaatatatatatatataatatataaaacatatatatgttatttataagttatatatatgttttataaggtatatttatgttttatatgtatatatgttatatatatgttttatatatgttttatatttatatatgtatgtttttatatatatatgtgttttcattcctgaaagggtgtgctttagatatttagacatgatgatgccagaaaaatatgttttaattgtgtgcatttatgaaggaaaaggaagaatgggctgagaattattattgccttgctagttgaagatttcacaatggaggttgtcccagttcttgaagtctccacatttccttgatttctgatattgcgatttttattcacttcagctactaacccaaccaccttgcagccacatctcagtgggcttcatcatccatctgcccttgagttcaaattaatgcacacaaagaggttactggaggaatcaagaaggtctcagaacctatcccttaggaatatggagagcctgttgattaatggaaaagagttgcacaactcaaggccaagtgctgtttccgtggatctgtacatgagaatactgcattctatatgactttataaaaatagtcacccaacaggtgttgttgaacacctgtagacatgtttacaggtgacagtgtagggggctgaatatgtagatgaagccaaactgagattgttctggaactttgatgatggtattccagacgggacaatggcagtgggtcaggcgttggaggcttccgtcttaatcactgctcttctacttggttaaatgtagtagttaccatctgcagtaggctgtactggttgtctctggattgtccctagatttgcccaactaaataaagctagccattataacacccagcctcttagctcagagcacaacagccaaaggtttatttctcacccatgtgacagtttgctggtggtcagcatgaactcaagagcctttcatctgttggctgtactgagcttttaggacctcacagtcctcaatttcatcttcttcaggccagtaatggaggagagagaaatagaggggggaatatgtaaaaagctttaaagaccaggactaggctagaagtacagtcatgcatcgcttgacaatggggatactttttgagaaatgcatccttaggttatcttgttgttgcttgaacatcataaagtgtacttacacaaacctagatgggataatctgctgcacacctaggctatatgggatagcctattgctcctaggttacaatcgtatacaacattttactttaccgaatactacatgcaattgtaacacaatggtaagtatttgtgtatctaaacataggaaaggtatagtaaaaacacagcataaaagattttttaaaatggtacacctgtaaagggtacttaccatgaataaagcttgcaggactgggagttgctttgggtgagtcagtgaatgagtggcgactgaatgtgaagccctgggtcattactgtacactactgtggactttatatacactgtacacttaagctacaccaaattttttttaaatttttttcttcagtaataaattaaccttagcttgctgtaacttaactttataaactttcttaaactcattttgactttttttttttttttttttgagacagagtctcgccctgtcgcccaggctgcagtgcaatggctcgctgcaaatctcggctcactgcaaactccgcctcccaggttcaaatgattctcctgccccagcctcccaagtagctgggattacagatgccagccaccaggcccagctaattttttttgtagttttagtagagacggggtttcaccatgttggccaggctagtctcaaactcctgacctcatgatctgcccgcttcagcctcccaaagtgccgggattacaggcgtgaaccaccgtgcctggccttgactattttgtaataatacttggcttaaaacacaaacacattgttcagctgtacagaaacattttccttctttatatgcttatactataaacttttttctatttttaaaagtttttttgttttactttttaaactttttcattaaaaactaagacacaaacattcacattagcctagaactacatagtgtctggatcgtccctattgctgtctttcacctccacatcttgtcccacttgaagttcctcaaggatgatagcatgcacggagctgtcatctcatgacaacaatgccttctggaatacctcctgaaggacctgcctgaggctattttacagttaactttttttaataagtagaaggagtacactgtaaaataacaataaaaagtatagtatagtaaatacacaaaccagtaacatagttattatcaagtatatatactgcacataattgtatgcgctctacttttatacgactagcagtgcagtagatttgtttacaccagtgtcaccacaaacacggcgtaaagcattacgttacgatgttagaatggccctgacatcactaggcaataggaacttttcagccccattgtcatcttataggaccaccaccatatatgcagtctacagtgggcaaagtttgtcattcagtgcgttactgtgtgttatttctacccactttcagaggccaccacttcatcacctgacctcatctaacgacaggggaagcaatgaagtaactttaactgtgtggccagaaaggaaaagaaaaccaaattctgatggacatctgatgtttttactattcctatgaatgtattccaaggttctgagagggtagggaaagcaggaataagagtgggaaaatacatttagcaacattcttgagagttttttcttagacttgtcagtgttctcagttgtgcccatcctcaagctccaaagattctcccacaaggcatttggccaaggcacttcatttttccaggcctcagtttccccatgtgttaaagtgaggggttgaattagaatacctttcaagtctttgggccccttaaagatccaaaatcccatgattctgtaatgattctgtatgattcccctgatgttcccttccccctgagacaaataagcagtgccagtatgccaataatttatgttttattttaattttccttctcaccttcaaagcttgagtttctagatattaatatataacaatagacaaagttgttatgaatacagtagtgacttttatggcaaagtaaagttattttgtgtttggatgaacagcacattcacacacgtatataatatacacagagctccatctgtgaaaaaataatcttgtttgaagtcttgcaaaacttatgtcctcctcctactcttgccctgtattagttttgcaattagtaacaaacaaacaaccgtgacatctctgtggcttagaacaacatttactctccgctcactttacatggggactgtgagtcagcagcagattggctgtggctctgctagaattggctgggttcagctgggctctcagtggggctccacctgtcttctcattttaaaacccaaacgaagggtatagacactatctgtgacatcctaagggcagtggagaacaaaagcaaggagacctaagacaaaccatccagttgcatttaagcttcaggttaaacacggcaaaaaacatcacgaccattcacatcccatgggccatagcttttcacatggccaagtccaaagtgattgaggtgggatatgtactcctctcacagaatgcacgagtacctcccatgacagtgggtaggaatatgcaatcctatggctgggaggaagcaaatagttggggacaataacccaacagatcacacccccaatgcctctatctaagttctaaatacaacatttcccgtagagaggaagccactctgcctcctccactgcatcttcctttcctgcccctctcagcttgagctcaggctccaaaacttgagcgtgataagaatcatctaagtgcttgttaaaaatccccttcctagggcccccctttccaaagatcttgacacatatgatctgaagtaggcagtggtgcccaggcatgatgccccaggaatacctactgctattgaagagctctccccggttcccacagccttcagcatcagacctgcctttggattgggggagcatgctgagtgagccattattaggaagagggctgccttagaggactcagaatctacgaccccaaggtcctctgacctgtccccactcctcacagccagcatggattttgtacttctggagctccttgaaggagggtcattgcacgtttgaaagtgtgatagttagcacagaccccagagatcaaatcctgagttcctcttcctccatatccaactcactagctgtgtgaccttggacaactcactagctgtgtgaccttggacaactcgcagaccgtctctgggcctcagtgtcctcatctgttagaaaggaataataataatacctacacctcaggcttcttgtgagggtgaagcgagttaacaaaacagtgcctggcatgcagtggatcacatataaacatttcatgtgtgatattatacatgtttttatgtatttataagtgtattctatacaagggtttgctgattttattggcacacaggtctgagaacatgggaggcttgtgagataaagttgcctcctattggaggtgttatatggggagcatgctgagtcagctgttatcaggtaggaaggctgccttagaggactcagagaatttacgtgtcaggtgatagcatgtaagtcagtggttttcaaccccagctttaatttagaatcatctagaaaggttttttttaaaatgcccatgtccttccaagtgggctcaattctgagccaattagtgagaatgtccagggacaaaacaaagaaatgaaaaattttaaggccgggcacagtggctcacgcctgtaatcccagcactttgggaggttgaggtgggcagatcacttgagaccaggagttcaagaccagcctggccaacatggtaaagcccgtctctactgaaaatacaaaaattagccaggcgtgatggtgcagatctgtaatctcagctactctggtgactaaggcaggggaatcacttgaacctgggaggcagaggctgcagtgagctgaaatcgtgtcactgcactcctgcctgggtgtcagaacaagattctgtctcaaaaaaaaaaaaagaaagtaaagaaaagaaattttaagacactccttggactgtaatgggaatcctggattagaaaccactgatgtctatagaacagctctgtaaactgcaaaacataatgtatgatttatgggtgttttttgattgttagtaactgattgatgatctcatgagggactagttcctctgaaaatcaggccaacgtgggttttccaccatctgtcctacatgtgcactggctgggggaaattgaaactcatccaattcctattcttgcctttaagccaaaaagactgctcgaaaacaagcctccttgggataaaagatgttgctaggatgaggaagctgtagtgagtgagtggagttaatgtgattagatttggaagcaatacttccagccatggggaagcatcggtgttctgtgttattaaagtgactccagtgcaaaggcacatatatcgtattggagtaatttgccctgactaggttagaagccaggagatggttcttcacaggtattcctgagtggcccaaggtctaagtcagctctcgtttagacaaatcctatctctgctgatcatctacctctcaccaaatgcagccatcaccatgcacagcacatgcgctcctcttgatgatcttcacagagtgcagagtcttcaggaagttctttcctcagtggaacctttgggatttctaggagaggggcaggggaatatctggaatcagaggtgaacactttacagcagcctctaaactacttctaattacgttcacctgactaaactgccaggtgataaacgttttatataaaagtaattcactatggaaagttctggatgttttccccaatgggtacctcaaaacagggtacaagatggaaacctgctcaagaaacagcaaaatgtaaactggataatggtgatgataaaaaaataataatgaatgaccacacgagcaagtgtcctcttgtgaactttcacagacaaatgcatagatatgctgcctggactatgggcagataaacattcattgtgggcacatgtttgtgtgaagctaattattggcagagcaagaacagctggaactttcatctccccacctgcaggccagggttctcttggcactatatcctcagttttcaatgtcttcctgaaagagcggctgccatgttctccttaaaacttctttagattcccctgtcaaatactgaaaactatgctggctgtaagtctagtgtttgaaataccagcgtgggaccagtcttcctatatgcagagttttgtcccatgtcttagaatctttttctgttttcttcaccttttgggcttcatttattcacaatcattgactgttgacattgggcagagcttgtataacagtcttaatctttagcctggtatgtaatatctaatccctgctgttcctcttcccgccctgagcacattatgtcctttactttccagattaagtgttggcattctgtactggaaagaaaactccaacttcttgccatgtgcagtggctcatgcctgtaatcacagacctttgggaggccaaggcgggtaaatttcctgagctcaggagtttgagaccagcctgggcaacatggcaaaaccccatcactgcagaatatacaaaaattagctgggtgttggtggctcgtgcctctagtccccactactcaggaggctgaggtgggagaatcacctgacccagggaggtccaggctgcagtgagcggtgatcatgccactgcactccagcctgggcaacagaacaagaccccgtctcaaaaaaaaaaaaaaaaaaaaagcccaactcctggaaatcaaatggtacctgatgtgaggttttctccctgttatgttagcctcaggccatctaacccaggtagaacaaggcaggtaaggaaacccagtgggccaaggaccccgaaggaagcccttaacacaatgcctaatactgaaaacaacggatgaatgtattcaaaatttgtttgcaagaaatgagactttttgcctttttaggacaaaaaaagcacttgaaatttaatttaggttaacaggagatatggcgggtagcacagagtgattatgaaatgcacagggcttccctgccattcgagttttgatcaatctcagcaaaacccaaagtttgccaaaacctggaaacaactcaaatgtccatcaacacagtagaatgaataaatgagttatggtatttcattcaatataacatgaatgaaaatgaatgagatgaaatgaaaatgaattatgtaaaactacatgtaacaacaaggatgaatcctacacccatgtgaaatgaaagaagccacacacacacacactcaagaaatgcatgttgtatgatcctatttatataaagttcaaaggtaggtaaaattaatctgtactgttagaagtgggaagaatggtttctatcaggaaggagtaggtagagattgggaggagttgcaagttggatttctggggtgctactggtggttaatctcttgacctgagtggtaacatagatatattctttttgtgatacttcattgagcagaatacagtcataagtgtcgcttcatgatagggctaagttctgagaaatgtgtcaagagatttcattgttgtaccaacatcatagagtatacttatacaaacctagattgtatagcctactacacacctaggctagatgacatagcctattgctcccaggctacaaacctatacagctgtcacagaactgaatactgtaggcaattgttacagaatggtaagtgtttgtgtatctaaatatatctaaacatagaaaaagaacagtaaacatacagcattataatcttatgggaccaccatcatatatatggtccatcattaactgaaatgtcattatgtggcacatgactgtacttacaatttgtgcatgtcatatgtatgatagtctaaagttcaaatgttggattgggccttgcttgattatccaggaactgagtttgcaagagctaaaaagaacctcagaatccctgcctaacagggatggcagggtccatttctggaccctaatggtaggtccatttctggagttaggaaaactgagtcaaaaacctgagtagaaggttgcagcaacagatacagcaggacaggttggggactgtactcagggggatcaccagataccagtcttgggagcaagttccacagaatggtagggctgagattgctggcaggcaggattggcttggggactgcataggccagaacataaaggtgaagtctaagagagggtattgcagaggatgaggggttgacagtggggagtggtatgttgggagctcagatctggtttatttttaactctcatgaggccacactgcctcctctcctatgttattcccttcctaatgtggatagtatggtcagcccaggccatgggagtgtggccccgattttccatgtagggagactggctctagtttctcaaaagcacaagctgctggacctttttctcaactgttggcctacgtggaagagacttggcttaatggaagggagaatgaagagaggcttttggaaagagagggcctaaacaggatcagcattgatgccaagcaacacaagggagaagggacttttcttggcgttcataccacggtgggccacagcgtggtgggaaggcatatttgcatatggtaaggggaggagcttaagggtaagagagtctttgaagattgggaagcaaggaaaccaaggcagctagccacaggcaaggtgtgggggctgcaaacttgctataaacctgctcttcagatccaccacttgcatttttaaccctcagtcaaaaccaaggagctgctgaggagtgatgcctaagatgatagtccccaggatgtgtggggctgactttttgctaactgaactgcaaatatttggagccatttgctgctataacatcttaaaaagatgaggcccctcattggatattccagtcccaattgggagagaataagaagggccacgcctgccctcgatcaagatcttgagtgcaatgcagggtggactcagagagacaaaaacctaatttatccccagcttagtgtctgccagccataaaaagaaaaaaaaaggtcggtggataaacaagagatgtgcctagtgctgagaagcatctccttgtgtgttcagagttaattaacatttagcatagcccctttaggggtgagaagttgtgattgtctttctctaaaggttaaattacctccattatgtttgccttcctgggaagaaaatgcaggatgagttggaaaatcactgttgaaacacaaccgtgacaccactgtgagtatgtctaattccctggcatgggggttttaggcattagaaagtgcataatagtaactagattccaggatgtgtctcaggaaatcccaaagggaagctttttttcattcatagaatacttcctgaagacattattataggaaaactttatttaggagagtttctttgatcctgtactagcacatgagaacatgtaagcagatgacaatatctaatatctactgctgcctgacccactctgcttcccatcccagagtttcttttgcaaaacgcatggagccctgcttcgacaaagctctctagatagcacccaacctcaccaggaaggtctgatttatagcatgttgatcttaagcatgttagtgcaacgcccaaaagagaaaggaagtctcaataaagggatattatagaaagtcttcagccagtggatagactctcatctctaagccaggctgagatcaccagatcagcaggataaagaactatttggggctatatgtacctaatgaggctggattcatgagatcaacagtatttaaggtccttgggcgtaagtagggcagtagctgagaaggcctctctcggctctggctctcctgcccctactcagaatgccacactcacccaaggcttgatgttgctcactgtgggtcagtggctgttgtctccaccgtctctcccacagagggggaataattgcacccccatcacagactttccacaagtcaggatgatctctcagtggctctcaggtttcccaagtatctttcccccatgggcatttgactgacaatctactaaatctctgtacttccatttgctcatctgttaaaacctgtagctgctcacggggctgttgtgatgacaaaatgaaatttacatgattaaggtacttaactttccccagtgcctgcccataatagatgctccagaagtgttaggcattattttaaacccagtaggagtctttaaccacttgattttaattagatgaccctcaggggtgagatgcagtgggtgatttagaaagtgcaccctgggagggcatttgcttggaaggaatcttgtaggagcaggtagaaggtccccaaaagaacaaaatacgggtcacctcacaggatccaccactggaccgggatcctttactgaagctggagcctcattatgaaagagctacttggccgggcacggtggctcacgcctgtaatcccaacactttgggaggccgaggcaggtggatcacgagttcaggagagcgagaccatcctggctaacacggtgaaaccccgtctctactaaaaatacaaaaaaaattagccgggcatcgtggggggctcctgtagtcccagctactcgggaggccgaggcaggagaatggcgtgaatccagtaagcggagcttgcagtgagcccagatcgcgccactgcactccagcctgggcgaaagagcaagactctgtctcaaaaaaaaaaaaaaaagagctaattgatggtacctgggtgcccaaacttctactgttgctatcgtttctccatgtctgagtacgtcccacaaggagcagtagcaaaagctggtctttcaggggctcatcaaacacactcagacgtttcaaatgtcccaagatcggcagctttgatcctgaatgttcttcccttgattaaaacaacaacaacaacaacaacaaaatgaaacaataaaaatttaaagagaaatttaggccgtgcatttctaagaatttacacttagttcattaaatctattgttttctcagttgtttgaagtccaacaagactaatgagcctttttttccaaatgtctttaaaaatccttttttcttacaaggccatttagaggctttgaacgttgttccaagggtaataatattagtattaataataaattattccaaactcccaacccctgcaggttcagaatttacttaatactctgaacccaaggaatttaaattattaccagaatttattaccttttgtttatggggctttccaaacaggagaaagaaaccacgtggaggttcactagagtgcattgtgtggttcgctttgcggtaatgcatataacccagaagacttccagaaccttctcagcttgaaccttcaaagcctccctaatttggtggaatcagcatggttatgttgagattgtactgagggtactgacttttcagcctggacaatttttggctgatggaccagagcaagagccctcgtaggattctcccataggacatacaatctatgttacataagatggatgatatattgttaggtggctatggggtggaaagagaacaatttttctctggggtgtgtgcaaaggaactgactgccttgctgccccttgaactctctaccttgtcatctgaggacctctggtggtggaaattttcccagcgtgtgtgaattgatgtttctgtgccaagccatccaaccctgttacattttcctacattcctttcctcctattttgtcattcacattaagcaaggagcaacaatcagttgcaaatacccagaataaagtggtggatgtgcctgaccagactgccatttcacaaaagttacctgctaccttctcttccagtgaacttctgatacatttcctgcagcaagagaaggcagccaacatgaaggaaaatgtggcatctgcaaccgttttcactctgctactttttctcaacacctgccttctgaatggtaagtaagaggctatcacgctctctttcattgcctggggtgtttgtcaacagggtggagagtccatgcagtcttcttgcaatgccattatgaaaaatgaaaatgctgtgttatgtgctgctgttaaattatttgcaatattttgcattaaagttaatgcagaaaaattaatgcaattaatgcaaaatcttgtcactgtgctctctgccttttgtcctcatttcaggagtgtaatgaaacagctctgaagaagacaggacctgagttctaatccaggtcctgccagtttctagctgtgtgacctagagccaattacctaactctctgggtttccaaattctcaaagtgaggacagtgatgtttcctctactgcagatgaaataatgtatatgaaaactctttaaaaaaccataatgggatataagaggttgctgttacatggcgggaagcaggtacagccgactctattatctgtgctaacaggagaaatgaagtccacagctaaatgagagggtgggtgcctgtgactatacacttctgtatgtcaacccatgtgcatttctgggtgtgcagacttctatatgtacctgtgtatatattaacttttctatatggacctgatttcaaatgtctctctgtctgaacctgtatgtatatacttttatgtatgtctgtgtgtgttctgtgtatatccgtatgtgcacacttctctgcaggtacctgtgtgcatacaagtatgtacttccatgagtatgcacctgtgtatatttttgtgtgtgtgtgtggtgtgtgtacttttgatgcgggctctgtgtgggcatctacatacctgtatatgtggttcctgtgtggttttctccgtgtttctgtgcattgagaaagtccattaatgttaacttgttcctctaatgcagatgaaggaaacatttgtctaattgtaattttacaaatctaccctcctctcttgagcttcctgaaggtactattaataaacagtaaaataagaaagagaagctttcagagagagaaaaaggggaaagcagaggtcagaatgacccacaagagaaactaaatactcaagaaatcaatgatcaccctaattggcttccgagtgtgctcattatggaaccataggctttaaactttttaaataaacttttctttctacttcacacacttctccccactcatgacaaaagcaaagcaaaacaaaaacttgcattcttgctgtaactcccagcaacacattatcctgaataaattgttcctagaggatgagcaatgttacaaatattggcagagctgacccgggctggcaaggacgggttttagcagggcctgtgagcaggagggtaggtgagtttcagctgacactactagcctggtgtcctgggctccagcctgtgtcccacagcatgccattccactaaattcctctttctggccagctctgcctagagaatcctcttcccacgcatttctcctcactgaggtctcctcctaacctgctgtttctgctctggtgctcagctagaaactctggccttggagcctgcatgaggggtagaggagaaaacagagagaacccccggaggtgctgacccatatctgaaagcgctcctctctgctcctgatatcctaaactcaatgctagggcatccagctagacaaaaaagaggatcagctgaagtcatgtaggcgagcatggtggcttcccagccccacagtatcagggcaaattcccagggctctgctgtccctctttgaacctgacatccaagcaagagaaatgggagcccgcttgccaagagctttggggatttggcaactaaaaaattttacactcttggtgttatattttcacaccacctcactgagaccttctagcatccagtctggaactgggtacagctcttagataacagtggttgctcagaaccaggagaggagctggctactctcctacctcttaccacacctcctaccccaaaaagatccatcaaattatagttttatagaccctatgggattacaaaagggccacacactcttgaagccctacgtatccaaaggaagccctttgcaacctcaccacacacacacacacacacacacacacacacacacaaaggaaagagaggaaaatctaagagaaaaaaaaggactaaaaaccaagattcagaaatggggatggggtggatgaggagacagactgtgagtctgggtcacaagatcaaagctgaataaaatcaaggaaaagtggccaggtgcagtagctcatgcctttaatcccagcagtttgggaggccaaggtgggcagagcacgaggtcaggagttcaagaccagcctgaccaacatggtgaaaccccatttctactaaaaatacaaaaacttagccgggtgtggtggtgtgcacctgtaatcccagctgctcaggaggctgaggcagaattgcttgaacccaggaggtggaggttgcagtgagccaagatcgcaccactgcactccagcctgggcgatagagtgagactccatcccaaaaaaaatcaagaaaaagtgaagggaaaggggaaggaaaggagaagatggggaaagaggaaggaaaggatgcccagatacagggagctttagcgatgtagtgaacggacagaagatcaggaacaagttgagttcattgtgtggggatggcagaaagatggagattggtgagctgagtggagaagtgccatagagcggtgttttgccagagtgtctgcggattgctcatacctgggaaggattctttgtatggttcccttaggctgagggagggtatcagctttacagaccttgtgggattacaaaagggccaccacacactcttcaaccaatatgtgtctatcttgcattcaaggctcattctttgttgaaattttgcagttggtcactaggctattgttatctccatctcaaagtacacagacacacacacacacacacacacacacaccagcaaaatgctctctaagagcaatgccaacatcagggcagcccacagaggagtgttgctggatgctgatgcttggcattcctgagcatccaccctaggtctcctcagcctgagacttcatcgctggctttggtccatcaatctgtttctgtcaccagcagaagggtcaaatggttaaatggacctcaatattgatgcagtggcttctggctttttctaggacagttacctcctggaaaacctgagatctttaaatgtcgttctcccaataaggaaacattcacctgctggtggaggcctgggacagatggaggacttcctaccaattattcactgacttaccacagggaagggtaagaagttcccttctctcctatgaaaccccacatgagtactcccattctccaggccaaagaaacactggttctgagtgacagcacatccctgaatttacaccagtaaggttcataccaccggggaaaggggagtctaaggtccatgcccacattctcctgttaatgtctgttaagagctgtgtcaatatacataaggttaccagccatagcagtacaatatcagtgttactggatgctgatgcttggcatttctgagcatccaccctaggtctcctcaccctgagacttcatcacttgcttgggtcccatcaatctgtttctgtcaccagcagaagggtcaaatggttaaatggacccaatattgatgtaatgtttcaaatcccctctcacagcttaggttgcagcctgaggccccatagaagtgtttcttaattgctagttaatcttaaatgctcatctataattcttatgccatttgtattttttttaactaaacatgtcacttttgcaaaataagtaggatcgtgtgaagtggtaccatacaatccttgacaaatgtggtatattaggttttcaaacttgtttcatgttcaagaaaataaagaaccttgtagggaaaagaaggtgaggttttttccttagcacattgctcatccaagagccaccatctcctagaagacatattgggacctaaggttgaaatgagggctaaaccagatcatctctgtgcaagcattttgttacgctgacagtgagaccctcctgaaaatcatgggagagctgcattcttcttcagaaaggaaaatatttagttgctggtagagacagctggcccactttccaatgactgcactttgttgtacacaaaactgtcatcccggctgaaatccaaagggacatcatgtaaacagatttcaggaactcagatgcaaccagaattgaacaagcctccacccctgtgcagtgtatcttgagctgaggttcctgagtctaaatgtgagcagcctactgagccacgtgggcttgaaatacctcctctcaacgtcacttcactttattgctgacttggtgcagtctgaaatggaccaacatcagtttttgtcctcttgaacccttttttaaaaaacgaaaagtaattcaacacgtatgtgaaatagctgctgcattgtgcatgacccctctgtgtgtggacaggtgaaagttccaatttcctgaggcaacccaatgggcatgacctgggtatggtggtgcctgggccattgaaagctcgagtgtttatcagcagggaatataggtccccgagcccacaagaacacttatagaaaggaagggttgatggaagaagaatacttgaggccctaaaataacctttccaacatgctcttccctctctcactcccagctgaaatgggcagaacatggaagcctaaggaaccatttgtcagctctgggttttgcgcttggaatttctgatacccaaaggccagtggtattgatctatgaagaaaaaaactagactctctttattactttcttattcattcctaatacattacttattgcagagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacataggtaaggggaaggaaagtgggtgaggaatttcttactccactatgtattagccaatagtcacactcagtttgagtcttcttgggttttggatggatccccaaaaagaaagatgagaaaactcacgatatgcttgtcaacagaacagttcaaatcattttttatcaagtcattcatgacactaaggctggcacttgggatccttgtgttcctgtgctttcccttgaccctcatcctcttgcactcagcacaaatgttctatgtatgtttcccttgccaactcttctttcttgccctgcccttgcaattgatgtccgcttcttccttggcaagctgggatttcttttatttctcctcatggaagacagagctgctccatgaagaagaagttcttagaagggttcatctgattctgcacccacagcaattgctcccattgctttgccccaaactcatatatgtgtgtgtgtacatatatatgttgcatatatgcgatatatatattagtgtgtgtgtatatatatatatacatcattggtaattttttttactaaacatttacaaagtaatcatgttacttttataacataagataatatgaggtggtgccatgtaattcttgacaaacatggtgttcaagaaaataaagaatgtaggctgggcgcggtgcctcacgcctgtaatgccagtactttgggaggctaagacaggcagatcataagatcaagagttcaagaccagcctgaccaacatggtgaaaccccatctctactaaaaatacaaaaattagccggctgtggtggtgcgtgcctgtaatcccagctactcaggaggctgaggcaagagaattgcttgaacccaggaggtggaggttgcagtgagccaagatcatgccactgcactccagcctgggccacagagcgagactccacatcaaaaaaaaaaaaagaaaagaaaagaaagaatttaaatgttaaaaactaccaatggtctgtgcacacacacacacacacacacacagagagagaggaagagagagagagagagatttatcacctctgcatctactggtgctgccaaggttgcaggaaggtcatctccaagctgaacgggaagctctctggcatggccttccatgtccccaccacagatgtgtcggtcatggacctgacctgctttttagaaaaacttgccaaatatgatgacatcaagagggtggtgaagcagggacaatgttctggagagccccatggttgttgtacctcagttgcgctgaggggccattcacagtcttctttatggagtgctggcatggactgtggacatgagtccttccatgatgaatgacaaattttatataagtgtggtgtgtgtgtgtgtgtgtgtgtgtgtgtgtgtattgccttaccctcaagcattataatatttgaaggcaaaacaatgaaagcaagaaatgttctgaaattagcaactgttttaataaatgcgacccacaaaaaaagggactcactaaagaaaagtaatatgtttaaaaagagaaatcaacaagtgtatatgaaattctcattgatcctggaaaacaaattctctggtgaaagaatatgttggaccatatttttcaaaataataaaagaagtgtccacagaactctcctataaccctgcagcctacagtgttgggacaggccacggaagttcattttaaaatgcacggtacattttctgacacttcgactctcatccagcaataacctgcagtacagaatgacaacattgaaagataattgctcaggagtagagttctttgttgttgagtaatatttagttacattgaaaacacttaaaagcagtggttctcaactgggagctgttttttcttcccacaggatatttggcaatgactggagacatttttgattgtcacaagctaggaaagtggggagatgggggtattacttgtatgtggtgcataaagcccagagatcctgctaagcattctacaaagcataggacatccccctccaacaaagaaatatccagtccaaaatgcaagtagtgctgaggttgggaaagtatgctctaaaagatacatcctcaacattttatttgcgtttttgtataattttttatcagaagcattgtttagtatgtatttaacttaaaacatatattaattagctgctgtttgtttaggaaatgtgctcaaaataatctttcttaggtatttactcagtaacatattagcttagacttgatggcaattttctttttttagtacaggggactttattgatggcacatggcaaagtgggtctccctaagcacctgctcttcagggagtctgcataaaaattgtgaggggagattctcactgaggtggagcactgagtgccacagggactcgccagcagctgagggtctcactcttgctcttgtgtgctcactgggggtggtggtccaggggtcttactacatggaggccatgtggaccatgagtccaccaccctgttgctgcagcctaattcactgtcataccaggaaatgggcttgacaaagtggttgttgagggcgatgccagccccaaaagtagaagagggggtgtcactgttaaagtcagaggagacagcctggtgcttagtgtagcccaggaggggtgtgtgtgtgtgtgtgtgtgtgtgtgtgtgtgtgtttgtgtattgccttaccctcaagcattataatatttgaaggtaaaacaatgaaagcaagaaatgttctgaaattagtaactgttttaataaatgtgatccacaaaaaaggggatcactatagaaaagtagtatgtttaaaaagagaaatcaagtgtatatgagattctcattgattctggaaaacaaattctctggtgaaagactatgttggaccatatttttcaaaatcataaaagaagtgcccacggaactctcgtataaccctgcagcctatgaaggggccctccgatgcctgcttcaccacctttttgatgtcatatttggcaggtttatccagatggcaggtcaggtcaccactgacacgatggtggggacatggaaggccatgccattgagcttcccattcagctcagagatgaccttgccctcagccttggcagcaccaacagatgcacagatcatgttctggaaagccccacggctgttgcaccacagtttcccagaggggccattaacagtcttggtggagtgatggcatagactgtgaacatgagtccttttgcaattgatggcaaattttttttattattatactttaagttctagggtacatgtgcacaacgtgcaggtttgttacatatgtatacatgtgccatgttggtgtgctgcaaccattaactcatcatttacattaggtatatctcctaatgctatccctcccccctccccccaccccatgacaggcccctgtgtgtgatgttacccaccctgtgttcaagtgttctcattgttcaattcccacctgtgagtgagaacatgcggtgtttggttttctgtctttgcgatagttttgctgagaatgatggattccagcttcatccatgtccctacgaagacatgaactcatccatttttatggctgcatagtattccatggtgtataagtgccacattttcttaatccagtccatcattgatggacatttgggttggttccaagtcttgctattgtgaatagtgccgcaataaacatatgtgtgcatgtgtctttatggcagcattatttataatcccttgggtatatacgcagtaatgggatggctgggtcaaacggtatttctagttctagatccttgaggaatcgccacactgacttccacaatggttgaactagtttacagtcccaccaacagtgtaaaagtgttcctatttctccacatcctctccggcacctgttgtttcctgactttttaatgatcaccattctaactggtgtgagatgatatctcattgtggttttgattttgcatttctctgatggccagtgacgatgagcattttttcacgtgtctgttggctgcataaatgtcttcttttgagaagtgtctgttcatatccttcaccaactttttgatggggttgtttgatttttttcttgtaaacgtgtttaagttctttgtagattctgaatattagccctttgtcagatgggtagattgtaaaaattttctcccattctgtaggttgcctgttcactctgatggtagtttattttactgtgcagaagctctttagtttaattagatcccatttgtcaattttggcttttgttgccattgcttttggtgttttagtcatgaagtccttgcccatgcctatgtcctgaatggtattgcctaggttttcttctagatttttttatggttttaggtctaacatttaagtcttaaatccatcttgaattaatttttgtataaggtgtaaggaaggtatccagtttcagctttctacatatggctagccagttttcccagcaccatttattaaatagggaatcctttccccatttcttgtttttgtcaggtttgtcaaagatcagatggttatagatgtgtggtattatttctgagggctctgttctgttccattggtctgtatctctgttttggtaccagtaccatgctgttttggttactgtagccttgtagtatagtttgaagtcaggtagtgtgacgcctccagctttgttcttttggcttaagattgttttggcaatacgggctcttttttggtcccacatgaactttagttttttccaattctgtgaagaaagtcattggtagcttgaatctgtaaattaccttgggcagtatggccattttcatgatactgattcttcctatccatgagcatggaatgttcttccatttctgtgtatcctcttttatttcattgagcaatggtttgtagttctccttgaagaggtccttcacatcccttgtaagttgggttcctaggtattttattctctttgaagcaattgtgaatgggagttcactcatgatttggctctctgtttgtctgttattggtgtataggaatgcttgtgacttttgcacattgattttgtatccagagacttgctgaagttgcttatcagcttaaggagattttgggctgagatgatggggttttctaaacgtacaatcatgtcatctgcaaacagggacaatttgacttcctcttttcctaattgaataccctttatttctttctcctgcctgattgccctggccagaacttccaacactatgttgaataggagcggtgagagatggcatccctgtcttgtgacagttttcaaagggaatgcttcctgtttttgcccattcagtatgatattggctgtgggtttgtcataaatagctcttattattttgagatacatcccatcaatacctagtttattgagagtttttagcatgaaggctgttgaattttgtcaaaggccttttctgcatctattgagataatcatgtggtttttgtctttggttctgtttctatgatggattacatttattgatttgcatatgttgaaccagccttgcatcccagggatgaagcctacttgatcatggtggataagctttttgatttgctgctggattcggtttgccagtattttactgaggattcttgcatcaatgttcatcagggatattggtctaaagttctcttttttggttgtgtctctgccaggctttggtatcaggatgatgctggcctcacgaaatgagttagggaggattccctctttttctattgattggaatagtttcagaaggaatggtaccagctcctctttgtacgtctggtagaattcggctgtgaatccgtctggtcctggactttttttttttggttggtaggctattaattattgcctcaatttcagagcctgttattggtctattcagagattcaacttcttcctggtttagtcttgggagggtgtacgcgtccaggaatttatccatttcttctagattttctagtttatttgcatagaggtgtttatagtattctctgatggtagtttctatttctgtgggattggtggtgatatcccctttatcattttttattgcatgtatttcatttttctttcttttcttctttattagtcttgctagtggtctattaattttgttgatcttttcaaaaaaccgctcctggattcactgatttttttgaaggttttttgtgtctctatcaccttcagttcttctctgatcttagttatttcttgccttctgctagcttttgaatgtgtttgctcttgcttctctagttcttctaattgtgatgttagggtgtcgattttagatcttccctgctttctcttgtgggcatttagtgctataaatttccctctacacactgctttaaatgtgtcccagagattctggtatgttgtgtctttgttctcattggtttcaaagaacatctttctttctgccttcatttcattatgtacccagtagtgattcaggagcaggttgttcagtttccatgtagttgagcagttttgagtgagtttcttaatcctgagttgtagtttgattgcactgtggtctgagagatagtttgttataatttctgtccttttacatttgctgaggagtgctttccttccaactatgtggtctgctttggaatacatgtgatgtggtgctgggaagaatgtatattctgttgatttagggtggagagttctgtagatgtctattaggtccgcttggtgcagagctgagttcaagtcctggatatccttgttaactttctgtgtcgtcgatctgtctaatgttgacagtggggtgttaaagtctcccattattattgtgtgggagtctaagtctctttgtaggtctctaaggacttgctttatgaatctgggtgctcctgtattgggtgcaaacatatttaggatagttagcacttcctgttgaattgatccctttaccattatgtaatggccttctttgtctcttttgatctttgttggtttcaagtctgtttcctcagagagtaggattgcaacccctgcttttttgttttgttttgttttccatttgcttggtagatcttcctccattcctttattttgagcctatgtgtgtctctgcatgggaaatgggtctcctgaatacagcacactgatgggtcttaactctttatccaatttgccagtctgtgtcttttaattggagcatttagcccatttacatttaagattaatgttgttttgtgtgaatttgatcctgtcattatgatattagctggttattttgctcattagttgatgcagtttcttcctagcattgatggtctttgcaatttggcatgtttttgcagtggctggtaccggttgttcctttccatgtttagtgcttccttcaggagctcttgtaaggcaggcctggtagtgacaaaatctctcagcatttgcttgtctgtaaagtattttatttctccttcacttatgaagcttagtttggctggatatgaaattctgggttgaaaattcttttctttgagaatgttgaatattggcccccactctcttctgggttttagagtttctgccaagagatccactgttagtctgatgggcttccctttgtgggtagcctgacctttctctctggctgcccttaatgttttttcctttattttaactttggtgaatctgacaattacgtgtcttggagttgctcttctcgaggagtacctttgtggcattctctgtatttcctgaatttgaatgttggcttgcctttctaggttggagaagtactcctggataatatcctgcagagtgttttccaacttggttccattctccctgtcactttcaggtacaccaatcagatgtcgatttggtcttttcacatagtcccgtatatcttggaggccttgttcatttctttttactcttttttctctaaacttctcttctcacttcatttcattcattttatcttcaatcactgataccctttcttccacttgaacaaatcggctactgatgcttgtgcatgcatcacatagttctcgtgccatggttttcagctttatcaggtcatttaaggtcttctctatgctgtttattctagttagccatttgtctaatcttttttgaggtttttagcttctttgtgatgggttcaaacatcctcctttagctcagagaagtttgttattaccaatcgtctgaagccttcttctctcagctcgtcaaagtcattctccgtccagctttgtttcgttgctggcgaggaactgcattcctttggaggagaagaggtgctctgatttttaaaatgttcagcttttctgctctggtttctccccatctttgtggttttatctacctttggtctttgatgatggtgacgtacagatggggttttagtgtggatgtcctttctgttagttagttttccttctaacagtcaggaccctcagctgcaggtctgttggagtttgttggaggtccactccagaccctgtttgcctgggtatcaccagcagaggctgcagaacagcaaatattgcagaacagcaaatgttgctgcctgatccttcctctggaagcttcatctcagaggggcacctgggtgtatgaggtgtcagtcggcccctactgggaagtgtctcctagttaggctactcgggggtcagggacccacttgaggaggcagtctgtccgttctcagatctcaaactctgtgctgggagaaccactactctcttcagagctatcagacagggacgtttaagtctgcagaagtttctgctaccttttgttcagctattctctggccccagaggtggagtccacagaggcaggccggcctccttgagctggggtgggctccacccagttccagcttcctggccactttgtttacaatctcaagcctcaggaatggcagacacccctcccccagcctcactgccaccttgcagtttgatctcagactgctgtgctagcagtgagcaaggctccatgggcttgggaccctctgagccaggaatgggatataatctcctggtatgccatttgctaagactgttggaaaagcgcagtattacagtggtagtgtcccaattttccaggtaccatctgtcatggcttcccttggctagtaaagggaattccctgaccccttgcacttcccgggtgagacaatgacctgccctgcttcgcctcacgctccatggactgcacccactgtccaacaagccccagtgagatgaacctggtacctcagttggaaatgcagaaatcacccgtcttctgtgttgctcacgctgggagctgtagactggagctgttcctattcagccatcttggaaccagaccacggatggcaaatttttaaaagttggtttttaggcaaatgtaactcataatgccaagtacactatagttacagtcactctttccccatctggtacagagattgatttaaggaggtgataaatgaatggagaaaatgtcactgaacagcagaactgagactgggatgaggcaagccagcaccccagcacctaagtcttaggaaggtactcacaaggcctgtacctacaggagcctacagaagtaaatgcctccttcattttttttttaattcttgccagcaggaagccacttcatttgtttttattgtggcaaaaacacaaaacacatatccaccatttcaactattttatagtatgcaattgaatgcattagtttattacaattttatgcaaccatcaccactatctagttctgtaacacgtttacctccctcaatgaaaacttcacatccactactaagcagttacttctcatttctcccttcctcaagccctggcaatgactgtctgtttctgggagtttgcctcgtctggatatttcatatatatatatatatatatatatggaatcataaaaaatatgtagctgttccacatttttttttttgaaatggagtttcgctcttgtcacccaggctggagtgcaatggtgcgatctcagctcactgcaacctctgcctcccagattccagtgattctcctgcctcagcctcccaagtagctggaactacaggtgcacaccaccacgcctggcaaattttttgtatttttagtagcgatggggttttaccacattggccaggctggtctcaaactcctgacctcaggtgatccacctgcctcagcctcccaaaatggtaggattacaggcataagccactgtgcctggcctctaccacattttttatccattcatcaactgatggacatttggatttcttcacttttggctattataaatagtgctgccatgaaaattcacatacaagattttcttaaacatctgttttcaattcttttgaatctatatctaggagtggaattgatgggcaatatggcaactctaagtttgactttttgaggaacttccagactgttttccacagtggttgcaccagtttacattcctaccagcagtattgagggttccaatctctccacatcctcaccaacacttgttatgtttcattttttaattcttgccatgctagtacatgtgaaatggtatctcactgtggttttgatttgcattccccagaaggctaatgaccttgagcatcttttcatgtgcttcttggccatttgtccctccttgaattttgtatcctatgcacttcactcacgtcagcctaatcccaggcctgctctccagcacctgacatcaaacgcaatgtcttacaaccatggtagagtgaaatagtagagaccacttcctctaagtcacatagttatgggttcaaataacacttttaccaaatatgtgaccttaggcgagtaatttccctcttctaagcctgtttcctcctctgtaaaatgaatgggtacaataatagtacttcatggagttgctggaggattataagaaacgatgcagagatagtattttatacagtccctggcatgtagtaaatactcgagaaacattagctgtcattttgctaatgggaattcgctaagcatttgttgaatgagtgactgggccaacaggctgttatgaaatcaccaaaaggatcattgccaaaaagctcaacctccatttagcttatgggagagtggatctcatttaccacagggtgtaatatgtatgttgaatataagatgtaattgctgaaacgaagatggaatctgtaaacctgttatctgcagagttatgattatgaatagttcatttacaaaaaactgtgtgtaactaaggagaatctcatgcccagctgagggaaataagctgtttgaaatctctttccctatagtcttccatgccaactcccacttgcaaatcccagcccagtttttatcacctggtctctgtcatcatgaaaattatggggatagctatgagattctaactgatgaaaagcgagaacatgcggagaatgaaataccagctgcttattattcttaccatgtaaacctcatctgtatgcacaaatatgattggtcacatactaagaggtagaagacaaaaggcccgggtatttggggggcttatagtacagtgggaagagtgagatgataaacagaaaaaggaattcctaatagaaaatggtaaagccaaagaaaaggtgcaagcaatgagtgctactggcatttgctgtatttctgcagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggaggtgagtgatccatatgctttttgaaggaactatggcctttggcaaggataaagccctcacaactgaaaacaggtcattcctcctaattactgggtcactgtgttggcctccaatgcagttgtgacccacccagatgtgaaaagcccttttcccctctattgggattgatgggggctcatcttcacagctctcctcgggctagtttcttgtactgctcagacacttgaccaggtttccaacctgcctcccttagtacattttagatctagacccttgtaagagtacttaaatggcaccaggtgggagggggcagtctcagtatatcccgtccatagtcaatggctgtgtttttatttactttaaaatacctcaaccaggctgggtgcagtggatcacacctgttaatcccagcactttgggaggccgagacaggtggatcacctgaggtcaggagttcaagacaagcctggccaacaggaagaaaccccatctctactaaaagtacaaaaaaattagccaggtgtggtggcgggcacctgtaatcccagctcctcgggaggctgaagcaggagaatctcttgaacccaggaggcggaggtttcagtgagctgaaatcgcgccattgcactccagcctgggcaacaagaatgaaactccatttggaaaaaaaaaaaaggctgggctcaggggctcacacttgtaatcccagcactttgggaggcagaagcaggtggatcacttgaggtcaggagtttgagaccagcctgaccaacatggcaaaacccagtctctactgaagatacaaaaaacttagccagccatggtggtgagtgcctgtgatcccagctactctgaaggctgaggcaggagaattgcttaaacctgggaggcagagatttcagtgggctgaggtcatgccattgtgctccagcctaggtgacaagagcgactccgtctcaaaaaataaataaataaaaataaaaataaaataaaatactttgacctaaagaaataatattaaattgcaggtggtacaatattccatctttacatactttagtatatgcctcttttaaaaaggcacatttccaaacatagccaaaataataggatcacacataggaaaattaaaattccttaatatcgtttaatacccagtccctagtttaattcctcccaatgtttccgaatatctttaacagctactttgtccaaaccagaatctgctcgtagaccacacattgtaactggtcgttatatccttcagtttcagtgtaatgaggagactgggccacttgtcccatagagtatcccaccttgtacctttctctgatcagttctttgtggggttatttagctaatttctctacgcctccatttcctgtaaccagacttgattagatgtaggttgaacaatttttaccaagaattggtaaattcagaggtgatattatgtactctatattgtatttaatcagatgtcaaaaactatctggttgacccaccataagtgatgctaaaactggcccctgaattgaggagatgacaaactgatcccttgattgtaaggtcatgtttaatttgtatactactactttaccatacatgaatgcccaattctctttcacctcatgtttttaacaccaatttattattgaatcagttatttcattagggtttaaaggctaacaattctttaattttgttattcttttttttttttttttttttgagacggagtttcgctttgtcactcagctggagtgcaatggcacgatctcggctcactgaaacatccgcctcccaggttcaagcgattctccttcctcaccttcccaagtagctgggattacaggcatgtgccaccatgcctggctaattttgtatttttagtagagacagggtttctccatgttggtcaggctgatctcgaactcccaacctcaggtgatacgcctgcttcggcctcccaaagtgctgggattacaggcatgaggcaccatgcctggccaattttgttattctttctacatttattaagtagttgtttttcataaagtgggaaggaggcagaatatttgacttttctgaagtagagtcccaaatggagagatagaaaacctgctaaatttttgtgtgagcaattttaagagaaggaaaagatagggctaagacagtggagtagtgacagcagggaattctctgtatatgattgttcagcctaacttagtttattttttaggggaaaactctctttcttcacaacaaatgttagaattgacttctgttttccttattctaccttagatccattttgctgggcagcaaacagagtttaagattctcagcctacatccaggacagaaataccttgtccaggttcgctgcaaaccagaccatggatactggagtgcatggagtccagcgaccttcattcagatacctagtggtgagcgtcttggctcttttttgcttatgtccctaaatatgttttaaatggtatatttgcatataataactactaatagagaaaccattttgagccttagccagaacaatagaggtgggtttataatctttctgcccaatacgaagacattttgaaaagcagcattgcaccctggattactgtcaatggagaacaattttaggataaggctacagacatgggtctgatgccccaaggggcttgatgagcagttattatgctcccaccatcttccctattcccatcatttagaggatttggtcaaggtcatcctctagttcttccagaatttataaggcagtaccgtgtctcaaaggctcagtctctgccatggattacacttggcaccttgtctcttagtgaagacacaggatataagatagacagctccagcaaagcaccttaattcagtagcttgtgttctataagggaacaatccatcttgcatttttaaaatgctttacagcttacaaagcctgtaccttatttggtcctcccaaccctcccaggtattcagagaatatgattatcattaaaaattaaaagtgaagaaaccaaacctcagcaaagttaggagtcttttccaaaaccacacaggaaagtctagcttttctaacaacttgcctgaccaaagtatcgggctttcattggcttggcatgctggaaagggcactgaactgcaaatcaggcaggcatctagtccactcctgactcttgcttaacaaaagcacagggtctagaggcagaaagcctgagttcaaatcccagcctgcaacactatagttatgtggccattggtaaatctttctttgattcccagttttcttatcttttataacaaagcaatgtaggcaaagagtttaacaccattgatggcttttagtaagaacttaatgttagcttttattattattactgcaaacgaccatgtgaccttggatttcctctttaaggatcaattaaaaagaataatgaaaggatttttaaatttttagagtactataaaatatacgcaacatattaacatattaataatatttaaaagagaatagccctgtcattgatgatactttggattgctgttcaaatcaaaaaaatatatgaatggaggaaaacactcttgggtttaagagtttcattcattaggttggtttgtttttaatgatgctgtacgtgatcaaagctttctggctgtttgttttttagacttcaccatgaatgatacaaccgtgtggatctctgtggctgtcctttctgctgtcatctgtttgattattgtctgggcagtggctttgaagggctataggtacttcactgtctctcaacttttcctcccaatcatgatagtcaaggataatgacaaaaaaaaaaatacaaagatgatggaaacctgtagataatcctcattttagccattagatgtagtgtgtttgcccataaaaaaaatcttttatcagtgctataaaaagtagaaaaattgactcgtttcaggctgatgttctttctatgaaacagagattcctagttgtgaaacagtaaaaatctggcaagagtagctaaaatcaagagaagcaaatagtccagataatccactaacttcaaaatcagcctccttaattagctaaagttaattttaatataggcctctgtaattttattttcatcattgattgtttcatggagctgccaaaccaagtcctatctctatcacagtccctatagtggctattatactaacctttcaaaaattacaaagtcagaaatgagtcatttagccaatctcatgaattattttatagcatggtgacctgcatctttccgccagttcctgggccaaaaataaaaggatttgatgctcatctgttggaggtaagtacaggaggcaaaaaaatggagtgtgactcactgctctgtagtaattaactctacacactcacacacagtccccgtcagttcagcctggtagtttcagccagcctttttggactgtctctcctggtcagcatgtgtgttaacagaaagttgtgtgaaggatgagggtacttactttcacacactaaatgtcagagggcaaggagagaaagccaagaaaacatggaaacacatttattgatttatcagatctactcataagcatagagataaacattttatacaaataatcaatttagaaagagagtgaatattttgattaatgcaaaacagggacccaccaccaccccctcaatcatacattggtaaaagcttctacttgaatgttctttacataaagccatagtaacagaatatcccattgccattatctctcactttgggcactcagctgagaccagatcagtactgtggggccatctgtttgccaggacccatttgggctgattcaagagggaattaaataatgagtgttttgaatgaaaagagaggttagaacagttttaaatttttctccaaattgaaataaatagtttcagtttggcttttaagcttaacactgacatatataaaagcaactagctgtacattaaggcaaatacttgacccagctgctctgggtctgacagtgtaagaatagaagaattgagtcctggataatctggcttgtctgtgttcactttggttgcaaatatcgaagcagggactagagcccaggagtcccagctcctgacccagtgctcttcctccactatccagtgtagcattggcctgatagaaccagcatgaatgtctcagcaaactaaactagttactgtccagctcacaatttaacctgctagccacagagacttaacgataaaatagctacttttgtctcaaaaatatgtgttagtattcttaatgatattacctctaatcctcaaaagaaccctcccagatgggtagtattaatattattttctaccttttaaaaatggagaagctgaagttcagagagcagcttgtccaaagtcacataccctataataagtgataaagccaagacctaggtcagtacctgacccaagtcagaggataagaaaaaagaggccaggcgcggtggctcacgcctgtaatcccagcactttggaaggcagaggcgggcagatcacgaggtcaggagatcaagaccatcctggctaacatggtgaaaccctgtctctactaaaaatgtaaaaaattagccaggcgtggtggtgggcgcctgttgtcccagctactcgggaggctgaggcaggagaatggcgtgaacccgggaggcggagcttgcagtgatccgagatcatgccactgcactccagcctgggcaacagagcgagactccgtctcaaaaaaaaaaaaaaaaaaaaagaggcaagagtgagaggaggaggcaggaggaaataggagggggaaaggaaggatagaagcagggagaataataggaagggcggaaatatggaatagggtgatgaagggggagaagagaaggagggagaggaagtagagtagaagaaaacagtagattaggaagagggaggagaagggaaggggaaataagaagaggaaggagagaaggaagatgaaccacagaaggaaaagacaagaatccacttactattgccagactctagaaagtgatagaggaagttagcaggccagcaaccacacctctgccagtgggccgcagtgtcagatgcatgcataagcactgtgggtttagaagtttcacaaaccttcattttatagttatctgtttattattgtatgtgtatatactacttgcccattaaactcatgattattattgcttggagagagactacgttaaatatcctgagttgactttaaaaaaaaaaatctgctgaatagtatccagaaggtgattctagatggcctggcacacaaatgtctgaagtttgagatcttcccacctgcttgtggcaatgaacagcaccacttagcagggatgctgatttggaatgttatgaagctaacagccatctcttcttgtgtctgtgttttaatagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttcccagtacagctgtttatgtattcagtgggtacagtattttctgctgcaaggttataatgtgtatttacagtacatagtagtatataaagttcccgtttgtggagtaaaatgccataccaacccaaagcccactgtgaaatatgaagtgaatgacaaaattcagttttcaacgcaatatagtatagtttatctgattcttttgatctccaggacactttaaacaactgctaccaccaccaccaacctagggatttaggattctccacagaccagaaattatttctcctttgagtttcaggctcctctgggactcctgttcatcaatgggtgaatcttcctaaagctaccataaaaagggagggcgacgatttctaacagctgtttaaaagagagaggttttgcttttgtgagaaatcttgggccacaaaaaaattttaagcaaagccaggagttagtgtctctctgaagtaaattcaattgcaaaatcttggcagaggcagaaatggctcatatcagaagtgtccaaataaaagttctgggaaactaggtatttgcttcccagagcaatgggaatagctccaaaggtcagagtaaggtaatgagaatctcccggtcaattccagtgccaggcttcctgaaagaagtcaaagcttggatcctcattttaaagggcgcatccatgactcatctagcagcccctctctatttttcccttcacttgatggtaaatccattctatatgtccatttactagctggacatagagaacttgagctcacctctgggagttaaatattccaccccaactatcccatattgatagcaactggactcagaggtccccctcctgtttgaaagtgaacacattgccaatgttttgagaatggcaaaagcaatagatacgaagctccatttttctaatatataaacaatatcatgagagtaagggaagcgtgtgggaaagttgtccaagctcattcagtcccctaaatcctcgatactttaactgtctgagaaccaactgcataggcatcacctgggcagtgtttgaaaattccatttgcagaatcttaagcatcagaatctgcattttactaagatccccaaatgattcaattgcacactgaagtttgagaagcattgttctagacaaccatttccactaaaggttattttagttcatagtaacaatcctcttttggaaaggacagatcaagtctgtttgacttgcaatgaacaacactgcatgtaagcaggcaaaaaaagaaacatatcagtagtttaagattcacattatgctgaatcttatatgaattcacataaaagaatgacctgcaaaactacgcacaacttctgaaaggccaaggaatataatctaccttgagagacattaaccaaagacagtcaccctcaaagccaatgcagactaaatctttcctaacatagtctattctctaagaatagagaagatatgtatcagtcactcttatagtctgaaaacctaaacataaaagtaatctgcttttgacatataattttgtataatacgtatgaaaaaatgtgacagctaaggacttgaattaaatccctaaaaaacaccaattagccactc

SEQ ID NO: 16000 - DNA, 17284 bp, Human
aaaatccccaaccaaccagctgagctatgtacatagtccatttctaggcaaggtcatctaggtgccgttttaggtagatttgactcacaaaggaagcagacagagtgggtctaggaggtgtctaaaaggtgcgttggtggctgccttgatgagctcccccacaccttgccacaggctacagaaacatgttttaaaaagacatatgtgcaatagttacacatttccgcctcccatcttttcagcacctatctctggagtctacagagtttccatctgtctggtctttgcttcagaacctgggtgctgcttgccagccctctcctaacctcgcagcccccctggctctccatacgtggttcttgacatgaattgatccgggctgtctctgtgaatcagcctcaagccgagactctgcattaaaaaatatatatattgaaaggttcgtggtgaggctgccgagttaatgctaacaaaggacttcagagggcactgtctttctttgtttgcaaggagcgaaatttctcggcgcaaataccaggaaggaacaaggataaaggaaaatgaaattagaatgaagaactgacagtcttggtttcagcagtctggactctggaagcgccatgtggggcctccttagccagtttaaatcgctcctgcgcctagtgttttaaagcaagctgggaggcgaagcgcgggcgcttggggacgcggggacccggggacggaataaactctgtcgtggggccctcactctcgagctgcagagctgggacattgttgctaagtgactacgagccaggcaattcacatctccctgggcctcggttccccacctgtaaaacaagggggctggaccggtcatctatcccgttcatttatagacttagctccaaataccgaataaaagacagatattttaactcccagtggaaagacaagcctctagttgcaaagataaatgggattcgtaaaagtgatcaccacgcgagattatttttcgaatcgccttcccttctcctgacacgcgggactattaaacgtgtgtgtgtgctgggccatttctttactgaactccaaactaacaccaccgagcgataaaaaacaggagaaggtgatggaggcttaatcgctaggagaggaggcggcgtggctgctgctttgaggagttcactttgaatcaagcggccgcggcgattggctgaaaagcacgtggtgcgcgccccgcaggactgcgccccggctgcccctgcagtcgcctggcttagggcagagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtaagtttcccccactgccccggacctgttgcaggcgctgcgggcttcaggggctgcttcggctgcaggggtgtgttcgcgaggggtgagcgtgctccgagcactcgggagcttcgactagagggcaaggggagctcttctcggtgcggagatcacggtgcccgccgctgccctcccacagcaggcagaagccgggcatcgccggagaggtcgaccggcctcccctccgcggtgcaatgtctggggcgagccgctggggaagcgaggagccgagctaaggatacagtcagcctctctcctctgcggaaagcagcgctttcctgggggtgaatgtcgcgctgcgtcgctccccgcagcctccagggccgagcgcgcgggatggttggcccacgttgcatcctccccggcttggaggaaagttggggccatgcacagacaccctgagtgcgggcatgttcactgcggcggaaatgtctatagagaatgaatgaaaactgctttctgaaaaactagtttcttgatctgtcgtgttaacattattagttacaaaggataggaattggtgggcctgggatgaaacactgaatttatccacatgcggtttggtgtcacacaggcatggccagcttgttaaatagcgttgcaagtgttaataaaaagactctggcaagaagctacttttgttaacaagatctttataatgttctattgttaccggtaatgtgaatgcccagaaaaaaatctgcttagtttctcttttgattggattgagatcatgttcaaaacctggagaagggtgcgggacgctaagcattggaggcagagagcctgagttaggagcatgaagtgaactgaagttactgtaactgaagcccttttgatgttcacagtaatagcagccctttctctgtcttctttgcagacgtaggttaagtacatgtgtgcattttcttggccacttacttggtatgcaaatgtgatttctctgggggcttaaaaatgctcgaaagatgattcattttatgttgaaggtgtgttcagtgacttgtatacatggtttctgctgatattttgaggtttgcacagttttaaaccagaaagcaagtatttcctcttgggtttccaagtttactttttattttaatcaaacattgttgcaagaatgttgattgtgattttgactgtgacgtgcttttccatctggatggtatccaagatgacaggctaggctcttccttctggcttgttgggccaacctggaacatacaggagcataaacacaggatgcggagagatgtagatcctatatcctaaggtcttctaagcaaattgttttcttaggtgtaagtctggttgtgaatgttgttttgcaccatcctgaatttaatgttcaaggaaatgtgttctgggcctagcatgattccagctcaatgtgtaagcattttggtgcctgtgcacctagtttcagggagcctcattcttccttcactcagggcagcatttgctctgagagaggcggcagattcacaagagtaagtagacagtctattgaggtttaggtttaaagtcttcctccagatactccagattgaatgtactaattaaaatagcaactacagtggtggagcattgagaatgctaatgaatgttttaaccctttggaaacctgatgcattcccataggttcatatggtcattctccaaaacactgggcattggttagaatggagtagacagtagatgcttagcttgaggtgggagtgaagctggctcctcaccattttttatatctcaagtcactgtggaaattactgggtgctttgtaaagtcttcctaacactggagctctaggactttgttgcttcctttcttccactaagccatgtttactcatcataaaaaattacattccaaaaaggaaagaaaactagttgcatcacctaatggtatgaggtatatgtgtcatgcccctgcctttgtggttttctgtgcagtcttacagtggggctcacatctggttggggaggtgcaggttagtattttagcccatgaatctgtggcaaatcattcatttgcatttattaataattcttagaatatgcatttaaaaatgtctgaatggttaaaggaaacagagtttcagctgcgctttcgggactggctgttatgtgtctggaacagatactgcaaccagccacacagtttaccctctggggataaacagcgggataaacagcttccttaggaatccttggacaggcaggttcttgaggacttcattcctttgaagtaacagagggatggtgtaaaagaaaaggatgaaggcatgtgattcagtttttgaagatgggtgacaagcatttcctatgtctctaccctactgttttcttactgaagaaaaccaaaagatagcattagattctactataatttcaatgtagataccaaggaaagcactgtagtcagcaaataaattctggggtggccctaaattaacaacaggtggcaaaatacacacacacacacacacacacacacacacacacacacgtgttttttgatttaaataaagcagtgtttgcattttgaactccttctatgcaggtgtcagcatttgcaggtatacaggaacagtcctagtgatgcactatttaatcaaaagacggatggatcttttgttcttgcagctggttttccaagaattgatataaagcgggaagaacagaaaacagcagtcataagtatgctactcaaaatattcttctttttatgtgccaaatcctcacattggaagctgtcccgagcaagacaggtagttggtgattatggccagaatttattctgtgctttgactaaaggcttgctgatcaatatatggttaatgttgaaattggggtgcttttaggactcttcagtggtagagctgtctggttagaaattaatctttaagttgggatgccgaggtgggaggatcaggtgaggccaggagtttgagacccggtctctacaaaaaatacaaaaaattatctgggtttggtggtgcacacctttagtgccagctactcggaaggccaaggcaggaggatcacttaagtccaggagttcgaggctgcagtgaactgtgattgcaccactgcactcaagccagggtgacagagcgagacttggtctcaaaagtatatataaaatgaaatacattatctgtaacatttaaataaaggtctgatcattgcagaagttggccttacatttcccatttactgtatgtgctgggagattggatcttaccaaaggaattcttaatggaattaattattaggtgtttgttttacgcatggctttatgttgcatggggcatgaaagccagtgcccatcctggcattataagagcaggagacctggcattttaagtggcccgcagtgaatgagctggactaggacagggagctgtgggaatgagactcactcctcttggcttttgctgacttatattctaaaagacttcgatggcctgaaagttggcaatcaggttttccaagatgaacctgctttttatgcagtgattttttttttttttttaaacagtgcagagttcaaatagctcaacagtattagcagtgaatatccttccttccgggtagttgtctctggctttgtcctggaatggccatacactattctagaatagtaggtggcatggtcaacaacaaagtgttctgttttttgtgcaaaaccattgttgctttcgttctgctgttctgaacatcaggagcatcattttcaatttattattattattatttttaggagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaagtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgaggtaagaagtttagctatagatgtaagtatgcatataattaggctattgtgtaagttcagtacatggagtgagatctgatccacagagactgtactgcagaagtactaccaaagctgtaaaaataagagagctggtgcccctagaacttatccacttgtgttgaccacagcctcagcccccaccatggcattagccagtggttctcagcttttactgagcctcagaatctcctgaagagctttttatttattttattattattattattatttgagacagagtctcgctctgtcacccaggctagagtgcagtggcatgatcttggctcactgcaagctccgcctcctgggttcacaccattctcctgcctcagcctcccgaatagctgggatacaggcgcccaccaccaggcctagctaattttttgtatttttagtagagacggggtttcaccatgttggccaggatggtcttgatctcctgacctcatgatccgcccgcctcggcctcacaaagtgctgggattacaggcataagccaccgcacccggccctgaagagcttttttaaaaactgcccatcccagagacttagtttcatttggtctggggtggggtccaagcatcagtatttttaaaaagtttccggatgattccaatgaacaaccaagttgagaacccctgacctctgttaagtatgccagctaatgtttattgagccctcactgtgtgcttgcagcggtgccacgtgtttcccacggatcatctcattctatcctcacaacaaccccgtggggaattattactagcttcattttatagatgaaaaaaccttcatgcattacggaggctaagctgcccgagttagcagagcttagtaagaggtggagctggttaggaagtcaatgcagggggtctggctctagggcatcagcactggagcatcgtgttgcactgccaccgaataaacttgagcttcacatccatgacaccaatgtcatcccaggtgatacttcatttatattcaaattttgcttcctcaaaccctttgtagaatgattagggtttaaaaatgtattgctcaaattcattcctagtttattctctccaaaattattagcttattttaaatgttttacttaaaaagtagccccctttaaggcgtttattacctttaaagataaatctatatctgtctttgtaaaaggttgcatgtacatagcagaaatttgtgcagataacacagagccacctaaacttcccaaactatggcctttcagagttaatcagtcaggccgaccctattgtcaaggctaacaaaagttgtgtttctgagtcatatatctgagtacataatagttgtctgtgtatttaagagtatagaatactcttggctcaaataattaataggcctacacagttcagagttcgcaaagctcacggctgctttgctgctaagcattcttaggattggccccaggaatcgcttaggcatgtgtaagtatagcccagcgcacacaggatgtgttgacttgttttggtgattcatgggcttattactaataataagagaagaaagtaactgctttggaggaactacaatgaaaacaaactcatttacttgggaacttttggctctgttttccctagtatgtttcacacctttgaaggggacttcaaagggagaaaaggagatctaggcctagtggcaagctaagcacagaggggtttcatctcattggtcttttctttccctgtcccttacagctcatttagaaacatcattaaacttggcctcactctcacatttcagcttgccattttattttctttttgagacagagtcttattctatttcccaggctggggtgcaatggtgctatctcagctcgctgcaacctccgcctcctgggttcaagggattctcctgcctcagccttccaagtagctgggattacagtgcccgccaccacgtcgggcttttttgtatttttagtagagatggggtttcaccatgttggtaaagctggtcttgaactcctgacctcaagtgatccacccatctcagcctcccaaagtgctgggattacaggcgtgagccaccgcacttggcctccagcttgctattttttttacttcttcagttatctcttccagccttcgtacagttatcagagttctgagttatgtcatgctttcctggaatgaaactccttcaaagcagcaggaacaatcagacacctcctctggggagcaactgggctaatagtgtctcacaccaaactggttttttgtagccttgctggcatctcagtaatcttgaataaacaaatgctctgaaagtggttatttcatttgagatatgaatgcatgactcacctctaaagcaggtttaaagaacctcctaggcgaaagcatcaattaacagcacacttagttgggtgttagtccagaactgactatatttgcacagaagagccataaaaattgctaccagggtggtggtacataaaaaatgacaatgggcaggctggctggaatccttggaacaaggtaaggaaattgaggcagaaagaggagagaagccacatgtgtattctggccctagttttaagttctagaccttcctgagttttaggttgcttctctgtcaaatgagtggtttgatctttaatctcctgtgatctgtcccaactcagacttgggtcaattgataggggagttaaaagaggcgaaaatacctagcccagtgcttgacgtgtagtaacttactgtgagataatggcagtggaattagctttctgtgtggtaggaaaatgaggtttctttgactattatctgcttgttatctttagacttcacttttggttcctcctttttcagcccagagtgaacatgttggcaaacacttgacttcaccctaccctgggtgtttgaactgaatcatacccttccggtcgctgggaaacagagcaagtaaagtgttaagttatatgtgaaataacatcctcttcacccttggcgctaccagtgagagagtcaagcacatgaaaactaaatttgacagggccaagtttgctgcttttaaagggcagcgtaagcgcctgatcaaagccactctttgaatttccgacagggagaatgttggttaaaatttctaaagtttactacacaagatagtgctaaaacatttaagagggggttggagtgccttaaagtgctgggtaggtgggtctcagtcccaaactgcaaattcctctgccctccaaatgtaggtgctaacggaattaatagagtgtttaacagaaagtttccctaggtcttaaagctcatccacctaggaggttttatctgcctcctgctgctctgccagtgggtgggaagggcagaaaggaaattactttgattatcctctgttttcatggtgccgtgtggcctcaacctaacttaggctttgatttgctttgtttcttctctagattttgttgttgttgttgttgttgtgtgtcctttttttttttattatcgttcctgtttgaatatgcaattttttggggggagggtgtgtgtattccttttttcctgtttgaatatgcattgtcttgaaattttatattattataagatacattcttttggcctaatgttgacatataggttacaaggaggtggaggtggggcaatgacaccgtagtctaaggcatgccttgaaagcttgaatcactgttaggaaacagccaaaagaaacaactcatgaaatgaatcaggcttctgaacacacaaaagcaaagaattcagtgcaaggtcatgagtggctcctccagaattccctttgtctgtacttagacttacagcaatagggatacaaaagccctctgcacaatttccccagatgaaatgagaaataaataaatgggaagagtaagcagtgtgaggaaatgcaagctctatgaaatgtgcaggctttgtggttacggcactttgaattgatattcacacttgatgtacgtagattctgtagcactggcatgccgtagctgctggcacctacgtgtggactgacgaactttgagaataaactccaaacttgggctgttgaggcctgatacattgtcatgtgaaaggaagcgagactgatttctgccataatggataacagagatgcatttaaataagaggattagtatgtctgcctcctagatggtaaagttaatttggaatctttcatggtacatgggccaaggagggtttgcacaggaatctcccttcttttcaccccttagtgatcactttacagtcgctctgtttaaccacagaaagaaattttatgaatgttggaagcagaagatggcaactcctaatagcatctagacatataggtttggatttgaaagtgtgtatgcttaggaaagaagtgaaggtccttctttagacaccactgtttttgtcaggccagccatctgcatggatgtgtacgtgcacacgtgtgtgcatttaaggcaagtactttaaatatctttgcacagttcctactgaacatgtaagacctttggaagcaatattgtccagctccataccaagtttaatttaaaaaaaaattttgtggctaataagaaaaatttaaaaactatggcatcacacaaatccttcatgcttttttgttttgttttttttccttttccttctatttcagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcattatgtgtgtgggtcttcatttgaataagacacaatttgaggcattgtaaacgtgtgccttttctcgtttatccaaagaaggatcatttcagatattccgaacgtgttttatttcaccatttagtgatatttacaaaggtaattttgcatattaaataaaacttcctgaccattagagtatctctttaagcaagacaaaattcctcatttatgggttattcatagctgggaatataacaagtcacacaccatgcgatattaagacagcatactttatattggaatgaatttagttttttgaaatcctcacgtgggttatattttgacagaaagctgttagagaaggagctggagttcaatcctcttttcatctgctgacatctgctttagaaatcatttaaagtggaaatatatgcatattatttctgtactgccacagaaaagcacaagtttaacccctcagggatacttagtttgttccaagctgatggctgtcctagctggctctgcataaggccagttgaagcctcctgcccctacctcatgatggcttcatgtcacactgagatgctcctttatcacttgggttggaacccttattgtttcagtgtgcagagcaaggttgggcataaccttttctgggtagaaaataaatattacctaattgggaactctaggagagctcacaagtaggcataatgcaattacagcctttggactttgaccaagatgccagagcagatgccttgggtttgacaggaggatcattcggttctgtgctgtgtgaggctggtctagagccaagcctttggggaccagtgtcagccttcagattccaagtgcatgatgttgaagacccgtggaaaccctgttgatgacaccatatggatgacaccaaatgacagggaagaacggcgggttagttaggagttgacggatgggatttagactcaggaaaaagtcttgatgttaatccctagaggggttgagaatggttcctgtagacatgattgtgaacagatctttcattctctggagttgtttctctttatcatctcagtcggaacatgtagacagattaaaaagatacttcaaattcttaattttcattcatttggaaatttcatttcatttagatagatcacaccaaacagtagctatggtaataaaaatctggccacagtaggcaaacgggttggaggtcggcagtccagggccgggacagcacccccatgaggccatcaggcctcatgcttgcaggatggcagctgcatctcatggcatctcatctgctttccaggcagcaaaagtggggcagacaaaggggaaagggctcaggccagaggacattctcccttttactttgaatagtaatagtttacccaaaaggctcaccgggagacttacacttacctctcagtagccagaactgggacatgtgaacttcccaagatataagagagcttggggagggcagaacttttatctggcacactgccaccccacagcaatgtgatttaattagtaaggaacaaagggagagcagacgttggagggggaaatacacagattattctctgcagttggtaggcttatctactacagcaatggttcccagcctttttggcaccaggaactggtgttgtggaagacagcttttccatggatggggactgggcctggaggcggcagggatgtttttgggataaaactgtttcacctcagatcatcaggcatcagatcaatcttgtccaacctgtggcccaggatgactttgaatgcagcccaacacaaattcataaccttaaattatttgtgattttttttagctcattagctattattagtgtcttttatgtgtggcccaagacaattcttcttctaatgtggcccagggaaaccaaaagattggacattcctacactagattttcataaggagtacaaaatctagatccctcacatctgctgttcacaatagggttccagctcctatgagaat

SEQ ID NO: 16001 - DNA, 317366 bp, Human
  misc_feature (1)...(317366): n = A,T,C or G
gatagctagctagctatatgtgtggatggataaatggatagatagatagatagatgatagatagatagatagatagatagatagatagatagatagttagatgataagtatataaatgatagcaagtctactgaagtatctttatcagtcatcaatcaccccattcaaaatgctgccaggattgtcttcttaatttagatctgaccatgtccaaactttaaaatacatgttaaaaatgttagacactctctcattgattccttatcttaaaaattacaatggcactttttaatcctccctgatctaacatatttatactttcttagccattccagattaaatactccatggtccagccacgctaaattctttggtattccccaaacattaattcattcattttatgactctcttttctaaggtctgctccagcacttaggtactgttttaatctatcatcttagtgtggctaatgacttggtttatatttgacagaaatcataacctgaattttcatttttcaaatatttttaaagtgcttcatctggaaaagagtttaaataattctcatgtgaaaaaccttacagagaataacataactaagaaatacaaactagtaggaagttggtgcccagatgcttttttattttgaaaagtcccttactcattgagtccaggaggtggcagtttcacctacaaagctccctttaaaactgtatgggtttttgtgcatctgattcaaatcctgtgtgcaataaagccacacccatgattctgtctgaagcctgctttttactccagacttaatcagtgctactttgggtgtgtcagccttctcagggacaatccttaaggtctctagaagcccttttatttagctgagaagatctttcaggctccacctgaattatttgaaatgttttcacagggaggtttgtagccacatccatgattgatatttatgttgggccatgtctttctggcattcgataatttaccactttgagagttgggagtttagaaacaattgtgttttctaacacaagtcctggtccttgtatactacttccctttactttcaaatggactggttctttatttagctcatctctttattgtagcaccttatcatatgcaggcagtaagagccaactgatgctttaacagtctgcccggaaatctccttactcatatgaaaagttcatcgcatacatgttctacctccccagttacctcagatgacagctttatcaattgttactcactacataaaatgggtagccatttttctagcttttcatggccatgactgcttttccagatactatctgccacccattgccacagccaaggccacgtattgtggggtttctgttatgtcataagttatttctctgtagcagtttctttcttatccttccacatttctttcactcatctcaagcaagctagcctgaattcattcacatgacgatctcagcactccaagagaggaagtagatgtcttcaagtgcttttcaaatctctgttgtcttcaagtctgttaacgacctactggccaaagcaagtcacatggacaagcccagattctagggatccagaaataaactcctgtcctttaaagagttaaagagtaaactgtgtggatataaagaaggtatttattagagtaattaatgacactagtctattacagatatttaggttaatatttattaaccaattagacaacattctctttacatattatgaaggaactccaaactgaaccaatagctttcagaggcagtgtttgaattatgcagtttaatttttgccatgttacatagtatttttttttgagtacatggtttgaaatgagtcttgcagatcttatgtgtgaatcttaatattaccctgacttttgactttgccaagggaacatccatagcaaagtaaactagtatgtttcaatgtccaagacaaaaaaaaaatgtcaatttcggtttttttttatgccttaggtgatatttgtgatcccaatccatgtgaaaatggaggtatctgtttgccaggattggctgatggttccttttcctgtgagtgtccagatggcttcacagaccccaactgttctagtgttgtggaggttggtaagtgcaaaatttaagtatttcagtagttatctttttatttccatgaataaatggcagtttggctgtggtgcattatggagattagttgtaaaattgctatatgttgctaattagtttacttttgtgtaggattctcagttgtatcatttccagtttatattgaaattatattaattgtgttctttaagttttaaaatatttttagtaattaacactaaatttaaagacattacaaataatacataaatataacatttcttatatttctaatattaatataaatttaacattttattctcaaataaaatacataactccaaagtcaatttattcaagttaaattatcactgtaaataaaacaggatgtttttagggacttcgaatatccatcagcattttgtagctgttctaatcattacttttcttaggtgataaatatattttatatttctaagcatataaagaagaggatattccagatgcagtgctcttcaaagttttctaaaaaatttgctctgcaaaaattaatgtgtcattggttacattcaaatagttttttaaaaaatctgcgaaatatgtatacttatggatttagagtaacttctgtaatttccacataggtccccattaaggaaatagctgtactttaaaataatttaacaccatgtaaacttgtgcagagattttctctctaactaaagagagaaataattttcaaagttaatagcacaggtaagtttgaaaaaaatttatatttttcgcattagtaccacgaagagtacaagatggaatatatctgttcattataggaaaccaaacatgttttgtcaacctgcataaaccttagagaaacaggacacttcaatggctttggggaaatagttttgaaaaagaaaagtaatagcgtccagggatcagtctgaattacccatcattgtacccagtgcacctaacttaattaccttatgcatagtaaaaatccagtaactattggttgaatgaaagaaagaataattaaataaaaccattaatttaccatctttggccattagttactggattgtagtgtgctttatttttttaatgaattttccttattttttatattgcattatgaatatatgttatctaaagaagtttattattgctgaaaggtactttgttcatttaattcatcttcaaagataattctcttttaatgcttttattaactcactgatattttaggaggtttgacacagtgccatcgaaataaaactgttgtaaccactttgacccaggcttcaaatatgtacatttgagtttcagagtttaatgtgagaatcatatcctcaggaaagtctgtatatctgaagaaaattagagtcataaatacccctagtagaaatgtatgaatagagtaaaattttagtgttgtattttaagcccaacaaccccaaattggcagtgccttcgagttgtataatagtatataatatttttggcactatttgaaagatccaaatctggaatcagagaaacaaatgtaggtaaatgattaagaaatcagtatcttagcagaatttttttttttttttttttttttttgagacggagtctcactttgtcgcacaggctggggtgcactggcacgatctcagctcgctgcaagctccgcaccccgggttcacaccgttctcctgcctcagcctccggagaagctgggactacaggcgcctgccgccacgcccggctaatttctttttgtatttttagtacagacggggtttcactgtgttagccaggatgatctcgatttcctgagctcgtgatccacccacctcggcctcccaaagtgttgggattacaggcgtgagcgaccgcgcccggccagccgaattttaaagtaaatacttgtatacttttgggctatacttttaaatattaatccaacattcaacattttatctgaagactgatactatgggcagcaacactttaaaaactaagcacgctgccatatcccacctagttcagtgtgactttgggaaattaaacgcttatagaattaaattctactcagattcattattacatattagtatacatctctgatattcagaaattggatagttatactgtattattttaagctatattttttaattatacatttcatacaaccctattcttctctgggctgtatttaggagtttttggaagaaatgtatttagtttgtatttgtttgatcatttagtataggatattagttacaccaattctattttcatgtgctggtgttctaacattaaaatactaggaaaaaactttcctaaagtcttaaagtgttgacagtttcttgaatacaactttcctatattatgacgtaatttttataaaggatcagaaaataatgagaaatcaagcacagttttcaagttcaatacctatttatgacagaaacattaccctattgcctttctactgctttttcttagcttcatattttcttgcatatgaaaggtgtactaaatattgattgcatagtaatacttggtagtaatgcctttaatatctagcttaccttgggtcttttcatatttttaaaactaatattgggatcaaatatttcaaacattagattactaaagaccatcctgcgtttttgtttcgaaaaaaaaaaaaaggccgggcgtggtggctcacgctggtcggtaatcccagcactttggaaggccgaggtgggcggatcacgaagtcaggagtttgagaccagcctggccaacatagtgaaaccctgtctctaccaaatatacaaaaattaaccgggcacaataacaggttcctgtagtcccagctactagggaggctgaggcaggagaatcacttgaacccaggaggcagaggttgcaatgagctgagattgtgccactgcattccagcctaggtgacagagagagactccatctcaaataaataaatatataaataaaaataaaaataaatggcttggccaaggcttttttgttattgttctcctgttgttatctagcaccaatgcaggaaacagagtgtattggaatttaaaaaacaaacaaacaaaaaacacatgtgggtattttgaggtaatatcttaaaagacaaaaaatatttgagctgtcactagtctgtatttttccttacatattagttaccacaaagatagagatgtgtctaaggtttcttctatccatttcagaccatatgaattttgagccatatatattatgaaattctgaatctttatatttttaatttccaaaggaaagaaaataatctcatttatatttgcttagaaaaagttgttttttgatcccagtttttaaaattatgtttatcctgtttattctacagtcagacacatactcttttcattgcagttcatctggaaaggagaatttcaaatgcatgcttagagaaaaacatttcatgattttacctcaaaccttactactttgcagtagctttgtttcaggttgttgatatttatttcaagcgatcctcatccagttttgtacttttattcttccctcacaaagcatataatgtcagataagcacaaaacacttaacacatttgcaatcaatactcacatcacttgcattcctgtgttacgtaggatagtttggcagaattgactttctcagatttgtgaacttccttcactagacaacattgcttttctctggacattttttgatatttctgtatactgcattctcattctctctctctctctgcctctctgtatccccacacacagctatcacacacctacacaactcaatgtgctcagcctcttagagttattaagattcacttctgatatctgaaaatggcagtaggaaaacttctcttcaaacaaagcaaagaaaaagcccttgttttaaattcttgaattcgaaggcattacccagattaaccagtgtttgcacagatgtgcactgaatgctgcctccctctccagaggatttgtggacagaccaccatgtggctaagccgcaaattgcttcccaattactcactcacattcctggatggcactgtgtaattgggagctatattatgacacattcatttcatgcagaaattttctattatctctctctctatatatatataaatgttctattatctctttccatatatatatatggccagactggtctccaactcctgacctcaggtgatccacccaccttggctcccaaagtgctgggattacaggcatgagccacctctcccagcctatcagtatatattatacagttcataaatggaaatcttgagaatttttaaattgtacaagttctgtggcataactatcctatgtgtgttatcagagtaatccattaaactagtaaaaagtataaacttttacaactcaaatacatagtatattaacgtaatcaaagggaaaaaataagtgactttttttaaacaaataaaatcttagttttcatttattttcaaacaaatatttattgagtgtttactaagtaatagttacttgaatggtggaggggcaatgataaacaagttgctgtttagatgatgagacaaatagatagacagacagacatacatacagacagaaagatggagatagataatagatagaaaaatagatgatagatagatagatagatagatagatagatagatagatagatagaaagatatgttgttatgtgttgtgatacaagtacctggagccataaaaatataaagcagatgtcttgctttaagctaagtgtaaaggaatgcatgccaacctgaaaaagtaacatctagacataaatctaaaaaataatttcaatctattgcagactaaaaactacaacaaacaacaaaacctattccagacagagaaaatagtgtgtagaataaccaggagattaaaaaaaaaggtataatgtcataaactgaaagaagttaaatgtggctaaaacttagagagaagggacatggtggccagcactgactctgaggatggtgacaagtggcagatactctagagtttggtacagtgtttaaaaaaatttcaactttttactaagaaaaacaagagattttgtatttctgttggtgcaatatggaaaacaaattacagcaaaatacagcagggggacaatttgaaggcaattgcagcagatgaggctagacatgatgatcttggcttctgtcaatgtggtaactaacgggatgaagaggagagagtcactgagtatttagatgataccatagacaattattgcttatttatggggtatgaagaaaaagagtttgggagaaactaagagtaaagaaaggcatccccagtttctggcctgagcaactgggtatcatttactgagatattataaatgacaatacacaggattgggaggcagaaggagagttcagtatttcacatgttgaatttgacaaatttgatagacattatctaagaagtcaagcatagatgtagaagtcataattacatagatggttattgaagcttagggaatggatgagtctgtctagaaacaggataatagcaaagaatagaagagctagacatgggaaagaatagaggaattagaaatacaaagcggtaagaggccatcaatatttaagtgataggcagagaaagtgaaatctgtaaaggagccagagaggcagagtagtcaggtagaaggaaaaccaggaaagtgtggtgcacagtaagttcaggattaacaatgtctcaaggagtgggtaatcagcagtgtcaagtactgtggagcagttaagcaagataagcatttcctttgattacatgtgattgatggatgatcttgttggtttacggaagattagttttgctggcgttgtggagaaagagcttgactgtggcacgtagaagaatttgtagaaaaaaattaaatggctaaaacaaacatttgtctatttatttatttgcttactcattcatctatcaaatatttgagtatcagctatgtgccactcttcctggcactgaggatatagcagttaaaaaatggtctttgtcgtaaatatgtgtaaaatattgttaaaatgatcagacaaaacaaagaatataaacattggaatttggtagtaatataagattcattatcacttggaaaaaattaaaagtatgtgtattattgacagtaggtcagtacaggataatagtactgtatattattttatttataatttctttttatcttctctgtaattacattgacatctggccaggcttctcatttccaaatatatatatgtatagcatatcatgtaaaaaatacatatatatattcaggaaaagttattttattctgttttatcttctcttatcctcttttacctatcatattccatagaaacttatttccctttggtaatgatatcccttttctaccacaaattcagattctattaaatgtgttaccctcctatattgtcactaataatctgttcctcagctttcattttattatgaaaaattgaatatatttatcccagaaaatacagactgtcatacacattttttaaaaaactagaagttgactgtacatttcactctatgaatagccatattcatgtttatctttcagaaggcgatcagtgtcagaatatcaagtagtataatagagtctgacgttgtccgaaagacttcttgttagtgttcatgaaatatcagaaagttaacgagccttaagtagctctcttgggtggtgtagggttattttagatttcgagactttggttaccaaatgagggatttggtaaatttcagttaaatttttcagatagtagatgaaattgtgagtagttgtcggggtggtttattttcccctctacttaagattacttcttagactcatgattgaatccatttttctagaagttaccataatgagagctatgtttcacggactaaaatactttctctaaagctgctagccaatagatgattgctaagaaattttccagtcaactagggtcaaagggatttattttcacagttatgtttacttacttttctaataataagaaagggtaaatataagttcatacaaacaaatataattgtgcagttaagatgacagataattaagggaaagttttcgtactaattttgcatatattatggaaaagtaattatattttatatgtgtaaaaattctgtaacataccatataaactcattagcttattgatgtaaaaatatttctgctttattaataatgacaatgattagaatttgttagtttgcaattccaagctgtgacaattatatgttaactttcagaaagaaaaaaatgtataacatcaaagaaccttagatattattgagtaccaaaagccactctagcccagtcaaagggtaaaagccagtttgtggtaaagcttttatttgtaagaaaagacaatgacccattaagaaattgatgtatgtcatttaaaccactgtcctttcttctaggagtatgtccttattcatagggaataactgcttttgtatttgaatgtattttactgcctaacaaataatcacagagtttaatggatttattaaaaaataatcatattatctcagaagtgtgtgagacagctaagtggatattcatctctggaacatcttttacgtctttgttgcactcatatctgcgtctgcagtcagctggcgctggatagaagatggttaactgatctctactattacgtagtggcagtggcaaaggtgtcaagagtagtaagaaagatcgagtcctaaaaggcacttttcaaatctcggcttgcctcacagtagctaacaacacttttgaggggaatatatgcaatttcattttacaaatgtgcggatgcaagaaggggaggagtttgtggctagttttacaatctgctgtggaatgttgcttctctttttaattttatttttgaagagttttattggcaaagcaacaagttgataaacacataggtatgtttgcagatatttctttttacgttatacacaaatatatggccatgattacacaaatcctaatcacattggctttagcaaaagctcttcaattatttttataaggagtaaaaaggtaaaatctcttaaggaaaaacttagatttttttttttttttttttacattttagaaaaaattattgaaaaaataggaaggtgaaaattgaaggtaatatcaaattgcccttttactcctaacctgaaatcacttgtggcacagccaaaatatataattctatacacttatgaaaatgaaaattacaaattcaaagtgataggccacagtggcaaatttagcattaatctctggaaagattttatcttccagcttttccctttcatggaaaagcaatctatagaagactcacaaatcacttatatgatactatgtaaaacatgccaaaaatctttacaatctttcattctgttacttgatttcatcttcttcattgattttcaacatgaatctatttctttattctaggaaattatacctattgttatttcctttagattaagttatttgcaccataaactatggtatccaaataaagcaagtcatttaaaaaacattaacttttaagcagttatgacaaggtgttgaaatgttatcatcagagaaattgagatttataatgaagaggaagcttaatggacttatgctcacttattcatagtaatatagatttggagttatttgatttgtataataggaaaagaaaaatacacatgaagagaaaaagaagagattgttgtcctatcaaatatattttttaaataatgtgattatatctcctttaattttcattcaaacatttgattactgtagtaggccataaaacatttaaaaaagggtaaactagaactaggcgtatataaagaagagtgaagagtttagttaataaaaactataaagaaagggacattctctaaaatcaagaccaatgagagaaggaataagcatttaatcaaagaaagcttaaatcatgttttagagcatctacagcagcagtccccatcctctttggtaccaaggactgggtttcatgaaagacaattttgccacagaaggtgggttggcattagattctcataaggagcacgcaacctacatcccttgcatatgcagttcacaatagtttgtgttcttatgagaatttaatgctgctgctgatctgacgggaggcggagctcatgcagtgatgctctttcacctactgcctggttcataacaggccacggactggtaggaccccaatctaaagtatggaacaggcttagggtaagtggacaaagaaagcttagggtaagtggacaaagaaagtaaagggctaacggatgaatgacacagcctttgttctcatctttcctcatactactagtaacacagaagatagaatgaagacaaagatatgacactttaagaattcattgaaaataaatgttttggcctggagcagtggctcatgcctgtaatcccagtactttgggagaccaaggcgggcagttcacttgagttcaggggtttaagaccagcctggccaacatggtaaaagcttttctctactaaaaatacaaaaaaaaaaaaaaaatagccaggtgtggtggtgcacacctgtaatccccgctactcaggaggctgaaatgagaattgcttgaacctgggaggcagaggttgcagtgagttgagatcatgccactgtactccaacctggcaaaagagagagactgcttcaaactaactaaataagtaaataaatacataagtgttttgataggttggattaatttcttgaaaattttacagactcctgctgtaacatctaatacaaatcttattggtatctcctatgtgctagaatcatgctatttgatatgaggaattactacaataaagcataagggttactgagatgaaatagaggcatggattctttgttaaagagcttaaagtagatgtcatcgtttctggagttttgtttggccacattccccggagccatagaaaaactaggttacatctcaaggtgactttgtactgtaagacaacttattgtttaacatatatcaaagtatttatgtgaagaaaattccataatccatatgcttaaagtacatgggtaacaatttttaaatgagtcatataatgagagtagaattgggctgaatcatttccagattatatttaattttggcctttgagagtataaaattaaccaagctatgatttaaaatagacaacaatcaatatttattgttatcttctttttattttaatcaaggcctggaaagaaaaatagggagggcaaaatttccatctctcagccagagatagaacccagtaaagatatttgttttcttacgtactaatccttggaaaatatagcaaatttcaaataagaattaacacctttttaatacaatgtgttcatataaccccacaatgtctttatctgctaaggtttcattgtgaaatcaaaccagaagtgcttcatccaaatcacagggagccactggacacagaactcattattgttactcatctacacaaggagctacaaacattttcaagaacaagacacatgctgtttgtgtcaacttagctatcttttaaccaatgactttggctcttcaggcaatagataaattggagtgcatcacagcacagcctctggcttccaaggttagatttcattacttcttaaatatggaggtccagctgtattactttccacaatgctttcctgtcccacaactaccgtagtaaagctcacttctcaatgagccctgctggttattaggacatcaggtgataaacactgaagtgtgtgggcagatagtctttgtatgcagtttatcggtcactgtaatgccaaagacaaagacttttttcctcacccttttccctttaattttgcctgtattttcagagtgcaccattcatttacacacacacacacacacataaaataacctgaaaataaacaagggagctaatatcaatgtcagtgttaaacgggaaggggattctgtgataaatgtaatgattagaccaaggtcattgattcctgctcagtggaagaacaggtgttaaacctacaattttgttccatgctttttgcacactgcagtgcttgtgttcaaattaagctgtgcctgttacacatatggggagggttactttcaaactcgaagaaataataataataatatttctttggaagtttttttttttttttttttaagatagggtctctgtcgcctatgctggagtgcaatgatgcaatcatggctcactgcagcctcaatgtccggggctcaagtgatcttcccacctcagcctcccaagtagctgggactacaggtacactccaccaagcctggttagtttttgtactttgtgtagagacagggttttgccatgtcgcccaggctgatcttgaacttctgggctcaagcaatccgcccacctcagcctcccgaaatgttgagattacaggcatgagccacagcacctagccaaaaataatacttctaattccagtgtttcttacatgctgagcatgctctactggaattctgtagtgtgtaaatatctgaaggaacacattctttcaaggacagcatcatgggggtgtggttaagaagctagccaggctgagttgaaatcttggtacttctgtttgctaagtctgtgactttgagcaagttacttaatctctctccaccttactttcctcatctgtaaaactggggttaacagtaccaacttcaaagggtttttgtgtaaattttttttttttttgagacagagtctcgctctgccgcgcaggctggagtgcagtggcgtgatctcggctcactgcaagctccgcctcccaggttcacgccattctcctgcctcagcctcccgagtagctgggactacaggcgcccaccaccacgcctggctaattttttttttttttttttgtacttttagtagagacggggtttcactgttttagccaggatggtctcgatctcctgacttcgtgatctgcccacctcggcctgtcaaagtgctgggattacaggcgtgagccaccgcgcccggctgcttttgtataaattaaatgattcaatatatgtaaggatcttaaaacagtgtctggctcataagtgccacccaggagttactaattaagtgatataaataattaaaccttatatactattttaaagctacatgcagaaatcaaacatctaggcctctgactattctttcatcattttagtcattaataaaattattgaaatgtccaataagtactgacttattatttttatgtcaggttgttttttttttttcctgttggtgcatgaatacacaaactgggggcaatttagttgtcagcttttaatttttcaaaaaatttatttccttcaacatataatttgacaaatcacttcatttcatatgggaaaaagagagccctattttttattatatgaaatttatgagtaatgtaggtaaggcttgcataattaggaatcagtcctttaggaatctagccttccttatgcttagagcaaataagttatgaattgatttttttatttataagattgcaaaatgggaatcctgtaaaggtataataaataccaagttggaatttatgatagcacattaatattagtttcttggatatgatagatcaacaataagctttttgtggttttgcataaagatagaatcatagggaaaaaagaacattaggatcttccatttaacaaatgtgtattgagccttcatggagagcctgtgatctaccctttctctatgacctgatgataaagactctgccttttaaatacttacatttgagaaagggtaagacaggcatatcagtaatcattatacaatgcagaaaataattatcataagaggggaacaaagtgctatgggtatcaagtggggaaagatcacttcctgtcctaggaatcagattttatggttgtggtggcttttgtgagatgagctgagatggaaatttatttaatctgtagacattatgatattggaacattttaagcaaatatagaatgataaaaaattagaaaaacaggagacatggggaaactttctagaagaattagcattagtggttgctcagtttataaggtgttttaataggagacatggggaaactttctagaagaattagcattagtggttgctcagtttataaggtgtttatggggaggattgggagcaagaccaggaaggtaatgtggatctgtattccatagagctgcggtccccaacctttttggcaccaggaaccagtttcgtggaagacaattttttccatggaccggtggttggggaatagtttcaggatgaaactgttccacctcagatcatcaggcattagattaaggaggccacaccctagataacccacataggcatgctcacaatagggttcctgctcctatgagaatctaatgctgctgctgatctgagaggaggcggggctcaggctcatttcctgttgtgcagccgggtttctaacaggccagggacccataccggttcatgccccatggaagttggagaccctggatatagagcctctattcatctccttgaaccaaaatatagtcttcaatgttatttccaaaattatcccagaaatatgactctataacttcccttgataatatattattcaagtgtgtaatcataaaaacaaaagaacacaaagctcttatctgaacagcatttaagtactacctcaggcttttcttttgaggattacattgtttaaattgtacatttttctattacagttttattctgcctccaagataaatttattttttgatttattaattattttatttttgacaggacttggtctaataggtagttgatttggaaagggctgaatgtggctcattgactgaaattgatgctaagttttaatctagaatttctaaccagaaattagttattggaagaaacagctgtaaacttttaaagctggtttccaggagaaacatctacaactagaaatgtcagttgacatggaaaatttcatgagaagctacaaaatatttatattctgctggatggacactagttttggacactaaggaaattgtttccattagaacaaatgtttggttttcctgtctgtggactttaatcaactacatgtgaaatatatgcaaactagattctttgctagagagaaagtgaaagattgaaagtatgtctttaaggcttttctttgttgcaaaattttgcaattctttcccgttgcaaagatacctttgacattgtttgcatgccagttatattctcccttgactcaaccccaagcatgacctcctctgactaatcttgcctttaggcagcaagaagataagattaccagttcccagtactctaggaattggtccataagatgtagctgaaggttccaagtttttgctattgtgaatagtgccgcaataaacatacatgtgctggcacatgtatacatacgtaacaaacctgcacattgtgcatatgtaccctagaacttaaaatataattaaaaaaaaaagatgtagctgaaggagggaaggaaaggaaattaattctttacaatgttggattgctggttgttataaagccgcctaaacaagacaggtaataacaccattgtattttgtgctagttagatcacatctggagtactgtttccattctcattactatattttaaaatacattatcaaatttgagtttatcaagagtaggtcaacaaaaatgatgactagggtgtatataccataatatgtaaaattaagtagggatatttatctcagttaagaaaagaattacaatagcttttaaatatttgaatgactggcctgtcaaagaatgggcctcattagtccattgttttctagaggtgagctctgggagagagatatgacatgttccttgatgagattttgagttccctgcctctagaaattttgaaagatatatagattttttggtccgcagattggatctgttagaagggtagaaattaatagtttgcattcaagacttgaaaatattctaaaagattagaaaaatgtggtgtgggcccaccctgaatagtcctgcacctttattcaattttcattgccttaaagttaggcctgtctacttttttatcagttgagttctttaaagacatcccaattaaggagaaatttagcctagggagacaagttttgcagataagaaaattacattgtcaatgttatatgattaacacccaaatgtggatacactattttcctttcaagaaggtcctaatgattctgaaaaaaaaaaaaaaaaaacatttaattttagctcctgttgtaacaggaagaaaaaaaatcctctaaagcagtcattaactcactgttacataaaggcagtagcacattagattagctctacgtaatcaagcagaaattgtgctttatttcttatggttagtgtccttgagatgagttaaaactacatgaaaaagataactccccctgaccaaaatgacacgtacagatttcacggaaatatctcatctttcttcaagttagacctgcccactgtttttttttcttcccccttcatcttttgaatttcaaaatatattttaattaagccaaatgtgtcgatctatattttgggaacacatcatttcaaagccattgtaaaatttctgaattattttggaatataagcaatgaaaaggcaatgatattttactaaaagacctcacagatattaaaatggtaaaaagtcatgtttgaaataactgtaaccatatgaaatacttggttgtgacacacacacacatacacacacacacacaccgtttgccaagattctaccatgaagtaattttctatctttaaattcatcaccatttattttttaaaagcattgaagttttatattatttatatctcagaagacacagaatattcagtattcagccctaagcatctctactggggtgggatgatgggcagggaaaccagtaattggtctaaggctgcatctgccaggcacatggatcagtcatttgtttgtctctgtgttttgtgctattggacatcagacattggaagttttactatatctctgttaatggtaactttattaaagcaagagagtaacattcacaggaaaatggcagaaatataatatcatccaatatatttaagaagcatagtcctttttttaaaaaataggctgatggcatcaaaaaggatggcatcaaagaggatcttttaaaaatctttcttacaaaaagcaaatattttacattgtgtttaggattatggactttatttaataaaagtattagataatttattttctttgtttctaccatgattcaaatgaaatctgattattcattgaaacctcatttataagacagaagtcctggaattcatccaagtattattcactaaagacttagtgaaacaaattatgccatatccatttacttcaaaattctgcttgtggtgaattttagttagtaatttaggtgatttaataaatatacttctattttctaatgcaaaccttaacccattgtaccaatggatttttttttgacaacactcttaatcattaagtcttgtccagcattaacattttatgtgcaatgattctgtggttttcttaagtggatactgtcactgagatttgtgccagtattgctgatcaattcattactttttagttttctgttcttttggttttagcagatttgctttttagattagctcatttgtccagacttagggaaatgaattgaggttgaagtgagtagtctcccacacataaataaagcagaaatccatagaacataaaggagcctgagagtatcagcttcctgctgtcaggtgctatgaaacaaaataacatggatgctgtgaccatctgaaattcatatctagtgagctggtagcctcggcttcatggcttctctagtgacattaaacagcattctcattgtagaattaatgattctctctttcctgtattaaattttcaaaaagattatgaatttattaattttattgaaaatggataaatctgagaaatcatttatattaacttttgatctgctttatcccttacaagtttcttcgttttatttgcccatgaattttcttaggtttaattttcaatcctcattttacaaagctaaaaaaaaaaagggtaaaaacagtcattaaatttacttttggacttcattttctcaatttaaaattggacaactttccaaaaatatttactcagaaccaattatatacactgtgcaaaattaaaacatttgccctccaaggaagaataatgtccagcttgggaaacaaagctggaaaatattatgtaccattctgtttagaactggctttcggttatagtttaaaaggtagtggggttagaagggaatatctggagactgaaataaatactaaggagttgaaggtggtgaaacttgaattcagtcgacaaggatggtttgggtttggatagggaggaagggcacatttaataaacaaaggatatttaaggacaattgaatagatacaccaaaatattgaattgtaagtccccttattatatcaaatcacctaacttaaagatatttactacttcctttaagtaagagaatttgtcctaattatgttctcaaagactaataacagctgggatatgaatgtaggctatttgagtcatattactttccagcttcccagtactctggcttacttttataaaatacgtgtttttgttcagtttagttttagttttcttactcagtggcaaaaattgaacccaaagcttgcattcttttttgttatttttctcatttatacctctttctaaaatgagagaatcacaaatgcactggtaattgctgttaaaatgattcactgtataaatacattgtaaaacccatgtaaactatatcaccactaaacattaaaagtacattttgtggttctgtttaaatgaatctacttaattaataaatcatagtttcatgttttctgagttagtttaaaaatcacagatttaatttttcatgagataatctaatggtctttagagcaaccattgtctttataataattatattgtttccttcctaccccaagaaggaaaatctgatttatataatgacatatagctatagaaactatatataattatgtatatatttatatgatgaaacatatacagagatgtaaggctttctttgattaatttaataatattacaaaatgaagcagctgagctttatttaatacaaatgactgtattaaacatttgtgtatcttttctttcaacaaatatttattcagttcctccagtgttccagacactgttttgaaaactacggatgtaatggtgagcaaaaaaatgctacagccctgtcctcatgaaactcttagtctaatgggagagactaataaaaattcaatatatgtttacatgctaactacatgtgtacaaaattatgttttatgtgttatatattatcaatacttcaatggatgccattctccaaattttgcacaggaatcacaatgcatgtaaaatgttgatagaatggaaacattttgattattcaagcattttctatgcaaatccaatgctgtgcctcacagtgacccaaatactctgcagttctgagattgtggagttgaccacatcatatgctgtctgaaatatttggccagaggaaactaatcatctttgttatacttttcacagggaagaagttagtaatagcaacctttaagtacaaagtcatatcccagttgggccattggccaaggacaacagataaacaaataataaaacaaaaaccaaattaacccaaacctctctctcagtacttctatggatacgtccgcaggcaactccatatccttctttaatgactgagttcacaaatttaaataatagtttactctaattttagtaatgcctctgcttccctcaacacacaaacatacacacacatgtagagcacttgacatctgggtaggcataaataatcaagcataaatatcatgattgctatttttgcatcactgcagttgaataaaacattgtaaaatattgtcagaatacaataatacatagttcttgttatggaaataactaatgactagataattatatgcttgaaaacatatttggtacatgcttaaccaaatttatgatatagccaacaaaaggatcaataagtcactctgaattaacattcacatgtaaaatatgttataatatactaagaaatgtagtttttatatttcataatgagattttcctatttgatggtaagccacactgggtgtaaaattgtttttaatgggtataatttccaagttataaaagtttacttaaaacactcaaaaatgaaacagacaaaaacagaatatgtaagaattgttgaaaccacacaaagagactggaatctgtctaatgaataaacttaagtgttatagtatcgtgttgtatcagggtaatatacggcccactgggcctgggtagttgtacttcacagttgatacttgtggggaaaaagagaaagagagtgaggaagaaaggaaggaagtcaaggagagtctgtatgatgccttcctgtcctcccaagtaccaccacacttcaggaacatgggaacatgtacactggtggaatgtcctgcaaaagagcgactaacttaaaaatcaaggaataggtttattgtatcaaagcatggtggtaagctccctggaaaaataaagcactgaaatctcagctgcccactgaatgcatagcctgaggctgtgtgtacttctggtctcagctgcctcagataattaatttcttatgcattctaatatttttaaaaggaacaacaaaactgattaggattgtagcagattgccatttagatgtaaataacaaaaagctcaactcaaataatacacagtatgtattttccctagaactagaagtccaaagaaaggtcaggattcatggttgatatgattcagtggctcaacaatctcatcaagattctaaaatctttgtttctgcactctgcctttgagcaggatcagctttcttccagatctgtctcccatcatggttgcaaggtgcatgccaatgacttctggggccacaagcctctgtgtctacatctaaaggagagtgagaaggggttatttccagacactttctgagaagagtgaggaggccttttttttccaagagcctctccccacctaaatacacacaaatatctccttacatatccttgtccccaaatgggtcacatgcctatatctaggccaataactgtggccaagaaaagggaacagatttagttagttctgagatacagaccatttattaaatccaaaggggatgtcatctttccctaaagcattgatataggtacccaatgaaatctgaagatgatacaagaaaacagtgttgaaatctcgtgaaacaaccggaatataaattgcaaagggttttctgtaagcctactaatttactgctgtggttccaacaatggtacccatggctgtttcccagtgaaataaactttgatgggttagagtcagaattctcaatatttagtgttcgtggcgattatctacagaacttataaaaaatgcagaagcctgggctaaaacccaatattcaaattcagtaggtgtggggcattttaacagacacccaggaagattctgttatgggtgataggaggattacacttacttaaattctatatgtctgatatatttttttacctctgttttcctaccatcattataatttcagtacattcttctaaatgctgaccaagtggagcaatacacttatttgttgggttgcttatttttggttttcttggtgaatgtgtttaaattcccagaattagaagagactacatgtgccatagactctgatttttattttaattgctgattttatgacttctgagaggaagagagaataatcatttgggtagcatgatagtaccttctgtgatacttgtttcgcagaaatgtcattaataaggcaactaatgcccactttgaggtttatttttactctggggctctagttgccacctgttaatagttgatgatgttttgttcagtaaagcagttagcctgaaatgctgcctttgttacagagataactaaagctggattattaccaatagtaacccttgtgtatatgccttcatgagtgtgaatagtatgaatattggttaatgacatctacccatatcaaggaagcactgctatgtagatgttacatagagaaatctttgcaaagttgtgtatttgctggctgtaattctgttaatttgtaacaaagatactttcaggtattgcaaattcaagtgtagattggtgcacagcttgccctgtgggatttgctttttcaaaggttctgattactatgactcttactaaatttggaattgtcttcatttctgtacttgctaattccttcctaaaatttcttgcttgttcttacataatggaaaagtaaaatcttagcaacttccagtcttccttcttagacatcacttctttagggtgctttgtttaaccagtcaggatctcagctgcctatgtctgtccctggattgtaagggaaatggagaagcttccaaagaactccatttcttgaaaggatttctctcctcagcctctgtatcaatttttctttcttttctcccccagttttatgcttaagtccagctaacattattaggagcataactactcccatgacccaacactttaaatagtacctagtgaatttcggtaaactctgccgtctagtttttatctttaagtagaaacggaatcagcactttgtgatacaataaggcacagcagaagaagttcagttttaaagtcacactgacatgagctcaaattcaaattgaactcacacagattgttcagtcactctgaacctctgtactttcttttatcaaatgagaaatattttcatctcattggttgctttgtgaattaaatgagttcatacacataaagtgaccagccataagtgtaaggattttttttcttttgaatctctagattttgttaacaataactcatctaagtcagcacttctgcaagcccctgtggtattttcctaaaagggaattcctggaagctaccattttttttcctctttgaacatgttatgatatattttggacatgataaagcggcaaacagcttttaaaatatttatgttctctgcgccatgcatgccaactgtgtttgctctctccatttctttatgtgccaaggaggcgagccaaacagtgtgagaagaaaacactgtcaggacacaaagtcagcttgtctaatgtgtactctgcgcagatgtaaccttaacggaaaagagtggagaccactccctggctacacagtgataccttgattaacgaatccgctgggaacaaagttcctttataagcaattcagctgagtaaatttttattttaaaacttcatgaatcaagtgaaataggactggcttgtgtcatataattcaacggtaatattctgggtaaactgcagttctgtacagagcagaaatacttcttcacagagtgtgtgttgaagtataaaagtgaatagatggattctaggcaaaattgtgaagctgcttcagacaaacttctttttcactcttgtaattgctgtgctccatcctccacatacacagggcagtaggttattgcccttggaatcttgctgctctcaaaccttcctacctcttaaaacaggaatcaacaagattcacacttgtatgagttacagttaatgttatcttacattgatattgcctagtaatacctcaatcctggctacaagttaataccatgtaaagattctgacttaattggttctatgtggagcccagaatttggaattctaatatacttacagggttggtaaccactacccaaggataaaattgtattttcgtattgtggcctcctcttttataatgtctatgtgtatccatatgtgggttgcagaacataagtcagaaccacctggggtcactctttaaaatgcaggttccggtgtccttaccacagaatcatcactactaaattttgaagtgtgtggtatatgtaagtgtgtgtatgtcacacacacacacacacacacacacacacacacacatcacgtagtgggagagagagagagagaactggaatcttcatgtttaagaaaagtccaggccgggttcggtggctcatgcctgtaatcccagcactttgggaggcccaggcaggcggatcacctgaggtcaggagttcaagaccagcctgaccaacatggagaaactccatctctactaaaagtacaacattagccaggtgtggtggtacatgcctgtaatcccagctactcaggaggctgagacaggagaattgcttgaacccaggaggcggaggttgcagtgagccgagattgtgccattgcactccagcctgggcaacaagagtgaaactccatctaaaaaaaaaaaaaaagaaaagtccaaagtgattttgagtcaccctgaagtttaattcttcctttcttataacttctatctcatggaacacaatttttgaccatcagccatgacttttaattcctctttgccaaatagaaaattgatggtggggtagctctatgttatatacaatccatatttttcagcagcaatatttataataatttatactcaaattaactaaggttaatcttatttgcaaaggaaaatcaaattcagacaattcaatttttttctaacaaatattaatagatattttaaagtataggagcacatatgtttttatttaatgtgaatactcattaatctgttattaaatcatgacaattttctaatgtatacacaaaattacaagtcaggggcttgtagttagtgtttggaaatgtgaaatatatttatgttcaatctcaatatctctttttctctttctttctctctccccccttctccctcccttcacttctaccccacccccatttcaccttttcctcttatcatagcatcagatgaagaagaaccaacttcagcaggtaaagttcctatgttgtaaacataattcttatttaatgtcatgcctttaataatagagagtcaaccttttgagtaatattttttcagatttcaaccagaaaattggcacaggtttgtttatttatttacttttatatttgctgagctcactatgctgtgccagactaaatgatgttggttaagagttttgaataaaaggagaaaagtcttgaaacgaactaatacagaggaaaatacaatacaaaatagcacattgacattaaagaataaggaaaattggaaaatgagaacattgagaaaaatacagaaaaataatacagtgaggagaatgaatgataaaattaagattaaaaaggaggaaaatggtaaaataaactttcagaaatacctttcatgagagcatacagcactatcacatgtataactagcatcaaacatcatattcactaggcttaagggtactgtgtctgcctcactcattttattttaaaaatgtaatttttacaattataatttaataatcctgcaacttggcatcatgacttagttccttatccagctaattagtatttatcaaacacaggctgtggcctgaaccatgtgcaatgaagaatgcaaatgttagagatggcatggtattttccacatggttccaggacagtgagagaggtcagagaaatgccagagagactaaagaccagacacaattataagaatataatgggaagaaaaagctcacttgattaattaataaaagaccagactaacataccagcaacatcagaaaaaaaaatagagtcaagtcctgagaggtaggcagttagtggttggtctgaagagaaaagacctcggcattagatggattctttttagtaactgagaaaaggatttaggcctgagagacaagagcaggaaagggctcctgaaattaatggtcagaatggtgcttgcttatatggaaggagggaaagtagcccagttattgaaactcatatacaagatagggtcagttcaattcataggcctgacttacttcaactagcctggcttcatggcttctatctctgtgcaaaactggacaaggattttacctgtaggagtaaattcaaaagatcaaagtttcagtggaagaaaacaaaataaatatcttacatttctttgataaattccaaggatatataaatgtcatgttgcatgatactcattataactataaactgcctttgaaatggaatcagacattcagacaaaccctcaattgatgtttcattttcataatattgttagatagtctatagcctgattaggataggaactcctatcatatttctcccactctaggcagtattgtgtagcctgttttaggaccagcctaatcacatgactcaatagcaaactcatctgtttgtgagtttcctctgcctagtttctgctttctgtttgccctgactttgaagctttgctgttgatagtgttgcccaaagactctgtctgtatgtctgtctattgtggtgtattttttctatacagacaacccatatacttgacacataattcaagcaatacagaagggtttgtggttaaaagtaaggttgctatctctttttacccctagtctcttagttctcttcctgagaagcaacccctgttaactttttttttgaggcctcttccagaaaaactccaggcctgtgttgtccaatagggcagccactagctacatgggctattgaacactccactattccaaattgaaatgtaatgtaagtataaaatacacactggatttctttattattcttaatttaacttttactttagttacagggggcacatgtgcaggttggttacatgggtatattgcatccaggtagggaggatagtatccaataggtagattttcaacctacaccctcttcctctcctccactctctagtagtctgcagtgtttattgttcccaggtttacatccatgtgtgctcaatgtttagctaccacttgtaagtgagaatgtgtagtatttagtattctgatcctgcattaatttttgaatcatggcctccagctccatccatgttgctaagaggcatataatttcattctttttcatgactgtatattattctgtagtttatatgtactacattttctttatccaatccaccattagcacataatttgattccatgtttttgctattgtgaatagtgcagcaatgaacttatgagtgcatgtgtcttgttggtataatgatctgtcttcctttgagtacatacccagtaatgggattgctggatcttacagtagctctgttttaagttctttgggaaatctccaaactgccttctatagtggctgaactagtttacattcccaccaacagtgagtaagtgttcccttttctccacagccttgccagcatctgttgttttttgattttttaatagtatctgactggtgtgagatggtatctcattgtggtttttgatttgaatttctctgttaagtgatgatgagcatttttttcacatgcttgttggcttcttgtatatcttcttttgataagtgtctgtccatgtcctttgcccaatttttactggggttgtttttttccttgttgatttaagttccttatagattctggatgttagacttctctggctaggacttcttctgtccatatttcttaactttaattggactttctctctgggtgtcaatccttgacagcagccatcattttctagcccaattcattttcatttctcctgtctgctgcccacaccttactaagtcatctgccaagcagtgttggtgctttagcaaaattattgttttgtacgaagaaaatgaattgtaacccagtgtatgctatatttaagtataatatagctacttgtgtacttttcttattctaaatctattttcataacttctctcctcactaagaaggcctttttgtgaaatgcaactgaacattttttcttcaaaatactcatcttcctccagagtgatgtgcacatcatagaatttaaattatgttttaaaaatactttcatttctagatatgagcagatgtttttgttgtgattttagcatagatttttaaaatagaacaaatgtgctcttaaggaatatttagctacataatttcacatatggattatattaacattgagaaaatgtgtcatttagtaaagtagacactccttttgtataaaaagcagacaatgggaaacaaatgttttccttttaattttatcaacctatataataaaaagagtaaattaaaacatttggcaaaatattatcagatttgcaaataattgatttcataaggaatacgaataattatgaaaattggattgagatttttgagttcattttagtatctcttgccctgaatttttcaacacttaattttttaaaggaatagttattatcctgttcacttatatttttcagtaatcatatatatcagatatatatctttaatttatagctgttattcatgtttgtttattacagcattaatattctgttttcactctcatctcctttcaccaatagaattgatgcagaatggtattttccaagctgagatttatttttgtggtcctcttttaacttatgtctctttcctgttatttcaccattttgtttcagttatcagtgaaatgaaatcttttgtttgccagaaaaaaatgtacgttaattcagctttcacatatccccatataatatctttaccaggttcatactcttccagattggacagtgtcttcttcaaatatatatgttaatttctttaaattaaatatttatttttctaattggagataagccacttctcaaagtaaagtaatagaataaataatacaataaatagcgttttttactgccaaaaatcacagcatcctgattaatagttgttaatgtatgaattttgaattttaaaagcataattttttgaacaaatctatacatgacttatctaaaaatgtaagttcctagtggatattaccactcatactatttagtaaacatttttaatgtattgatattgtatgacaaatctaggttgttttaattctataggcacacagagttgggtcgattataattcaatagttatgatctattctcattgtttagaactatttttaaagtaaataatagatgtttatcttcaataacatatagaatgaaaaaaatcaggaagacaaataataaacgagaaaattagggagacattagatagtgttttacttgtgttataatgctacaaaataatatggatttttttctttacaatggaatacaattgatttgccttatattttgaattattgaaaaactgcctcgttaaaacagataagtgatccctccactttgttcccatgtaactgagattatatttaataaaataaatgtcagaatgaaaatattcttatactttagacaatcacattctgtctttggttatttcttcatacgtacccacattcttttattcgaacttctaaattgccttgcaaatagcaagttcttaataagtgttttaaaatgttgactcgtagaggggatgcatgatacatcttatctgcatttctaatagtaggcatgcatccccttattgattgggaagcattggcttgttaatcactttcagttctgaatgttctggtaggatgtattagcctaaaagaccatatttcataacatctgagttatcagggtagattcagttaacacctgcttctttagctaccagaagcttctttttatttatcctacttgaatcttaaattcagatatttaaacatcttgttttattgagtataaaaacacatcaatgaactatagagaaatttcttcaagctgagttatattttaagatctaattacaaactaatgagattcacatttttaaagcagatactgtaccccaaaatgaatcacttttagaagtgatatatttaatctaagtatgttgatattgcacaaataatttttggaaactatttttttgaaacttccttctgaatctgcttatgggattacaatataaactattatagtctctgaactgtgctactatatttatctgactttggtctaatatatatgcctttaaaaacaaagctttgcaaatatgaagaatgtgagggggtatgaaatacagataagattacaactttgaaattaacaacattcacctgaacatatgatatgtatttttgaaaggtaaaatcaaataacaccttttaacaaagttgtcagtgattgctttccttatgttgcacaaatccaattttcatttagcttttatttaagtttcataatagatacttcataaactgactataacaatacttatttctatgtcccttggaaaaaaaagacatataaatttgaatattgactgctaaaaataaactaatccatataaaatataatttaactataaggtgtagcaaatcaagtttattctcacaatttcctcattgcttttagtttatttggtcttattagctataattttagatatttagaaatattcatttatcacaaggaaatcattcattcattcctcaaggaaatcatttaatacagggctgggaatctgaaattagtggatgggaccaaaatcacttagaaaatgatacagtagagatcttgcagctatacaataagtcgctggttaaaatgaactacaaccgtaacttattgttttgttcatatcacctcaaatataaagctttcattttattttttccttctcttgcctaagaggaggtttttaattactttgtcattttttttaatactacaagtggaactgagtttggatttctatataagtagctattaatattagattaactcatataataatgaaaatattaaaaagggatttttcagatatatgtaaatggtaaaaatattttgttcttttttgtataaatttaaggtatacaatgtgatgtgttaaatacatatatatagtaaaatgattactatagtcagatagatttacatatccatcacctcatattgttatcttcatgtgtgtggtaagagcactgacaatctactctctcagcaaatttctattacgtaatacaatattattgccatagtactcatactgtacattagatctccaggcttattcatcctacataagaactttgtaccatttgacttatatttcccccattccttacacccaccccagtaaccactattctgctctatttctatgtattcaaattttattgttttagatttcatatgtaagtgagatcattcagtattcttctttctgtgtctggctttttaaactttgcataattcctccgggttcatccacattgtcacaaatgacagaatctccttcttttataaggcttaataatattccattatataagtttcttatctattaattaatcaatggacactcaggttgattaaaagttggttcctgtaaataatgctgcagtgaacatgggagtgcagatatctgtatgatattatttcatctgggcatatactgaaaagaggggttgctaggtcatatagttattagacttttaattttttttgaggaacttccatactattttccataatggctgcaccagattacattcccacaaagagtgttcaaagattccctggaccttgtcttatataacatataaaaatgaactcaaaatagattgaaaacttaaacataagctctgaaaccataaaactcctagaagaaaaaaatgtagaggaatacccccttgactatgattttttggatgtcacagcaaaagctcaggtatcaaaagcaaaaataaacaagtggggccacatcagtctaaaaagcttctgcacaacaaaggaaacaatcaagaaaatgaaatgatggcctgcagattgtgagaagatatttgccaaccataaatcttgtaagggattaatatccgaaatatataggtaactcatatgagtcaatcgcaaatagttaaataaaccaattaaagagagggcaaagatcctgaatagacatttctctagaagacatgagaatggcgaatagatgtatgataaggtgctcaacatcactgagtgaaattccaatgaaaaccataatgagatggcatctcacacatgttaggatatcaaaaagataatccttttgacaatcatattaaaacatcaaaatacaaaagccatactgttcttcatatatttataaagttaaaattattgtaatttacttaaatgtaaagctgtgtatgtgacctcttatcagttgattccaactggtagtgatgatagaggtcactggacatatagcttataaaatatttattatgaactctgtgatgtccatagagaagaagaaaatggtgatttggcttaccaatgcatccatacattcaccagttccctttaaatcttttaatattttaatcatttacattactagctttgacattgaagaagtacacctaagaaaaatactattttcatatacaaaggttaataatagaatatgggctagcagtagtaaagagttgaagctgtggttttatattagcaagttaaaagtcattcataaaacaaatatgtattttgtgtatacatacaggaaacagagtaattagatattttctctagcttttgaaatatttaattttagttacacaaaaacatcatttctgtttatggtgaattttttattttcttacccatgctacagatatcttttagatttctttcttgttttcttgtggagtttaattctgcatggctgactatgctcaatttattctataactcacgcattttgaaaataaatgatattttatcacattattttctaatgaacaagggttggttgtgcattctgattttagtattttatttccttggggtctgaaatagaacttcacattctcatttttgtttaccttacatttgctacaaatttatctcttgttttatacataaatacatattttccctctagtgcctggagcaactttactaattgttttatcgagtatattcttgttcataaatatactttaatcaggctcaaatattaaaacctaatatataaaaaccaaaaaaatgctacaatatttaaaaatgagatagaagtaattatttgtagattctcagaggaacagggaaaaaacaatcactgcttctaaagatgtggctttggtcagtttaccaagacattagtggaaagaccaaatagtgcttacgtttcctttttttaaaaattaaacttcctttttgataggtgtgtgatagtgatgtttaactgtgagacaaataattgtaatttaaattcctgttatatggatgtgttttttcatatttttactaaaataaactttgctgtagaacaggatcatggtgccagtaggcactttggaaaattgtatactcatctttctctttagacaggtttaagaattaaactatcacaggagtgaaaaataatatctttacatcttgacatacatatctatgaatgtagttgtataatctatcatcttgcccccagactgtaaaatcagacttggcataaacaattaaaataataaaatcttattgttaaataaaattttaatctctcatggtacagccttaagaccattatgttttcagttgcatgtgttaatatctatcaacacatatattcaaaaatagttattatgtattgtgacctgattccttagttctaggtaacagaaaattcaatttaatatagattaaatatcatttaaatatagattaaataacaactcacacagagttgagaatggttggctcaatgatatttctaaaagtctggtttctgttattcctttccaatatttctgttctatcttctgtggcgaaaatttatcttagtattaacactggtttctccatggctgtaatatgtctgccaacagctactgtggccatatgcatccttatgcatgaccagagagggcacaaaaatgctttcaaagcaagagtcccaagatcactctggctggacagacttagatcccttctgtttttgttgaaaaactcagccaatcaagactgtcccatggagtatgagatttattttagctttctttgaagattatgagctatgggactaaggtgttgatacatgaacaaaaatgagggtactccttaagaacagaatcaaagaaatgcatactaggtcaccaatcaatgaaggtcaccaatcatcaattggaaatcatggtcataacatctctttttcactttaactaccttcatggttatttttctatactttgctatgtttttcatccatttttataaaaacttctatgagaccctgaaaatgtgattattgagaactaaatttggtgtacatctcaataatactaaaatttatattcatatgtgcattgtcatgcgttgtaacttttaaaatcccaactaccccatagcctttattttatcctgttctgtataaacatattttcaagtttgtcaaaactggatgtgcactgtctgtactgaactgatcttttatttcttttaagttttaattttagtgggttcatagtaggtgtatatattcatggcacatatgagatattttcattcaggcatacaatgtgtaataatcccatcacagaaagtggggtatccatcttctcaagcatttaccctatgtgttagaaatgatccaattatactcttttagttatttttaaatgtacaataaattattgttgactgcagttaccctgctgtgctatccaactttagatcttattcattctatctacctatatttttatgctcattaaccatccccactccccaccccactaccccctgcactacccttttcagcctctggtaaccatcattctactctctatctccgtaaataagtgctcctgtaaataagtgagaatatgcaaagtttatctttctgtgtctggcttatttcatttaacataatgatctccagctccatccatgttattgcaaatgacaggatctcattcttttttatgactgaatagtactccattgtccatatgtaccacactttaaaaatccattcatctgtagatgaacacttagtttgcttccaaatcttggctattgtgaattgtgctgcaataaacatgggagtgcagctgtctcttcgatatactgatttcctttcctttgggtatatacctagcagtgggatttctggatcatctggtagttctattttagttttttgaggaacctccaaattgttttccatagtggttgtactgataaatacattcccaccaacagtgtataatacaagggttgcctttcctccacgtcctcactggcatttgtaataatattgcctatattttgtaattttgatttgcatttctctgatgatcaatgctatgagcaccttttcatagacctacttgccattatcatttttctcaagaattttttaaatttccttcttaatttcttcactgactcactagtcattcacgagcattttgtttaagttccatgtatttgtgtagtttccaaaattcccctcattattgacttgtatggtcttggataatatgcagaagaattctcaggatctcttcccctactttctcccaaacaaacgcagtctctctctctctgctctgagctgcctggagctgggggagggggtgacacaagcacctctgtggccaccaacactgggatagcactgggtcagacctgaagccagcacagcactggatctcactcaaggcccacagtaaccactgcctggctaccttgtatgtttgctaaaggccttaggggtctacaatcagcaggtgacaaagccagccaggcttgtgtcgtttgcttcagggtggcaaattccctcctggtcccgaggtactctcttctgctgtggctgagctggcacagaaggcacaagacaaagtccttcccaccctttcctcccctttccacaaccagtggactctctccccatggccaccactgccccaggctcacagtgagtactgcctggctacagccaatgttcattcgaggccccagggcccttgagtcatcaacttgtggtgagtgctgccaggcctgggactctcccttcagggcagcggtctcccctctggtccagtacaggtcaagaaacactgtccaagagccaaggcctggaatcgggctctcaggagcctgcttggtgctctacccaactgtggctgagctgctacctaagctgatttttggttcttatgatgtttgctttgttgtgtggatagttgttcggtctggtgttcttgcagggaggacaattggtggaggcttctattcagccacctggctctgcctccatccctgatcctttctttttaaactttaatgattggtttctataggaacaactaaatttactcagccttatttctgaggaactgctgactataatccttctctctcacattttaaaaactgacaaaattgttaaactgcgttgcctagaacattcctaagagtattaaatactgtcattaggtatgttaggttgatattatcttattagaaataagaatgacatacagccaaaacacaaaattttatctttagagaataaccattcacatttagtcacatttttaagcttggggggaaaaaagtgacttaatatttgtttatatgttgctacagcgttagaaattcaactttttaaaacttctgttataatgttgaaagatagtcctagaggtgtaaatcaaattttgattaaatgtcttctgaaatttcatgattttcttttcattttgaattatgaatacttagattgtgtgctgttgacctttagaatgttaggagacaagccagaaattaaacccaaagtaacaccaagcactggaaaagcatcaaagttaaaaaagtaataaaaatacggttattaaagggaataaaattatataaatggaaactgatttaaaaagaaaaggagagtttatctctcagggttctacagttctccagagaaacagaaccagaaggatgtgtgtgtgtgtgtgtgtgtgtgtgtgtgtgtgtgtgtgtgtgtttgtgtgtataatagatagatgggtaagtagatttattttgaggaattggcttatgtgattttgagtgctggcaagtctaaaatgtgtagggcaaagaggctggaaattcagggaggatttctgtgttagactcttgaggctcctcttctcagggaaatcagtttttgctcttaaggctttcaattcactggatgagacccaactctattatcaagggtcatcttttttacttaaagtcaactgattgtagatgttaatcacatcgacaaaatatgttcacagcaatatctatactagcatttgaccaagaagttgggcaccgtagcctagtcaaattgacgtgtaaaatttaactatctcagagaaccagaaaaaatataaacacaaactgttttatttaccaaagaacctatttcagagaaaatagattgaacattatttccaatgtttaatcataattaatgttggcccctatctgtgcagacttagaggtttctttaatttctaatcctccctgcattagctggattcatctttaagaccatctccatttgcctgagtcattttttttttttttttggctgtccttggatttactccaatgttaaatattataagagtatgaagaggtatttacttactgttgtggagatttcctggctcagggaaggcattcaactttctggataggatggataagataaaatgccatgggccttcaggtctgaacttcaggggcttttgtcttgcgataactagctgtctactgcctatgaagtattttctttctacaagttaacttttcctcctctgtgaaatgggacaataagggcacctaccttagaggtatgctgtaaagatcgcactcaacaatacatgtaaagggctcaccacaatgttgctcatcctgtaatagggactgcacaggaaatctaagctgctatttttactttcattattctctttgctgtttgccatattaatattgtgatttcgattatgatttttttattcagtcaatatgcagaggcctctatgtagagtattttgcttaattttcacaattaacaaatactgccaaatgctgcatatacataatttaaagaggagaacactaaatgttaaagtatatgaagaaatgtgtacaaggttacataataagcaagtaacagaatcaggattcaagttcaagcttctctggaaaaacttgtgcttatcttacagcagcaaactcagcctttttattcacttataaacagttttaaatgtcatatattttttggaattgtaaaagtcatatagagttattcaacttttttgttatgcatatattataaaattgtacattctaatatgtgtaaaactttatatattattttaaatgcctctctgatcactacagtagtttatgaatcacataaacattgtggaaaagaatagaatcggaaatgaaaatctccctgactgccttcatccattttacatacttgcattaaaaatatatattcttccttaatctagctcctcttacaggcttcctgtcaatggctcaaaccaaaatcattaaggtctatgttgatgacacccatctctacatttagtccaccaggtctttttagcttcatttaaaaaatatatccaaactgtaatcagacagtccaaggcagcatcttctcactcatggatttgctggtactccaggcccctcttcagtctcttctcaaaagagccagcagcctaattcttttacaaggctgtgagtgcccatcactcttctgcccaggccctctagtacctctcatctggccctacattaaaattaggatagaaactttatatattttgcaacttccaccattgcccttctggcttcagtttctactgctgccaccctgtccttccttttctataaagcaaacacaaacataaaccctggacacattgttcttacaggcagggcttggcactcacaggtggattgcctgaaggacttcccttgcatgtgtctgcatgactactcagtcacatccttcatgtcttcacatgaaggtgcattctcagagaggccttcctttgtctctaaaaagttcacacattctccactttgtcagtcttttgcctgcgtatttttaatattattaatttttttaaaaatatctgcccatcttaactgggcgtggtggctcacgcctgtaatcccagcactttgggaggcccaggagggcggatcacgaggtcaggagatcgagaccatcctggctaacacagtgaagccccatctctactaaaatacaaaaaattagccaggtgtggtggcgggcgcctgtagtcccagctactcgggaggctgaggcaggagaatggcctgaacccgggaggtggatcttgcaatgagccgagattgtgccactgcactccagcctgggcgacagagcaaaactccgtctcaagaaaaaaaaaaatctgctcatcttacttatgtagcttatttatttctgtccaggctaaatataaactcctaagggctggcatattttttgtctattttgttctcgactgaatcccctccttctagaacaagtgtttgatacatagtagatgcttcataaatatttgttgtatgatcaaattaatgaatatattaagccatacagattttatgctgactttattgcattattaattcaagaacacacatagggccgggtgcggtggctcacgcctataatcctggcactttgggaggccacggtgggcagattgcctgaactcaagaagttcgagaccaccctgggcagcacagtgaaactccatctctactaaaacacaaaaaattggccaggtgtggcagcatgcgcctgtagtcccagctactcgggaggctgaggcaggaaaattgcttgaacccaggaggtggaggttgcagtgaagccgaaattgcaccactgcactccagcctgggtgacatagcaagactctgtctctaaaaaaaaaaacaaaccacacttagttcttccttataggatgatacaaagagaggggtgatgatagatgtatttccaaatagaagaaataaataaataaaaggagaatctcaataatttgataagaatattaaagatgctgtaaattacaggcaactctccttgtccacaggtttcacatctaggtattcaagcaaccagatattgaaaatatttgaacaagaaagacaataaagtaatacaaaatattaataagaaacaatagagtataacaactgtttacattgtattctgtattagaagtaacctagagatgatgtaaagtggcggggggcgggggttatacataggttgtatgcaaatatcatgccattttatataagatactggaacatctgaggatttttatctccctcagggttcctggaatccatcccccacaaatactgagggacagttgtattatttaaattccttggcagaaaaaaatccattacattgatctttgtttttctgtttttgttgcagtagaagaaaattacttttgcttagtaattctttcagtgtggtgttgtaacagtggcaatgatttagccattgttagtaataactggtaggaaaccacagcagtgattttaagacatctcaaatatgataaccaccatcatctaatgctgggtatgggtaaaagactcggagaggttaagggaggcagtggctcagaggacagcactggtcatgtagggggaaggggcaagcctgcaaatccacttggcttcctaagtttgaggtccacaaggaattaggaaaggacctgcaatttctttatgcaataactacctcattattgcattgttattcatgtctcattaagctcacagacatcttcaagtaatttattttcaagattacgtggacagaattttttaaacctttaagtaacatacttaaaaataaaataaaacatacctgggtatagtgttcttgtgagatacctttttttaagaaaatatatttatttgaagcagatcttcaactgctagaattcaacaagatttagatatgtttcatatctactcacctgttttttctttctctagacataaatctaaataagaaaatatctagagttttaatccaatatttaaaatgttacaacattattggttgcttttaaagctttactagaagctcttgaaaaagaatgagctatacatttctcaatagtaaaaacgaagaattaaaaccactgtacagattggccatggtttttgtcaaagcttgagatgttctttaaaggacagcttaagactgaggacctttgaaactatttcatttcataatttagtgtttaagtgtgttgggaggaattgtgcaagtactcagctaccaagaaaaacaaaactaaaataagacaaattagaaacagaatggttagggatttttttttccagaaacattttagcattctgcatctttgcctatcttaacacaataagttagttatactaagtcttatttataagatcgtcaaaaaaaaaaccactgaaaatactgatcaatgttaagttcctacagagtgataatcaccagtctgatattctgtagccagaatgctcaagcaagttgtcgtacttttaaaatttctgagaatttatagagctgttagaagaggaagattagcatatttttaagttacttgaattttcagactgtgattttttttttttttttttagtcttctctgtttgtttcaccaaatgactctagtgctctctgactctttggtgggtagtggtaggttaagagttaaaactattaattcacacttagttgtattcttattctggaaatgagagaaccaatgaaaactggtcccgtaaggcattctttcctttccctccatgaaacctgtgcctgggtttaatatcccatcacatccatgcttcttctctctaggaggcagggcggtcttctctattccaggtcacacatgttgtgcttattctcaccccaaagctttaatccaggcttgtctgtctagagtacgctttcctttccctttcagatctccaaaatgtatccagccttttacacacctctggtcttagatcttgtgtttcctgtaacccgtattgatttctcactttgcaattctcacttgtgtatctgttaggaatgtttttctgtggtaggtaactgagaagtgactgggaaggattccattctctgtgagatcccagaatctccacgaatttcttccaagtaaatcatgtttctgtgagtatgaaagaaggaatagaacagaggttggagaagcagtaatttctatccctaaagggatttgaattcctttagtatgtactggatgcaattggaatggtttcttcaccggtaataggaactcattctcaactggactcatccttctctccacttttatctgtgtcttttctcctgtttcttagaaggacacttgttatgggatttagggcccatctgggtaatctaggatgatcccatctcaagatcctttccttagttcatttgtgttgcatttccagcaatgctgaagacagaatgagggatcaatacctgtatagtatcagtagataaatacccataaaaataacatcatgctctttgggatcatacagcaatagagagcaagagagcaaagtgggggtggagagagagagaggaagggagagagagaacgcaatcaaaacagcacagcagtttcaattatacaaaatatggaaactatgttgtaggatccttatgtaggcaccataccctcttggatttgtgcaaattgcagtcatgtcagtcacatttcctgatttatatcatcctctaatcactttgactgtctacagctatattcgtttcctgaggctgctctaacaagtttccacaacctctgtggcttaaaacaacactcttttaattctcacagttctggaggctagaagtctgaagtcaaggcataatccaggccatgctctctctgagggttctagaagagaatttttccttgtctctttcagtttgtgttggctgtgggcatcccttgacttcattgacttgtgaccacttcactgcaatttctgcctccgtcttcacatcacctgctccgcttttgtctgtgtcttttctcctgtttcttagaaggacacttgttatgggatttagggcccatctgggtaatctaggatgatcccatctcaagatcctttccatagttcatttgtgttgctgtaaagaaatacctgaagctggataatttataaagaggtttatttggctcatagttctgcaggttgtacaagaagcatagtgctggcatctgcatctggtaagagcctcagactgcttccagttatggtgacaggcagagaggagcagacattacagggcgagaaaggagaagagagagaggaggtgctagtctcttttcaacaaccagttatcccggatactaatagtgaggactcactcctgcacaccaagctgttcatgagggatctgcttccacatcccagacaccttccaccaggcctcacctcaacactgggaatcaattttaacatgagacttggcatggccgaataaaccatatctaaaccatagaagtccttaaattaagtacatctgtaatgagactttttcaaataatgtaatattcacaggttccagggatttggacatgaatatattttggttggggggcggggtggcggagcaccattcaacctactacaatagtgacagtagatgtactaaataaatgtgcaatgaattagtttggctcttccaaaaaaattgtaagtaaataaacatattgtgtaatgaaatattcataaggatggtggaatatttacttttgcagctctcatattttgcatttctggattaaaaagtggttataaaatataatgatgaaatcatagtctattcgatgaaaaaggatagataccatacatacagcctgtagatattttcaaaacctcagccaatacagttcagtaaacatgtaactaactttgatttcagtggtaactctgtgtgttctaagaagtgagttatgggtaaaaatttaggcaggaactataatttatattactttaaacttatatatgcttatatgtttttttttaattctggagagagaaaaacagataagcaatattttaagcatattataaagtcattcctttttattttaaagaagcaaaagttatattcacaaattcattcttaaatattttaacatagttttataattacttgatgttatacagtttgtccaactttaattctagatttatttatttataaaagcaataaaatatatagagcatgagattacaaaaaactaaaatacacatattttatccagtcagtttagttagagtaacacatcattgcaaaacgtaaaattaaaccttatttattttcatttcagtattatcagttattagctgataaaatcgacttgttttggattacctgttttgaatgaaaaacaaatatttactatagtagattaaaacaatgctttgtccaaattcattttagcaatttggaagccaaagtttaattttgttttgaacacatgaacttttaaactattactatttaaatttttgttttaatgctaattttaacctgtaaaacttgttgttaagtgaatatactttttatactttgaaaactttctttaaaaaggatagtgataaagggtaaattagaatgtgctttgacacaagtctaagctctttccagattcaggtaacaagagccaagtgtctcagtgtgatatagaaatgacccctgggaaatcatcatgtttagtaacttaatggatagaacagaaaatgccagtagattgctgtgaaaaatatgtcaagaaaacatttttacagaatttctttcattttatttaccagtgaactagacactcaataaattcgtgtgtttctgttgctcagtgttaccgcactgccaacttttctaccccattattgatataagttgagaatagccttactgttcaccatctgtcgtgaaagagtcaagtttttcttttttttttaataagtttagttaatcctttattttttcatttagcagctacataggcatagtgtactgtacaaaaccaggatatacagcagaaaccaaggcaaacacagcccttccattatggagctcacatcttgtgggatggagaaggaaggtattaaataattaagtatacatttattcattctttctttttttagttatcaagcaatatctttattcaaacagtagtagtgcaacctaaacatttgtagaactcttttttttattattatactttaagttttagggtacatgtgcaccatgtacaggttagttacatatgtatacatgtgccatgctggtgtgctgcacccattaactcgtcatttagcattaggtgtatcgcctaatgctatccctcccctctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgagctcatcattttttatggctgcatagtattccaaggtgtatatgtgccacattttcttaatccagtctatcattgttggatatttgcgttggttccaagtctttgctattgtgaataatgccgcaataaacatagatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgtttcctgacttttttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttggtagagacggggtttcaccttgttagccaggatggtctcgatctcctgacctcatgatccacccgcctcggcctcccaaagtgctgggattacaggcgtgagccaccgcgcctggcctgtttcctgactttttaatgatcgccattgtaactggtgtgagatggtatctcattgtggttttgatttgcatttctctgatggccagggatgatgagcattttttcatgtgtcttttggctgcataaatgtcttcttttgagaagtgtctgttcatgtcctttgcccactttttgatggggttgtttgttttcttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctcgggtttttatggttttaggtctaacgtttaagtgtttaatccatcttgaattaatttttgtataaggtgtaaggaagggatccagtttcagctttctacatatggctagccagttttcccagcaccatttattaaatagggaatcctttccccattgcttgtttttttcaggtttgtcaaagatcagatagttgtagatatgcggcattatttctgagggctctgttctgttccattgatctagatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagcttgatggggatggcattgaatctataaattgccttgggcagtatgaccattttcacgatattgattcttcctacccatgagcatggaattttcttccatttgtttgtatcctcttttatttcaatgagcagtggtttgtagttctccttgaagaggtccttcacgtcccttgtaagttggattcctaagtattttattctctttgaagtaattgtgaatgggagttcactcatcatttggctctctgtttgtctgttattggtgtataagaatgcttgtgatttttgtactttgattttgtattctgagactttgctgaagttgcttctcagcttaaggagattttgggctgagacagtggggttttctggatatacaatcatgtcatctgcaaacagggacaatttgactccctcttttcctaattgaatacactttatttccttctcctgcctaattgccctggccagaacttccaacactatgttgaataggagtggtgagagagggcatccctgtcttgtgccagttttcaaagggaaggcttccagtttttgcccattcagtatgatattgactgtgggtttgtcatagatagctcttattatttgagatatgtcccatcaatacctaatttattgagagtttttagcgtgaagagttattgaattttgtcaaaggccttttctgcatctattgagataatcatgtggtttttgtctttggttctgtttatatgctggattacatttattgatttgtgtatattgaaccagtcttgcatcccagggatgaagcccacttgatcatggtggataaactttttgatgtgctgctggattcggtttgccagtattttattgaagatttttgcatcaatgttcatcaaggatattggtctaaaattctcttttttgtttgtgtctctgcctggctttggtatcaggatgatgctggcctcataaaatgagttagggaggattccctctttttctattgattggaatagtttcagaaggaatggtaccagttcctccttaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcactcaaactagaactcaggattaagaaactcactcaaaaccactcaactacatggaaactgaacaacctgctcctgaatgactactgggtacctaacgaaatgaaggcagaaataaagatgttctttgaaaccaacgagaacaaagacacaacataccagaatctctggggacacattcaaagcagtgtgtagagggaaatttatagcactaaatgcccacaagagaaagcaggaaagatccaaaattgacaccctaacatcacaattacaagagctagaaaagcaagagcaaacacattcaaaagctagcagaaggcaagaaataactaaaatcagagcagaactgaaggagatagagacacaaaaaacccttcaaaaaattaatgaatccaggagctggttttttgaaaggatcaacaaaattgatagaccgctagcaagactaataaagaaaaaaagagagaagaatcaaattgacgcaataaaaaatgataaaggtgatatcaccaccgatcccacagaaatacaaactaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagtttaccaaccaaaaagagtccaggaccagatggattcacagcaaaagagtcaagtttttcaagtggacacagctcacttacatgattttaaatattttggctattgcacatttcatattacttctgtcacggagataaagagtctttcacaatgacacatctgacttcattgtttttctggcttatcacatgactgtccatcattatttttatttgttatttgaatgcttctagtttatttaatgtattttaggggtgtctaaaatccacacaaaaaatgtggaacatatataggtacaaacatataggtatatatatatatgttattagaaagttactatttattttagcctggcatggtggctaacacctgtaatcccaacccttttggatgcctaggcgggaggatcagttgggcccaggattttgagactagcctgggcaacaaggtgagaccctatctctacaaaaaaaaaaaaaaaatcttccagggcatggtggcatgtgcctgtagtcccagctacatgggaggctgaagctggaggattgcttgtgcccgggagatcaaagctatggtgagctgtgattgcgtcactgcactccagcctgggcaacagagcaagactctgtctcagaaacacacacaaaagcgttactattttacgtatcaaggctgcttacaggaaacattacatttaaaaattataaaaaagcagcatttcgtttttaggtcatgtggccttttttttttttttttttaaatattggccttgggccaattaacttatgcttgtaaaggggcataatagaaagaaaattttaagaactattttgagatcactaatatgttacttcaacgtggagcagaagactttgaaggatactgacattgcagtcataaggagcctgctgaatttctgagttaattggaactcaagcagagaagggatgggcaggttgtatgtatacctagatatggaaaataattggatagtgcctaagaatgggcgtttgataggcatgaaaactttaaaatacaatttttaaaaaatgaaataaatttttatttaaataaagaacaggttggatatcaatgacatggaactatattataaaatgttaattatcttgatggcagaaattcagttttatttttaatctacatttgatgagaataaaggaaaagtaaataacatctgtgctaattataatcagagtagacaatgttcaaaatattttaattttaaaattggctgtgtcctatattgttagttttgagggtatgcagtggacattattccctgaagtatatgaaagtaaatttgactaacagggttatataaatgcatagtttttgcttggaaactgataacaactttctaatgaaaaaattgaattaattcttattatgttggttaagtttattcactaaatgaccattaaatgttgtaaacattcttcacttaggtgaagttgtatttgaagttttgctttcactagttttttaagaataaaagtaatacaagtacaaaacaacaaaagcggagacccctgttggacaaacaggtaaatcaaaagctgttttctaataatagaatcagtatctgcaagaaccgttgatcacttctaaggattggcaaaaacatatagtattccaagtatttttttaaaaaatgtttctacagatgtgatatacgccttccttaccctcttcggatatagttaatagaaaaagtgcaaatgttttctcttaagtaatatagtaatttttccttagaggaatgttgacattttctaaaagtaaagagtattgtcttattatgagtctaaaaatgagataagcccttgacctaaagttcttaactgccacttgtgcgagtacagtgcttccattatattatagattttataatagtcactcagttatgtgacctttcaattaaattattggagctgattctaattcaggatttccctgaagatcacttgaatattcatccaattcagaggttcccatgcatctcattaaacattatgacccatcaggaacgtgtgttgctggcacaccaacatcagccctgagattcagattccttttgagagcaatttatgggattaatttacctgtatgacttagtcctgttaaggggttcattcaacatcagttgggtcatctttgctggagactttttttatctgaagaaatttaaaaagtattcctaatgatacttaattcttattttaatttaggcaaacatgaggtgtagtgctcataaaatgcctcatctttgagatttgttcagtttgacagcctacagaatatcagtatattaaaaacgaagtaattttcagcttttgcctctcaagttatctatttggaagcaaaattcaatagtttgaagatgataaatctagttagttttctctggagcattcgacatgaacaacaatccattacttcttgatattttccctgttggcctcagtggcacctattctctgtcacttggttgtaaaagtgtctgttcctatttagtgtcctgtttcttttgcctgccccctgaatatagtctttccagtctccttgcctgtttcctctataatatctctcaggctttatttgttcctttatggatagtactgccaaatctgggtagcttaatctcttagagtgcctcatttcttccagtggaatggtaaaattacaatcattataggagatattatatttaaaagacttagaagaattaccagttcatagtacgtgtgagactgctttctcttctctgtcttctctatatccctgacttctcttttgaatttcagactttcattttcagccatcagctagatacatctaatggcctcagggcaaaaataaatattctcaacttttcccctctgctctcaaatattccctctctaaataaatggcattacaatttatctgccaggtataaaacatccaagccacctttatttccactcttttctttagcgttaccttctacacccatttgtttcttgtctgcaatattatcaggtccactccctgctatgtactcctcactgatatcctatagtactaaaattctttgtttgcacaaactttgcttagctctttttagtttaaaaagatgttatgaaatgaatacatcacactcctattaaccttttcttgctgagtcagtcaagatgaacttgtttatggctcaggagaaagctcatccagaagttcttggagtatatatccagtgtgagtcagtaggggctctctgctcattgtagatacccagggtctcgggctgacaaggctacatctcagcagtttctcccacagtcactaaagcagtgggaagaaaacatgataaattacaaactggctcttaaaatgtatgtaagaaatggcacatattacttcttgcattattggccaaagaaattcacatagacacttataacttgaaaagggatggagaagtgcagtcctaccatgtgtatttaagaactggaatatttgtgaagtcttaatgactagactagcacactgtttttcttgcgtatgttgaccttcccttttctaaaactctttacaacacaattttttattttaattctatttttaaaatctatgtacttcttctaatgcctgtcattgtctacataccacgttacttaatcatagcatgaagtgcactctctctttttgcattgaatagaatttcatgtggattttggcatgtaactgattatttcacctttcaaaatatagttggcaatatactattctatttcacagttatgttgtagatggcttaaccattctttaacttctgggaatttggaacctttcaagttttactcttagtttatacaacatttatagaaaggactataaagagttgcaataattcaaaagattagactggcaaatcagccttgcacaaataagagatcttacccagtatcagtttactaatactgggtaagacaaagcagtttagggacattgatgacaactacccagtccttctttgcattagacacatgctttctgacccagaaaaacagatgaagtctctaagtatggtacatgagctaccaagcatacaagggagtattgaggtaataaactgtcttcatatagctgtatagcttacataacattttccatggagctatactttataaatccatagattgtaaatacatttatttaccagaaacaatcctaaactagaggcatcctactgaaaacattcatagataaggattctcatcctagcatctatttggtagcaggtttagttgtcagcttgtttacaagaaattgatacccctacctttctttctttccctggatcatacccctgataacagaagagaaatggattataagccagttgtttaactgctttctccaaaagactcaagtggcatatatttgtgaattagtatttatgttcacgattatttatttgagatttaagatacaagaaattaaattgtatcattaattttaaaaagacctgttaaaatattataaaacatctgatttaccctgctctatgcctgagtgaccttagcttagttacattgctatgaaaataagtatgcttatctgtatggaattacttgataaataattttcttaggctttcctgtgaggataaatttcactgtaaatcatatagacttgaagatttctcactctttctccagaaagacatttctttccgtttctttcccattatgccaatgcgttccaaagaaagtgtttacttactatcgatgtctacatagtagtcatgtctgtctgttactaacattggccaaatttggactgaatataaatttgtctctttaaaaatgagtttcagtgctattagaataattatatgactaattagttttgttaaaacaaatgtaatatatcacaaaattgtgtaacaagtttaataatttggatgtgttatataaaataatgcttccctgctaaatttgaaaccccatcaaatattatcacttaagatatgtaataatttaagaagacatggtaaattttttttggtatgttatgattcttgtttcaaaacttatggtgttactttaggtctggggataaagcatgctgtatttattcaattaataattaatattaattatttttatgtcaagtttggtttattgaaacaaatatgcttcattgcttaaactctttacatatagtcatgattgacccctaagaaaatttaaactcattagacagattaataaattaatactctgcttttttattatactttaagttttagggtacatgtgcacaacgtgcaggtttattatgtatgtatacatgtgccatgttggtgttaatactctgctttttaagaaaggttttagagttatctttaaattcatatataaatcatacaatatctataactcatatcctaaataaattcacttatgaaaataaatcccagaacatagttctgattgcaatcacctgggtttccttaatccttcagccttctgggggacttgtaccaatacattattagaaaatttaaaaaacccatagacatgggaagggcttcttttcctcagtcattagatactatttgctttagttgctctcagtttggctataagcccttgctaactttgcagttggttacagaataaatttgcaaggctcctgctttcctccatataccactgctgatggagctttaaacgcagctgagttgtgatacatggaagcctgtttttccttttactgcccaccactaaagtcccttcaatcccacgacatgaaaactttgtgttgcaaaaatgtttacgggagatttgagactacctggaagaaataagaatgatacaacaaataaaaaataaacttgatccttaatatgactgtttttaaaatccagggtaaaagaaacaaagttaaacccctcacattattttctctttgttggtatgctccatccaagccctgtgctctatcctggtctctatgtttctcttcttgcttagaaatctgcatcttaattcaattcttccattacagagctcctgcttttggttaatagtgacatctacctcagtataagagatgaagttcattacaaagtattgtcaagcagaaaaccatctcccagaaggtgctcactttgggttagatcatgttttgaggtcagttgttttcactttgctgatgtttaaaccttcaaagtatgcaaaaatagtataaatattttccatcctgcatccataagtagttagtaaaggggaggatggttatatgtcactgtaaaggaaaataggacaaaggcaaaaacaaatgaaagtcaacaaactaagatgaaattagggtgaagtctcggtataaaaggtttgcacagtcctagcataggcccttctgataaagatgaaccaggatttggctgtacatttctttcttaagggctcatactgttttcaaaatataaaagatcctaataaactagaaaacttcattacctacccactagaacaaagtctccttcagaagcaaaatcaattaaagttgcaatttgttctttacacggaggtcttaatctcctatcaagcaagctaggaattgattattctggaaatcttatagcccaggcaatctcattccatttagaaaccttaatgtctttggtgaccaataaaaccagaaaagttttggctagggatcttcattactaattcccattctcatacagctattcttgctctggccagatccaaatgtctgctgcttacattttttatgacatgtgagaccccatttcataatatacaaattccatgacatgctgcacatattcttaggaatcttccttttcttaacacagtatttccagaactatggtgctaattgcttgttgtcatgagacaactttaggtggtagacaaacaaggcatcgataaccttggatgacatagtgagaattttacttcattgctaattcttctttactcattctgatcacgtcaagaacaatagctgagtatgttaatccttaagactttttaagcttgttataaatatatacacaagataatgtatataggcatatatatggcttcactacagcactacttttttttcagatctagatttaattaagtttcttaaaatacatctgtcttggatctcagacttccaaatcctactctttcagttccttaaaggctgacctctcttcccttactagccaagaccaagaattctatcatcagaagcactatcttgcacacatttgcatggtttttttttttgccttgacccacatacaactagaaaacatctaaccttgcattaatggtatcatcctctttctctgctaatcacagtggaagaaatgccacattatgcagagattggtaccattagagtttcctagtcttcaatgctatctaaatattaacactatctacaagtcctctgattgcctactcagatgttgtgccccatagttgtatttaaaatgtttctacctcatttcctattacactacctcctactatcctttccactgttgaggcagacatatactctttagaggaaatagaatctatccccagtaattccatcaagtagctaatcctacacttctagtttatatgtattcaatagccatttcttgcttaaatgtcttaaatgacctccccttacccttatcataaagtgtaactccttaatctgcctagtgaggcttgttataatcaggctatgcaaatctttctggctttctcgcctgccacttcccctcttgcacttcatgatgcaattatattgcatttctttcagttctacaaatttagctatgcttaactttttttttgtttgtttgcttttttttttttgagatgtagtttcgctctgtcaccagactggagttcagtggcatgatctcagctcactgtaaactctgcctcttgggttcaagcaatcctcctgcctaagcctcccaagtaactgggaatacaggcgcgtgccaccacgcactgctaatttttgtattttagtagagacggggtttcactatgttggccagatggtctccatctcctgactgctttacttaactttgagtcgtcatacatgttatttccctcttctgtctgaaaacctctaactcaccttcctaaacagccaacttctatttgttctgtaaacctcaactttgaggttaattactctaggatgtcatacccaagtttccaatattggattaggcattcctcttatgtcctcccagaactctctgtattcactatacattgacactcatttcataatattgaagttgcctatttatttgtctataatctcccttggcacataggattctagaggccattgactaaatatgttgatattgcttattatactcagtgcctcacacatggcatgtacttaatgttgtgctgatgttcaaatgatgttataagaccataatgtctaacagaataagcgggacctgttgctcatgataaacaaaactactcttggcctcaaatttagagatcctgatccttgggtcccagttgacataattccttacttccttgtgtaggaaccatactaatattctctgtatcattccaatcttagtatatgtgcatccaaagccagcacttaattcctcaggaaaaaaagcatggtattgtttctagtcttattttataggtcaatgggataagacaaaatacagtggtataaaagcattttcttatgtgttgaaatgatcctgtgtacatggctaactgctgatctggaataatgtaggactaattccagattttgatcgatattgaataagtttaaagtttcattcctagcagagatatatttaattaacaaagatgtattggatgcatcattaccaggcacttgagatatatcagtgaacaaaacaaagttctatgtcctcacatcaattacattctaacaggggagagggacaataacaacacaacacaggagagaaacacaaacaacaccacacaacacaaaacatgacaaataaattacatgctatgttagaaggcgttaaagccattgagaaaacaagatcacaataagagagaaatagaaatattgggattggactgtggttcccaattttaagtagaacttttctgggtaatcattgttgtgaaagtgattttgagcaaaggtttagtagaggtgagagttagaggaagagcatctcagggagaggaaacagccagttccctgtaatcaaagtttctaatgcagaagcctgattgacatgttcatcatagcaacaaggactgtggagacccaaatcatttatattttttttgcaaagtaatatcaataaatcatttattgtgtatattcatctgtgtttcctgagtttatggccatacagcattttgaaggtagaggcaacaacatttcttaatgagttaggtgcagggtgaatgcatatagacccttatgctccaagggatagcataggcacaggtaggaatgtcatgctcttataaaaattgaagggtctgacaagcacaggtgtctgaatcaaagactgcactttttagcccagaggtgggctttggtagctcctgtgaaaagaggtaagtttctccttgaaatttcccaggttcccctctagcatatagatcaaagagaatttggaaccttcaagttctatgacataaatcttcttcaaaattcttttatctagaaaaatattacatcaagtttaatagaattcctactgtggtcatgggggcaagcctcattcttcatccagaagatatttaatcttccacaatatggttatccttctaagcccaaagcacggtcattctttgctgcttgccaatctcctgttagaattcagcacatctgtagaaactatcagaatgtcttgtacaatcaggcaaggatattgtttagctgcttctttggaaattaccaagtgtacacgtttataactgatttttaaagactgaatatacaatcctaaatccctttacttcattgtttgtgacctacttcaattaggtcacacaaaaaaatcacattaaaaactttactgtactgatcaggtagaagacaaacattcagacacttctagtaaagtatttgttcatctgaaaatcttttacacttgataacaccgatcttaaagagggacagttcagacctactgtatttaagtagcataataacttctctaatatttatagtaacttccctaattatttaagatattatatttattgacaaaagacttctctactgcatattatttctctgtacactaatgggctttcatataatagaaattgtattggtaataagaaaagatagtggaaagaaataactgaaggtgtcttatactgaagatgtgaacctcagcttttttgtccattcagatggtgacattgtgatcattttaatcagcatattttacttgtatcatgaaaacactgtaaatattaaatcacagtgtagtcaaacctggattattgtcacttcttttaatgactctgtgaccgtattctgtatagtattaaatacagtgtcagtgtccaaagacagtgatattaaagtgtaatttttttatcatttcaatcaaactgaggggatctaaaatgtctaataactttcgtgaaggaaaccttactgttttatgagctacagtcaatctttaacaaaatttcctacaaaattgtcagtaggcatgatttcttttataggaaatgtagtgaagttgcccatctatattcatgtgattaatgtaacatagaatttacaaatttaaatgcataatgctggaaaagtagaaataaagatttttatagtaacacaaatctgtgctacatacatttaatatattcatggattataaaatgaattgtgttcaatagctcaacatttttaattgggtttgcaattataataaattgttacacacatttctcaagtggattttcagacttctcaaatatttgagtctacattttcatgtctactagaaagcatacagagaagttttttacacaagtaataatgttatttctaaatggctttttggttttttcttccacacattgtttatccctgtgggcaaatctttgtcgagattttctcatcctaggagtaaaagggtttaaactggcttctctagtcagattgatcttacaggaatcagttttagatgtatagtcaagcaaatggacttctaaggacagcaaaaatgagaacacaacattgatagcaccaccagcaagacagatcatgaaaaacaaaacaagatgaccaaaaagatgctaggtaaatatgaaaacatgtataatttctcagtgtactcttttactgtctttccttcattttggccaaatatcacgtatttcattctccatgtttttacttttacttctccagaccaaataagccttcttttggaagcaataggtattggcagtttctccaacttgactttttacttttttaaaaaatgtgaaagtggttccctatataagcaaaaagatcaactagaatattatttggtataaaataatgccacttaaaggagaacattttctcctaaaatgtgtttttcctaaaacactttgccagtatattcaattcatgaagttatgaacattttcattcagcaagtatctgttgggttctgcaagaaaacagagaggtgttacataagaaacataaaacggaaatctcacatttccaggagcataacatcattccaaatgatgcaatgtgtacatgttaaattgttcattaataccacaaagcagtaatgtgccagaatgataccacatccctactaatgtttttcctgcctctctgtatgttgcctttcctagaccatatctagctattaaattgagtcttgatcctggattctttgttcttttccttatgttacctgtaaactttcagtaggcaactatatccttacccactaatcgccatctatttccacaaacactaacattaagtatctccaggccacactctcctctgcctacttcttacctctttttgaataatatatccataaagattactcatgatcctctctttcaatctagaccctcttccagtgttgctgtttcagtgaatggcaccaatattcatccactgacacatgaaatctagaaacagaatagtcttcttcgacccttctctgtccaatctgtccacttccatccatacctaccagcccaccactctaatccaggcgtcctatcacacttcgcctggacaagtacaatgattcttaactgctctattttcatctttgaaaatagatcctttcaaagtattctccatatagcaaacaaatcatctttaaaattgaaatttagtctaaatgtattcatgtgtccataaagctgttttgttttgttttatttttcttaaatacatggcctttgaaggctgcccggtttggtccctgtttctttatccttgctgtgcctgttctagctacactagtcttaccacaggccctttttcttgccctccttctccttctacatcctacaaatgaaatactcatttctttcttaccttagctgttacttggtttccggcttctagtctatgcttcacttcttcagagaccctcttattaataggttattggggcacaggagacctttccttcatgacattcactttttcttatttgattatcacatttctttacaatttcatttctttatgtgattatttgattggagtcagtcctctcgtttactgacgtttcacaagattagaaggtacacctgttttgttcacctttgtaaccctggtacttagcactgtggaacacaatagaagctctaaatataaactgaataactatatcaataagtgaacaaatgaaccaatggatggaaatagtatgtaacatggtaatagaaaaacttgtgaagggaataaaaataaacaatagaggagagttgatatgaaactttgggctatctaggaaggaaaaggacatcaggaaaagaggaggtgaagaaaggcatttggcatttaaggctgcagagtcatttgagcaaagttctaggaatgcaaatgatctttaggtggtagaatggtaaattaaccaagtgaagcatattggttcattatcatgaacaggggaggtaacactgaagacataagattagtttaaatttatggactttggattaacaggctgtaggagctaacagaagctttttgattaggtttgcatggtgggtagctatggaggatgtgtaagagcaggagatcagttaggacactatcccaataatatagtttattggatgcatcattaagcatccattcaagggtaaaaaaatcttatgattttgcaattattaagtgtttatgaaggaaaagctgctttcttagaataaaatacttcaattaatctttttaaaaacaacagcagaaaaagtattttgactaatgagtaactacttggtgttgttctgggaaactatttcgaaaagcttgaagttaatggctgtaaccctaagtgccttaaatttagttcagtgtgataaagcccctcacatattttcttagttttaaaattcttatttagtttgtctatgtaaattgatatacacataatgagacagtagaaacttcagtgtatttacttagctcctttgtaccatattcaccctctgtgatttgacatggattcaatatgataaaaagtaaaaatgaaaacaaagttaactgttgctgttttgtgtcaattttgctgttccttttttttaaaaaaaatattggtttgctttggtgaccttttctgtgtttgggcaagcatcccttaagctttcatccagtgattataagcagtcattatgtactgtttgacatggtcattacttaatgctcacttaacagaattctacaagaccaaattatcacagtaggtgaaggaacagatggccagctggccagaatccacgcctgctttgttttatgcctcctcaaatctgccacaaggaagccacatgtgagacctgaggaggcaatctaaacagtaacttgcctgtccagctgtgcttccaatgttctcagctgtgaagtctaggtaggtgccattcccatatgagtgcagcaggaacatctcctgcaggaatctctctgcttcatgattaacatggcagtcacggaggacagattccaaaagtaaaaatagaaatcctttcctccacctcctgccactgccttcaagatcaaaaatcactatgctatattataggagaaagaactgtagctttgtggaaatagtatacttatttttaacacactttgtttataattataaaattatccaaaatctgatattttacagattgctacaacattcaacaaagagaattaggcttggctgcagcttaacattgagttgttgaaacctgctagtgtaaatgaaaaagggctactgatatttatatccaatctctaaatttttggtttctgttatagattatgatttgcagtttgggttatatgctgacatttctaaaattagtaataattttaagtcaatcatcacacatttatgaaacaatatcaaaatatttagctcttcattagggactatgagggtacaaaaatataaggagtgaaggttcctatgcaaaactaatttataattcagtgagggagacaaaagagatctatggaataattagaggatgaagcaatgaaaagtgagatgctaatcatgcagtatagtggcaagttgagtagagcctgaaaaaggtgaagcgctgtcagagaaagattgatgaagaacatgcaatttttgtagttgcttagagacactatgtgaaatattagagatagatagatgacacatgaaatcttggttctcagatatttgttttaatatatatatatatatatatatatatacacacacacacacacacacacacacacatatatatatatatatgtagaaatactggtctctgctctgtctttaacttatgccctgtctaattgatatgtagaaaatgaaacaaactatggtagctaatggcaaacctgggtgatatcttaggactttgcactgcaagctgatgtgtattctcaaactttaattgtattgtgtaatgaatggcttgtgagttctgacagatatacttcttaaaaaagtgatttgcaggattttgtttggaaatagctccctgatctaaaaagaaagactttttaaggaattttcttagcttgaggaaaattgtttgatgtgtgctttatgagttatgttggattacatttatggtttctaaagtttttacaagaaattttgcatggaaatcgttgttattctgaaggccatcaggaaaaataaaaatatgttgattatcaacatagcccataggtttgccatctatgtttctcttagattataggggtgttcatgtttatcccactggccaaagatttcaaggtgcacctaggccttatattactaaattcaaaaatgataacttaatttcatatggtattcactaattcacaaaaggcttctgtatactagctttattattattaagtatattatgtcagctttagttttcttagtctttgaaagaaaaccaagcagcaacattgtttttgtcatatgttcattacatatttttatgtaagccataacatcacacagtcagcaaatattattggccaactaaaagatgcccaaaattagacagcatgttttgaaggataaaaaatgtatatgcagaataactacagagtattgatatagagttctctttgagtaataaaacattctgagctgagaatttccattatgcaagtagtggtttaaggaggttgttttcgcagcagtgtgcaagatgaatgtacgggggaaagaaatgggagactgcctcttaacaaagtgtagctgtaacaatagttatcactttgtaaaatgatagctcttttgctgtgattggttattaattttctttaaagtcatattaatatttaataagatatttatttattgaagaaaaggagacatcaactactgtgccacaatgattacctgtcattgtggaattaatatataaagactttctcagaaagttgctgagtgcctgaaaaactactgccatcagcaagcccaactctaaacaatagtttaagtggatgaagattaaccccaggaaatcttcctcctttcttaatgtgtcctcctatcatgcagtgctaggctctccttgatgtcccctggctacccaattctggattctacctagttactgccccaaatttagactgctctcctgatctccagcaccatcaaagcttatccaccactactctgtgacgagaaccaagtaaaattaattttagctaagattttaattactgataatatgagtgctttgccagccgattctaatacataaaactctggtttacttaatcaactgcaatactataacaaaacaactacacaggaaccataaggcgggttaaatagtgctccctacccccaattcaggtataccaggaaccctgaatacaaccttatttgtaaacagggtattagtttgctagggcttccattacaaaataccacagactgggtagatcaaacaacagaaatttgttttctcacggttctggaggctctggagatttggtttcttctgagacctttctccctggcttacaaatagctgccttcttgctgtggcttcacttggcttttcctctgtgtggcagaatcactggtgtctcttttgtgtgttcaaatgccctattcctataaggacaccagtccaattggattaaggcccacttatatgacctcatttaaccttaattatctcttttaaaaagtcctatctccgaatatagtcacattccgaggtcctgaagatcagggcttcaacatataagttctcggggggacacagtttagcccatcatagggcctttgtgcataaagattgttaaggatctaaagatgaagacgtattagatttatggtgagttcttataagcagaggagagaaacaattagaagaaggcctgtgaagacaggcagggattcgtgttttgctgctataaaccaaggaatgccaggagccaccagaatctggaataggcaaggaaggactttttcctggagccttcaaagggagtctggctctgttgataccttgatttcagacttctagcttctagaactctgaaggaataaaattctattgttttaaactaccatgtttgtggcatatttttacattagcctgggaatgtaaacaaggacaaagacctctaaagcatctccactggtcatctcagtgccttcttatagacagacgtatataaagatagtctagtattaattcttgagaagaaaatttatcaacaggttttaagggggggcgggaaatctctatcttcaggtttccatttttataatctatccaaatgcttttttgttcaatgaaaaatatattaaatttactgattctccactacaatgaaatgtttgagatagtatcataaaatagtttacgtctttcttcatattcaaaatactcatagacgatttttatcctcaaatggctgaattttgcacatttacgtttacaaaggaggaggagtacaaaggagaaggaaaaagagcaggatgagaagcaacaactagtgtttaaaaaatagcttgcaaacgtcaatcatgtgagcgttcccagaataatttctttctttacaactggttttaaaatagagtgacagtggctcaaaatggcaactgccaaaatgttaaaaaattattaaatgtaaaggcaacactgaagataacttcgatatgttcttaacaccagaatttggggtgaaatttggggtcatagctattcctattttattctagtggtaaacaactagtaaaaactatgctgttgcaattgccttactggcatttccttactacataaagtgtacatttattttgatatctaactggcaatgttttggaggcatattttttaaaaattgaccaaagcctagtacatattatcacaggagaatgttaacctattcactttctaataatctgcttgtgtactataagttattcatgatttcgggcacagtctctaagtgtgtaagcagctaatcatattacacatatggaaataactctaactctactattggaattgtgaggagatagatgcagaaaagtagcaaaccatatagatctactgcttttgtgaggaattaatcttgttgacatacttatatgagcttgcataaaaaatgcctggaaagcatgctgttgaattcagttgttcattaatattgatcatatgctgtccccattgtgttaggagctacttaaagattacctgcaaaagtattacagcattattgattttaaaactccctaaagcctcttgtatcttgaaagtccatttatgctttcattgttaagagtgatattaccattgttgtctaatcagataatttcgaattttatgaatactaatcagaacacaagctcctagtcaccactctgtatacttcttctgtatgccctaatgcatagaaagacaaacttctttacaaggcttttgaagtgacaagcaattgagattgcccttgtcttctatctttttgttttacaagctctgagtggttgaataatactcatttgttctcaaactttgatctgctattaaactgcttcaaagctgtgtgagagtgatatacatgtgtgcttgtatgtgtgcgtgtgtgctggtatgttatagaaactatatgagatgcctcaaatgtactatagttttggctgctaaaattaagaatatggccgattcttaattttcatgttttaatatgttgccactaggaaatcctagaattaaatttccaggaaccattatatgaacaaagaaatgtattaataccaagcatagtatattcacagtaaaagagagccattgaaattaccttaaaaaatgagatacctaaactggataactaaggatatttttctgatgtgagatttgtctttcagctgctgacaattttaataccatacaaagtgcttatcccaaattactagcagagaccagcacataaggagtacttaatgaataaatgttatttaacctgaaattagtgggggaaacaccttctgtaacatactgggcagtgtccatttctttcttatcctcccagtataagcaacactatatgctctaggtgattattattacttatagtgttacaagacctttacatattactttagtaatattttttttcagtatcaaaatagagaagactatggaatgggggtaaccacaaagtcaaaacttttccaggatttctaattctcatatgaatagcctgcttattatcacttggggcaataaaactggaaactgttgcaattgagcatcaaacataacttttggctaggaagcaacttttgtaagttgagaccttggactacatttattatgttatctttatatactaacttgtattctgatcattttatcttgctcatacatgaagtgaatgtttttatttatatagaagtagttaaattaagtaactcaaacagttaatgagattatacaagttacatttttcttgattatgtatttgccaaagaattaagatacatgtaatcattatgcaaaagtacacattctaatggtctgttatttacaattcagtgtaatacatttgaagcttaaaccatattagagacaaaacacattggaatctaattataaatttaaaggactagaagcttgaaaggtgtagaaaggttccagaaaatatctaacttaattattgagtgaaaatccaaaagaaaatgatgtcataaacctaaaattagaatacagtgtaggcagcaaatataatttttagaactcattattgccatatccttgtttattcaaaatgtatcaaacacctactgtgtgccaacgttaagtcttcccacacagaatttatggtctagtagggaaaaacaataggaaaccattcatttcaacactctgtcatgagtacttgaaaaaaagtctgtacaaggcacataacatcagtctcacattataattacagagcctacctctgttcctaatatctaatacactgtgacccatttcctgaaaatattctgaaatgtttccattttggagtcctgtattatttataggaatgtgcttagtgaattcatgctgattccgtttacatctgtgaagactaacatgaatacacagattttcaacatggtaggaaatgtggcttaatggaaagggcatagactttatagttaggcagagtgtgttaaaatctatgctttttcagatggatatgatacttatcctccctgagcccattttattgcctctaaaacaagattatagtcttacaaggcattataaagataatatgtacactcatattgtctagcatgcatgcaagggactctagaaaggtttaatctttggcccttttgctttactccatcctcatccattaaatgaaagtcactgaatttcttggagtaggaaaaataacagcagccataacctctgaaacacataatctttttctaaaatccagatgtcagccaaggtcatgatgtcttttggcgtgtaaataaaatgagctccaatgtaccaattcacatcatctagaaatcccagaggctgccccaagattgctggacaggcttcacctgtgccctcaggaagtgtccagaatgcttgggacttaagaaaccgctgttcactctatcttcagcttcctgaacccattggattcttgaatctcttgggcatcacatgcagcaatacttttccccttctgccaggataagccacatcaatagtatagccctttccccttgatttccccaagtaccactcacaggcttgtgtgtttagcagctgttattatagagctagatgctccagcagaagcaattcacatagcatctgtgcaaacaacttaaacctgaattttggacatcacaatttcttactagctacttttcatcacatattacagcctccgagcacattgcttggattctgtctctccttgaagactatatttctgcctttccttttagaatttctgcttctcagttttctgcatccattccccagctcttccctttatttcgcagatccatttaggtcatcttgctcttctcaccttctagccaagtttcacttttacaaagacatagtaggcttgagtaaatagcatcatagattccaggttcctatttgccccatttttgtcagagagacttccatttacctccttccttggaatcacttgttgttttttgttgttgttgttttgttgttgttgtttctgagatggagttttgctcttggagcccaggctggagtgcaatggcacgatcttggctcactgcaaccaccatctcccgggttaaagcaattctcctgcctcagcctccgaagtagctgggattatagccatgcgccactacacccggctaattttgtatttttagtagagacggggtttcaccatgttggtcaggcttgtcttgaactccttgacctcaggttatccacccacctctgcctcccaagatgctgggattacaggcgtgagccaccgcacctgcccagaatcactgttttaactgctctcaagaactcgcagaggacttactgtttcagtcattttctattcctccctcgtccaaccctgtaagtgtgaaggagcatggaagacttattttctctgtgatataaattactccactctcttcggtaatttcttaccagttttggtttaaataactatttttcctcctaggaacaagtccttaaacctaatttttctcatattaagttgtttctagggaacatttctgaattcgtatttggtttttttcctcacctgcaaaattggaaagttggattaagtgatctccaaggactcttatttgcttaaaattatataatttttgactgtaattatttatatatttttttctttagcggttatgtgcttggctgtcagttatcagttagttttaaaatctatcatttttactctcatttgaagtgaattgatgagtcaaaactctaacatcactatcatttcattctcccctccccagttagttgatgctctgaggggtataggttttagaatcccagattcttagtctgaggcctcaatctgtcactggtagatattgattgagaaatattatataatctttctgaccttcagtatttaaaaaaaaactgtaaaagagaatgataatgacgaagacctaagttatagtaaagaataaatgagatgatttatgtgaaaagagtttataaattgtaaggcactatcaaatgttaattaatttgtgaggagggaggaagtggaaacagagagaggagaaggagagataggttctgcagcatgattttcattttgtagcaatgaaagaaaatggttcaaattgttctataactagtcattggtcattcaccttctttcctgtctcaaatattggcaatgtaccacctcgaaggcaggtgttagataatttaattgatatgtgcttcacagcacaaaactgtctacttaaataaatatattgtttttaattggtgtggtgctgacaaaaaaaaaaaatcacagagcccctgaatcctttttactttttgaaaatcagtcctatcgggaagtcaaggtccgggaactgtacagttgccacattgtttcctgttccatgtgtttctttgttagactccacaaccgttgaatttcataacattttaaatggaaaaaaatggagggtcaaatacagctctcagaagaagaaatagattcataaaatcttgccccagtgcatgacaaagttgcccaccttctaagtgcttcccacccatggttgaggtccgattgcagtgcttgaagtgatgctggtgattttttttttcctattcacaagtttgtttgtttgttttttttaaagtttagttttttgagacagggtctcattctgtcacacaggctggcatgcagtggtgtgatcttaactcactgcagcctcaacctcctaggctcaagcaattctcccacctcagcctcctaagtagctgggactacaggtgcacaccagcatgcctggatttgtgtgtgtgtgtgtgtgtgtgtgtgtgtgtgtgtgtattttttgtagaagtggagtttcaccatgttgcccaggcttgtctcgaactcctgggctcaagcaatctgcccgcctcagcctctgaaagtgctgggattacaggcgtgcaccacctcgttcagctcttgtttttattagtggctttgacccatgcaggaggagtcattctctatagcactctctgttcaatacccttgccccaacccagttgactcaagttattattattcatttgtccagctcttctaccttgcttcttgtttcagctgaacacactcactccttttctgaacaaatcctctagggctctcaaaatcacctcttcatacacagtcagatacttagtttaattacccttgctttccttttctaatatgtacatcttaacttcctcttcagtggcttttcttttccttataaatatgttctactctctccaattaaaatcagtacagactaaattagagaaaactgtagttttttgtttttgtcttttttcatctcccagggagagcttttccttccttcaacttgactcttcccttcttcacaatctcaagtctggattctgtcctgagtcaattaacatcctgcaggaagaagactgtaagatagaattaaaagtgtaaaagatttttggggggaatgtctgtgatgcacaaaggggagagagagcaagagtagataggatgagcctacagaccgtgacatagcctgtcactttgaagggagaaaaggaaggagagaacatggcatagaaaaagtctcaaactgctatggttttaagaaaaatctcagccacaccattggggcacctcagagtacagaatgtttattagagaagtctcaggtcaggcacgactggcccagctagctctatgcccctttggtatttagtttttggctggggagcctggccttaaaataaatgctgccacagcagatcctgtggttcagtagctgaatgttgtcagctaaccacactcctggcagctggttttctccaagagagctctgagcagcaccacactttcattagcagccacaggtactaaataatctgctgttactttctcaagtttaaaaatgaccatcagcccctcttctctaagtatgcaacttttgacggactgctcgttttagattggcagaaaatgtgcttccccagaggtatgctccaccataaactcatactctataaaagctttgcagccagctatccaattcacttggtttatgtggttacagccatatgctgcttgtaccagcaggggacaaaaattgtggagttgtgaatacaactccagaaattgctattcaatattactttttaaacacccagaaggtattctacaattcagaaattttaataatatctaatttaatgctaataattttttgagtactttacatgtgacagacactgttctgggtattttatatgtatgaactcttttcatctgtattataacctcttaaggcaaattttttagtattgacatttaacagaaaaggaaacaggcatggagaaggtaagtaaatctctcaagactgcacgcctgtgaagtggtgaaaccaagattcaaacccaggccattagtctccagagctcatacaaccagtacatttactatgccactaatatctagaacacttttttctgtaaaattattaattgcaaaatgttgacctaatgtctacttttaagaatatgcatcaagcagaaatatttttttctgtctttcaggtccctgcactcctaatccatgccataatggaggaacctgtgaaataagtgaagcataccgaggggatacattcataggctatgtttgtaaatgtccccgaggatttaatgggattcactgtcagcacagtaagttattcatagtcattgtacttttattattattgattacaaagtatacaagccatcatcattcttgtttgtagtagaatcatagaatctgagagcagaagagagccctggctttggctaatgctgcttctctcccatggaatacaccatgtccacagtggaggactcctagactgtgtttcaatcctcccagtggcatgggaagtttgtagtcttctggtcatccctttttattattgccccactatccttgccaaaagatgcactttacattaaactgatatctgtctctttcatatttgtcctaaagccacatcctttaagttttccaaaaattactctggtgattaggttcagagatgatacccagaaaaaaaaaaacaaaacacaaaactgccaccctgcccttaagccagttttctccttcttacatgttggcatttttagtgtgaaaatctttgaaagctcaataagtatgctacctgcacttcttttttaaatcccaattcttatttatcttggaaggttaaagaaagtagatcccactagtgatgatttcttcttagaaggaggggtgaacataaatgtcaaaggaatggtgtggtgccttagcactgtaggtgttcagcaagcagaggggccacagccaactctaagctgtcagggagattctcacagaggttgccacatgcaagctgagtcttgaaggagggacagaatgttgatcagagacaggggaatgacacatagtaggaagagtggggaaggaataggcaagccatgattactgtattgatgggtaagacaatggtattaagaacgataaggcaaagctggatttgtcagcgagagctgtatccaagcaccagcaaaaaacagagtgccttcaggctctgtgactttgggagcatcttgtacttttctggagacatgccatggccagaagtttgtagaatttccgtagaaacctattgtagtgcatgggcgtgtgtgctttgtacaacgggcatctaaactacttggaattgtccctaaaagctcagatcaccaacaaagcaatgaaaagctattgatttttctcaggttgggcccagaggtgccaaggctaggtctccctgatgctagctagcatcactgctcagccttcacacatggacacttcaaaacagccctggaaagataaagataggagcccagaatctcaggagccttgatgttcacttaatcccatgaagaccatgttacttacccttacttaccctgtgatgtggcatcagaggcagtgcccagagggaaacagactggccaccccaagtcttttctctcatagcttcatactatattcaaacaagcttataaatactatattcaaactatagcttcatactctgttcaaacaatatataaaatatagcttcatactatattcagacaagcttataaattaatataattttgttgaatttcaagacatttcaaagcacaaagaaatctttccccttaatacatctgaccacccccacaacaagattttaaacccatgttaggaattgcagtgggaattgcagtgggaacttggattttgttgtctaaaccacctagtccctattttctgcattgcattattagaagcaacagaaaacagaggaaaaaggactggatttggaagcagaaacccagatttgagacctgacctttacagttattaaataagtgaccctgagtcagtcatttgatctctctgtgatttttagacgtacaaattggataattgaactggaaatagatggtctttggttcatataagccatgagtattatgaataaatggatagcttactcactgtacaaaggttagcaagctgtcctctttatagatgaaattgaaaagggtgatatattgagaaagcagctatagaagtgctaggggccctggaagcttcttcagctaggaaaaacagaaaaagagctctttaaactcttgcaaggattgctaggtatctgggtttgtttttcatggtggtaatagttttatgacctagatatttagaaccttgctactcaaatgtgctcgtgcatcaggatcttcaggaagtttattagaaatgcagataaacaggcatcacctgaaatcaactgaatcagaatctgtattttaaaataattcccagttgactctcatatacactgaaatttgagaaatactacataaggctttgaatagccaaaagtgataatttcatagcttagcaactatcacgttcagttacataataataaatataggcaaaatatttaaggtttgtgaaaatcaaaactatactgaaaatcaataaaaatgagagttgtacaaatatggcgtgaacatttcatttggaaaaagaaaattaaacaatttttcagacagctatattgggggacttttaaattttgtcctatatgacagaatgttaactaaatgtcttttggaaaatagctagacatttaaagaactttaaatttcatgatacaggagtgacaaatatatagttaataggtctattttaacaactattttatcaatatgtgacaaattggaaaaattatttccagcatcggcattattacctccatatgctttttaaaatgtttttggggttttatcattaatagacttaatttttacagcagttttaggtttaccaaaaaatcaagcagaaagtacagagtcccatatatccctcctcctacataatttctcttattaacatatctcattgctgtgatacatttgttataattgatgaaccaatactgttaccttattaccaaagtccgtagtttagagttcactctttgtattgtatagttctgtgggatttgaaaaatgtataatatcatgtatgtactgtcacagtatcatatagaacagattcgctaaactaaaaatcccctgtacacctatttatcctttcctacttctctcaacctttgccacggatctttttactgtctctgtagtttttccttttccagaatgtcatgtaattgaaatcacatagtatgtagccttttaagactgattttttttcacttatcaatgtatttaaggttcctccgtgtgtttttaggacttaatagtttatttacttttacctctgagtaataatccattttatggatgtaccatagtttgtttataaatttggcatttgaagagtatcttggttgcctctagttttgggcaattataaataaagctgctatagacattcatggcaggtttttgtgtggacataagttttcagctcatttgggcaaatacctagtagtgcaatttctagatcttatggtaaaagtacattcagttttgtaaaagaagcttcaaaaggtctccaacatggctgttttgtatccttagcagcaatgcatgagagtccctgtgttctacatccttaccagcactcgttgtgttttggatttcagctattagatgtcctttttatggtaatgaaagtagcatgaggttataactttataagaataatgattagtattggatttggtatagaattatcaaattttatatatatatatatcatagaagaatgtgaaacacacgcatgcgctcacacacaggcacacacacacacacatatatacacacatacacacacctctgtgtgtgtaaattatagaatgaattgagcaccaaaattgtctacaggtcaaacttttgaaaagcatttttaagcaagcagttttgtgctgacagctgcatttgggactggctagagtaattgtattttatgtattgcctggtaacaaatgtaatgccatagagaaaggttatttcttcactcccagaactccttcccatcttcccacagaaggcattctgtacattcttctctacctgtgcacagctccagagcctttgattccttttaagagcacattttcttctttcctacttttcaagaaaagagggctgatctgggagcccactgagcctggaaagaaacaggacagtttaggagaagtggcccatgttatcacattagctcaagataaaaggctccctaatatatatatattatatatatatggaaatatattttatatataatatattttatacaatatatataatatatatacaatatattatacatacaatatattatatatatatatatataatatatatatatatattttttaccactgagaaagttggccagaaaaaaacaatcaaaaacttccctctttgtatattctaactactttaagtcagtttggtcttaattgtatattagtgattaatgcagtcctacatttaaccaatatttattggggtcatgaatcacttttgtaacttccatatttcacttttctcaaagttagtcaatgatatttgctgttttcatgatcattcttaattgcattaatcacatatttggcaattacgtgctttgtcttctatgttacacttgttaaacatgtagattactggccccacttcagccctgttgaatcagaatttttgcttggtagcctgaatttagttaaaaacatccatatgatccttcagtacaccaaacttgaggattactgacttaaggaatgaccactaccttcaatcaccaaatgatactggaggaaccatgctgtgaggggaggaattctggttggacctgagtttctgatacaactctatcttggtaagttgatgaagcgtcattcggcatttaatggatctgtgcctaaggtttctcatccagtaattcagttcacttcaacaagcactgagaccttgacactgttgagtgtggaaataacacttctttaaaaactgtgattaacaatcctttgtcctgcttctctaaacagatgtgtgttaagatcagatgaggcgtttcaggacatactttacaaactttaaaaagttaggtatgcctaatggactaatactttaaaatataatggggattgctatgggtctttatttttttcccttcctttaaaaacaattataattttttaggaaacattttgtgtagtaaggcagggggaggctaaggctcactatgtagctccatacttttctagaattcctcttatcattaattcttactttaagttactctttataattttaacttgatggcttcttttagctttttgttgtgttggattgctattaatgtcagtggggatggcacaaggttcgagaggccaaagagacccagaaccaggcaatgagacatggggtttattgaagtggaggttacatacagtgtggtccagtagcagcgggctggacagaactgccaccgcctacagaaagcatgcagtttaaatagcattttcacttaacaccctccacctggcagtctccacctagcttaagacgttattgctatcaggtggatttaccatacacctcagctcagaatctccttgaatggccctaacatttttatcgtatcattcttccgtgatttccccagggccaggtatgcagaggagcattgctgccagatgtggcagcagcactaaaaactacaacaaaaaacaaataacaatcactctgcaaagattgttcttccaagcacttgggagttgatcctgtacatgccacggcaggcccatggtggaaagcagcagctctccatagacccaacagtccgtcttgttctagagagaggccacagtctgcgcccagtcagtgaagaggttctctgcctaacatctaaccagatgacacccaagcacctgaccaaaacgcttgaaccttggaccctctctgcatcaaccatccatcctccatttgcctagtgggacaacaaggtgggggctgcagcctccaggctggaaaaagacttagaaaccagcatatcattaatgcaatggaaaataggtaccccctccattccataaccatctattgttgttataggccctttgaactgatgaatgttaccatatatgagagtgtattccactctagtatccactagggcaagcacagcctattcttatttgtccaatatatagttagttctacatatggcctctgtcctcagacaccctggccaccattgctcccatcagaattttgaagccttggccttcatccaggtctaaaagtgcctgcccttgccatctctctgcaggagaggcagtgaactgagcctgaggctctttaatgaaactttgttctggcttgagcttctgccatagcctgaccaagacagcatcaggttgtctccaccctcacagtaggcattcctgctagcatgccatgccatgtcttcagcaggccaccctgatgggcccctcatctgtctcctttcctttggctcctttgtctttcatcccagcagtgcaccaccaccccctcacaaccccacgcacagacgagtgcaccatacctttggtttggcagggactcttagatggcgtctttcatgccagcaagaaaagttcattgctgggaccttggcaatgctcagcatagatagcatgcttcactcctaattcccggaggagtgccctgcaatccctccatagtctgtcatcacaaaggccacgtggggacatctccctcacttggcctggctatcttgcagcaacactcacccagctgaggagggggatggccccgtctccattactggcaccacagaggtgctgcttccaggccgggtggtttgtgatggatgccattttgccattttactcatctcaagtctggagagtataatagcctctgcctgcatgttccacagatggagaagccaccccatgattgactctctacccttctgtcctaacctgtttttagctccaccaattctacagtggggtcgtcccatattgtggtgcgctgctgtcttccagggggcgggagaggggggcagtcgtgcgagtctgcttccagtgggtgcaggggagttggtgactcttcatacaggctacctgaaaagccagggtctccattttgtctggcacctctttgtagtcacagctcgtcctgcaactggcagaccctcacttgcaccatgagctcagcctctatggctgcttggagcagggtcagaagccgcccaccaactgtggctcccacagctcaggcatctgaccctcactcagtcagatccaccccctgcaacaactcttccagaccactcagtgttttcaaggcacctccatactcatgtggtgggccccatccatcaagtataacagctaccaggccccacacagacatgcatggccagcctaggatttatctcgcagatttctccttctcagatcctatcttctgggcactcatggagttttctctgacctcctgttgtcatgctggacctctgtttacttcagtagggatggcactaggtttgagaggctgaagagcagacccagagccagcaaaggagacagggtttatcaagggggaattacatacagagctgcccagtggcagtaggctggacaggagagccaccactgcctgcagaaagcatgcagttaatatagcgtttttcacttaatgccctctacctggcaacctctacttagcttatcattgttgttgggtgcatgtgccatgcagagtcattctcagggtatgcttaagttattgctatcaggtgtatctaccaaatacctggtgtacagtactggtggttgtacagtatacttttccactagaaaaccaatattccctaataaagaattcacctcattctttcctctttttcttttatttttatttttttgttgttgttgttgttgttttgtttttttgagacaaggtctcactctgtcacccagtctggagtgcagtggtgtgcaatcctggctcactgcaaccttcatctcctgggctcaaatgatcttcccacctcagcctcccaagtagctgggaccataggcatgccaccatgctgagctaatttttgtattttttatatagtcagagtttcgtcatgttgctcaggctggtcttgagatcctgggctcaagcaattcccccaccttggcctcccaacatgctgggattacaggtatgaatgaccatgccaggccaagaattcacttcaaaaactgcgtaaatttttacctgaagttattactgacacttgcaaactatataaaaatattggtgaaataaagacctccaaagaaacttccaaaatggacttgtctccaaccctagaagattttcagactagaatcgagaaattttcctgctttccaatggctttgccggttagtgtgagacaccttaactctgtaaactaagggatctcacacttgctgtgcatatgaatcatgtggggtccagataagtatacagattcctcttgccaatccatagagatttgaagttaatagttttggagccatgtctgattatttaataaggaccccaatgaaagtgatgcaaatgggtctggaactctggttttcaatcttggctacacattagagtcacctggggcattataaaaaataccaatgcctggctctcaccccagagattctgacttaatttatctggagtatggcataggcattaggagtttcaaaacctccccagataattctaatgtacaactaagactgaaaatcagtgttctagaaccatatgtgaagggttataatgccttaaagaaactaagcacagaaatagtcaaagagaaaccaagcttgggataggttattataatcccacactgaatgtgtaatcgcacaaccttattgaattcaaactttgtttacgataatggaaattgtcttataacaagaaccccaaaatgattaaaagaatcagggcagaaaaatatattagcttactgctcttaaaatctgaccctcacttaatcggatccaccccctgcaacaacttttagcccataacctatctataggagccagagttccaaggcatttttattttcttgtttttctcctttggctggaaaccaacaaagaccactgtcatggcagacatatataatagctatttgcacaaagacactattccaatatagacacaaagtttgtgatttttgtgatactcagatatgtataaagtccaaaatagttgaaaattgctactttagattaacagtaaaacatttttttcttttctattctttatttttttaatatgattgccagaaaaacaataatctctgaacaaaaatgttagatgcattttgccagaagattatactcatgaaggtagtatatttatattaataggcctgaacttctagaactgattcagccaggtgcggtggctcacagctataatcccagcactttgggaggctgaggcagacaggtcacctgaggccaggagttcgagaccagactggccaacatggtgaaactccatctctcctcaaaatacaaaaattaaccagccatggtagtgggcacctgtaatcccatctactctggaggctgaggcaggagaattgcttgaacccgggaggtggaggttgcagtgagccgagatcacacccctgcactccagcccgggcaacaaaacaagactctgtctgtaaataaataaattaattaattaaaataaaataaaatagaaccgattcataattttataaagattgttcccagaaatagaaatagtattacaaatgcagtttttaaaaaattgcatgtaattcaaatttcctaggccttgtagccaaaggtgatactgatttctaaattactgttgctcttagttatcatcttccaagtaagttgcttaggtaggatttcattctcccctaaagtcttccccagccatgtgaggaaataacttatttatttatccatttgataaatatttaatgagagcttacttactatttttcagaataccactgctgttgttctgaccttgaacatagtgataagggaagactactccgttctctgctaatggtcacctagccaactgaaactgcacatggtctaaggtcaaggtcaagcctagccgttttaatggcattgggtcttactatgttcttgggagttggaaagacatgtgtcttttcccagaaccttacaaatctttttgtgaacaccgttgctcagcctttcttccttaacttctctttcattcagggttcagatatctcaggctatttggagacagatgctatggccacacctctcttattctcctctctactgtctttcccaagaaaccattttgcaatatcatttctcctgtaaaggcagctataaacaagagaataaattttcatgaggatctgaagctcacttatacaacaaatatattattaactccctactcagtgcaaagcactaatctggatagtggaatatagcactgaaccaaaataaccaagtctctgctgtcatagaacttcattaatggagaaaaagatgatgaaaatgtgacacaggcattaccatacagtccagcaattacactcttgggcatttatcccagataagtaaaaagttaaagttcacacaaatacctgtacctggatactcatagcagctttatttgtaatgcctgaaatctagaattgcacagatgtccttcaacaggcaaatggttaaacaaactgtggtacatacataccatggaattgctactcagcaatgcaaaggaaggacctattgatacatacaacaacttagataaatctccaggaaattaagctgagtgaaaaaaaaaagccaatcccaagagaatacatactagatgacccatttaattacatttttgaaatgacaaagttttagaaatggaggatagattagtggtttccagatgttagggacagagggaagtgagtgtggttataaaagggcaacatgaggtgtccttgtgtttgaaccatttcgtatattgactgtgatgacacatacagaaacctacatatgtgataaaattctatagagcctaattacatacacatatcaatataagtaaaactggagaaatctgaataagattggactatcatagtaatgtcaatattttggttctgtttttatactgtagtttgtaaaatgttaaccattgaggataactgattaaaatatatatggtatttctttgtattatagtttttcaaatggatatgaatctataattatctcaactaaaatttcaatcagaaataacagcaccacaatgcataataacaagttttgttatgttttgtaagaatggagattatggaacaaaggggcgtgagtgctgttttagagcttagccaaagaagcttgctcctaccaagtaacaagcagagatgtgaatgaagtcagggggtcaagtatgtgaatcacaaggattagcaagtattgaatcctaagatgggtatgtgtctggagcatggtgagtgattaagagagtgggcagaaagaggacctgagcaatagtcaaggacgtgtaagccatagagaggacttttagttttattgtagttgtgtaattgtaattgtggaagcacacttttggaaggtggacagcaagggagtaaatgaactaatttctatttggagaatgattctggcagatggcaaagaataggttcaggtgggggtaagcgtggaaccttgcaaccacctgggaggtgatggtggcttggaccaaggtagtaatgaacacttgggaggagttgaacaatgttcgtatatgaaaaatagtttgaagtcaattacgaccagcatcataaatatttatgggatatttttgttaatttcagtagcattataattatttctctttttacctcactttttactatagatgtgggcagcgtaatatactgttcttatgatttcaagtatgcattgtgattgccactctttctatctttcaacagcatcattaagatagaatctagaaatttaaagagaaataatgtatatgttcatacatatataggtatgtacaggtacaaggaaggtcttaaatatattcaatgctatttaggatgttgaatttttaatttttgatatttttaaaagacccataaaattggttgtctttagatatattgtgtgttatgtgtcatgatagtgtaatgcagtatattttaaagaaaacataacagaagtatgtaaatcaagactaataattacatgctaaaatacaacaatgattttaaaaaatagaacatcatttacatttgaataggaaatctggaaatcacagttgcatagagtggatatttactaatgtcagcctttagaatgattgattttgctctcaacattttaatttattttgcaattatgccatagcctagaagtttagagaaatttaaggcaatgcatcgtttggaaataagcagacttagatattcaggagattttaatcattttatatgatatatcttaaattgaaatatttccaaatgagaattattctctccttgatctgaaaatgcttttttggttgataagtaaaggaattgtttctgactttttctaaataaaatgagtgcagtttatttggataatgacagcatggttgttgaaagagctgagaatttaaatgtagaaaagacttaaacttccattccttctatactcttaacaagtcatatcaactttaagtaatgataataacaggtcttggtttccttggttttagaatagaaataactgggccacttgcctattctcagatcccacttggtgatgccctgtcaatttagtatatgtgatagtgttttgtacaattaaatgttctgtatgctgataaactatcattcttggtattattggttttcagaatacttattctttcatcatagtaaaagaaatcggtactaaaataaaacagaaatagatactgattttatctgtgctaaattaggcagtagagaggattgaaacaccaggtgcctcaatttaaaaagtaacatcttataattgagagtgtacaccttctcagtatgtgaggtgagaagcagggagagaaggaggaaaagaaggggagagagaggagaggtgtgggagtctgaggaaaggaaggggcaaactcatgaacgctattgttctggttctacactttccaatcaaactccttagaagagttatctatactcaatgtctcctgcatgctctgagattagtttaagaacacattcagattttaatcacctcttaccaccttcacttcttcctaaggcagcattatgcactatgacgtgctcctaatgattttgctgactctacacttgctcccaatttattctcaaaaaaaatccagaccgataccttcaaatatacgtagtaataagtcatttctgtgtttaaaatctcccatggtttcatagttcacttcaagcagaatctaaagtctttatagtgaacaaaaataacctggcatgccccgttcctgttcgtctctcttgatcttatatccaactatactccaccttgctgattctactttggccacacagttctctgctgacctcagatgtgtcagtccagcttccagtctggggcctttgcattgtgatcatttacctggcctcctctttgctagataaccatgattcttgctccctttccttttcttcttagatcttagctcaagtaagaattttccagagtggcttcctccaactaacccgaagacaacagcattctttaacatcttcctccaccatctctttgctgttcctctcttttactcatctttattttcttagcactcatcaccatctgccacattttatatttatgttttaatatttttcttctctttagagagtaagcatcttttctagagcaaggacttgatttgtttacattttgctgtaatttgctgtgcctaaaaagtgcctagctcatcataggtgcttgataaatatttgttaagtaaacaaatgaatgaatgagccttggtgtgttaaccaatgaatcatttaatgtattgtctaatagcagtctatctcccatgatattgggctttgaaaaagacaaacaaacaaacaaaacaagggagaacaacaagggagaacaaacaaacaaacaaaaactcttaaatagtatgtgtctttaagagcttataaaattaatgtgaagaaaaataatacttcctctaacaagaggcccatggccaaataagttgaggaacacggtacctcatctcctccttttggagattgtcagattgtcagtgtttattagatttttggtgaatatgaggagccatgtagtatataaagattgctaaacaaataattgttagataatttttaaagctttttaagattgtttaaatcaatcacttggaagacagaggagtgacagtggcatggaaatttcaaaatggagagtttagtatgcaaaggagagagggcagatggaaacaaagtgaggcagaagcaagaaaagatgaaagggttattgttaaatgattgataaatatgtaggaggcaagggtgggtggaattgaagtttaatgcagggttctgttgcatttgcacatatacatgttttaatacaaatatacagtagaaggaacagccacccatgcataactgtctacaagcacttattcagcacttagaattgtccccacaaatagtgattatgttaatgttaccttgcacgtggtgccatcctttgtctaaaagatgaaggagccgtgaacagtgctttccatcaagattatcgagagagccatttgcctctcttgctgctggaggttttgtcattatttgttgtttacagtgagcacactgtttttgttggagtcactttgcttctcatacctttagtccattgtcagctactatttcccagttgtgtatgccttaatgctacattctcacagcctaggcagtgaatccttcaagagcaatattggaaggcaggagctagcagcacttagaagaggaatgcagcacaagagttgccgttgtgagaaatgatgccttgagaaacggtagtcacaagtaaaaggtaaaacacaggtagaagatggttttgtcgtagatgagatggctctaaatatgtgacctttcctgaactgtgtcaggtgtgtagtttcttttcttatagaactctaaacatcatctggtaaaagaaaggaatatgggaacaattcaatgtgaggatcttgcatttgtccggccatgtacatattagattataaagttcctaaggaccagagtctagctgtatgctttatttacattttaatagcaagaagcacagttagggacaccagcttcacaatctgaacctattctcttgccaaaaatctgaccctgatctaacttccttaatttattttcatattcccctttacatacaaatggttctctaaagttagccacttgccatccgtccttcaggatccttaatttcccattgtcctgcccttgctgattttctttctgtgcctggaaagcccttgcccttatcgctcatcgataatgccaggcccagatcctccaaaaacgctcctaggatttctacttcctcaggcaggaaagtccctctgctttcaaccttgtaagacacttacttcttcattctttctcccttgttttgtatttatttatatatttctcctcactccaggcagcttaaagataatttctgcctgagtcatctatgattcctgatcaaaacctagaattgtgatttgcatgtagtaggtactcaaaatatattgggtaaatgaatttataaataagtgagtgataagagcacactaaacacttgtttatggtttgactaccaaagcagaacgctagagaacaccacggtgaattgcaacagagatcattgcaattatcttgtcttttgaacttgaccagttggggttatttaccactacttggcagggatatatggctattttacatacggatatttctcttatatctttcaagggtgcctgtcacatggtagctgtactataaatatttattgaatgaattagtgctggcatattttaccagtatatttttaaatatattttatttaaattcaaggaagcacatatttataatttctgaagtatgaagatacccatgtcatcaagtaatgagaactataaaagctattttatctacatagacaaacttaatgttcaaatccagtaagtatcctagtctacgttcctattcttcccaatcatttaggatacctatttttatttttatatctacgtctcttcatatgtagggattttactgcaaaccgttttaactgatttgtggaaaaagcagggcatatattaaaaaaaatattttttcagatccctctcagttgtatctgcatatatgatgagaaaatcatagcacagcatatacagcagtagtcccttatggccagcttcagaggtctaagttggccttcttaaaagcagtcaattattacaagcttctaaagagctatgtattagtataaatgattcaccatatttaaatacagtaaagcaatggaatccgtttagaagtttataaggtagaatttgatgacatcatacttttgatgacaggatagtattttgatgaaaatggatagcattttctagtatggataatcattctcagtatcttcatttaagatgaattaaactgcaagtttatacatgtgttttgttttgttttgctaaaactttccttatgcatttttctgtctataaaagatgtcacaatgtccatgttaataccttactactaacattattctaagttacgtagatagattgacctagcatggctgattttgatcttaagttgcactgattagtcttttaagtttgattagatgaatttctgagctatccatgacttttttattaataaagtcatccaagatatttagtgtatttttgcattgatggtcttatatgttaaaaagtaaataaacatgaaattaccttatttccttaaagtaacttaattcttagtgagctttattttttaattgatattttaaactcataggaatataacgtatttcagtttctctttaaggtatagtctcataggaatgtaagtgacatttttgtctgagaacatagtctttctctttcctcttcagagcaaccaaattgaggaaaaatttattgccagctatctttctgccatagtttatggcctgcaattctcaaatggtttagagagtatatttaaaatgaacttcctggtcattttctgtttttcagggactttaaacatgatttgggtttgtcatctaaaagtagagtcactctttgaggttcaaatttcttgcccaacttttatttttaaagctttctcaaatacaaagctcaagagtcttggtcgatttaaaagcccactgtctgttttccctaaatatttacttttaaaaatatgattgatattaagtatgttattactgaaaaaggaagaaaaggactgtgggaaggtcagaaagaaataaaacactaagcttttccttttattatgatgatgtcatataatcagttacatatggactgctgcttcagtgcctttcttgggaggcccaaagacaaggggctatggcctaagctgtcctcactggatacagatcaaggacagagaaaggtatggggaatggagtacagttctagaatatggcagggaaagaatatgtgtggatttcctgtgggccagatgtggacttctcaaaaccaagaagctctgttatcttgggagcccaagaggaaaatccagagaaggtccctgtgcaatcaacatggtgctccaaggggatccagggcacagagcataaaggcccataaaagaaggcagctagaggtaaagaattcccagtgatgaaatgtcatcacagaaccttccattgtcccaggaaaaaaagagcccacaaagcacatctgccaaatccagatcaccaaagccatgtttcaacctgaccatcaaggatttcatctcatccactttggtactgaagatgtcaaaagaaactagagaatggaggataaggtggaatgagagaagagaatatcgccttaactcacttcccagttccttccttagacactgccaggagggaccccttgtcctggatctcacattggagatcttgctctggctttcttctggaaccactcctctctatggagcaagacatccatgggtacaagggaacatgcccacctggagacttattcccctttctagaccatgctgaagataatccagaacccagaatggtctgcccaaatggtacccagcatacttctaggccccatgtgagccccttctccatatctgtcctcccatgtgtcactgtgtcactagtgggcacacacctgggatcagtgacatgccatggaatatctgattactgcttgggaaagacagtgatcaggtgcttgggcttggatatctgtagagaagagtgggttgaaagctgtttctcttatggtcctcaattctaaattctaaattccaacctagttctaaatttagagttctaaattccaacctagtcttccacattgttagaaagataggtgacaaatgttttaaataatttattagccttatgataacttttaatgatttagacccataagagagtttccattgtgacccagactgtgaattttaggtgaggtcccacttctccactgcaattttcccaggtaggcctaagctgggaatgaggagttccaacttggatatcactatgaatttttagatgctacaaaactagacttattttagtaaggaaggtacaggcgattgtctagtagctaaaagtaagcttagggcatttttattacctagaaataatcagaaaaacaatggcagcttcctcaagatttgattcaggatcaggtagaaacaaatatctagtattaggtaaaggatgcttttgttttgtttgaaatattatagattgtgaagctctttttttaatgagaaaccccagtgctcattctttggttggggtgaatctttatcttacagttgtcctgtaatcttattatttgtccagataactagacccgagttaagcattagtcataacaaacccaggttttaaaaaggcattcgtcttgaagctagtcaaaggaatatatttttttccttctttatgttgggaacagtttatctatttaacacctatcaatcaatgagtagataaagaaaatgtggtatatacacaccatggaatactactcagacataaaaaaggaacaaaatcatggcattcacaacagcctggatggtattagagaccattattctaagtgtagaaactcaggaatggaaaaccaactattgtatgttctcatttgtaagtgggagctaagctgtgaggacacaaaagcttaagaatgatataatgaaccataggggcttgtgaagaagggtggggagtgagggacaaaagactacataatgggtactgtacaccatgcagtgatgggtgcaccaaatctcagaaatcaccactaaagaacttatccatgtaaccaaaaccattggtttccccaaaactattgaaagaaaagaaaagaaaggaaaggaaaaggaaaggaaaaggaaagggaaaggaaaggaaaggaaaggaaaggaaaggaaagaaaagaaaagaaaaaaaagaagaaaatgaaaatgacacctctcaggactgtggagaggatgttggaaagtgctgggtaaactgggaataactgggagcaatggaaagaaccattacctgcagctgaataagctttgattcatttaaaaactgcttcacgtgcagctgctgtttgtcaggcactgttctggaagagggaatgtagcaaaaaataaaacacaaaattcatgttttaatgtcgttaatattccagcaataaaataaaataaagtattaaaataagaaaaatcaagttctatcaaccattcattattctctaggagttataaatagttgaacatggttttatgcttaaaaacaaataggttatattttaaatccccagattcatcttcctagacactacttatagagtagttgtttccatgttgtgatgtatacaccccagaaaagttcaagagataatcccctgagaagtggaaagaaaataagataacttgcttgtatgtttatttattgttaacaagtacatgtattaagtgcattgcagtttacctcatgtattgacagaggcacctcactggagttgtctgtcaaaaaaaccagtacaaaggttctgaagaaggagtagtagttctacaaagcagaacccttttatcacaatgtgactattatgttatctattaaattaattctaaccaaatccacaattggcctgaaaagaaatctgcagagaaatgtcagaatgaagaaaatgccaacaacacaagcggtgagaaaatagctagcatttattctattatgaactaaatacaaaatattatgagataaagcagtgccaaagtaattatatgtaacaagagattggatcccaaagttgaaattatcaacatgatctataatatgtgtttacgtccaccattattgttgataaactaacccagagggaatactgtgttttatgcttttaggtattagttaatgataacatgaagccattgcaattgggaacatgctttaaaaatgtttattgtaaccatatctcattattttaaaatttatgtttcctatatacagtttattatgaacataattattcatttgttaattattgtatataatttataaattcttaagtatatatttattgaaagtgtgtgccacagttaaaattttactactgggatatatgatcaagtgttttgagactatggctagaaaggactagaatgtgtatttgttgaatgaaaaaaatatacttaacaatatatggggtcaggtaagcttgaacttataagagtaaccaataaatgagttttattacatttatataaatcatattttctgattctagctaatttaaagacaccattttctacctacacacttggtctacgtatgatttttgaaacacgataaaatttcaatcagaattttatgcagcaggaagagaaatacctgtaacaatgactgtgcctggctttcatgtagtgacctaagatggattaactcataaatgtactgtttatttataatagatagatattgccttttaacttttctgttaatggatgttttcacccgtgaatttgtattgcagagtggcaaaaagtggatctctggaaatgccagtggctaaaacgtttccacttggttgtgtatgtactggcaatggggatatcgttaaaacataataaaaatgtacattgttcctttttattgttcagtttgttcctttgttataggcaccacagggaatagttttatgggttttataataaatgagtttgtggggacataaaatgactagatatttggaggagtagagtatgattattagatcaatatcccttatgccgagaatggaactgcaacaccaaaacatgaaatgacagaatttaatttcttaacctcaggttttagaagttaaacaccccattaccaaaattaagagaacttatcacaaatacaggttttgttttttaagtaagcgtatttctaaacatcttaggataaaggtttccagacataaagccaatgatttctatatttatgtgttcttctatttttaactatccaattttaccatgtaattgagggataagtagtaaatagatgcaaagcttactttataataaggtagtactaggcactacacaactgaggaatatgaatgtatcttgtatatgctggaagcactttaaaattatgttttagaaatcgatgtatttctgtgctgatgttctgaatgctctttcatctttgatgtattctattttgtaggataattcagggcatgtctctgagaaaaagctgacatatttagatatgtaggaatgcagctgaatttgtgtgtgtattgctagtgggaattggataaattattttctcagtatttactttaatttccttcagtgcagataccattctttaaaatatctgagcagtattcactttcagagctaagaggtaaattggtaagacccttaaggttacccatttttgtgaattgctgaataaaggtaacaaagtgaaaatgccaaaatattacttaactctatccaatataattgatggatttataaaccagtcagatgtcaagttatttttactttcagtcatttggcacatctggttttacaatttttaaagaatctttcctcatatataacaaaacttgttgtgcctgttttgtctgtatgctattttaatgctttaattatatgcagcatgctgctttgttatagcaacacttctttgttctgtaatagattccggttatcattgtctagaaaatttcagaaaaatctccttcgattggcacccaaataggcagtattctaatgctgaagttgtgttttattttctttcttccaaatatttatgcatttagtaaattctacatttagcgttacgttatttttttaattcatactacatctctacaagaagtaattaaaagggaaaagcaaatttaccaacaagaatttagagagattaaaaatcttcttcttttgtatcattctctccacaggcttcttacatacaaaggtgacacagaatggtagctttaacactgttaggaacagagttattttatgtgggcaaatggaaatggtccaagaaattgattttgagaaaacatagaaccagactttatcattttataagttatgttgactatgcagaatgagataataatgtcagaaactatgtatacattacatccataggcaaatacatacatacatacatatttttaattgaaaaaagtaaatttttcaattacaccatggtccccaacctctttatattgattctttatactagcttaaatattatttactggattgcttacttcacatctggaatatgtacaaaactgtttcagagtcaatgattgagtaaatcccccatttttttaattttaagttcaggggtacatgtgcaggtttgttatataggtaaacgtgtcttgggggtttgttgtacagattatttcatcaccctggtattaagcctcgtacccattagttacttttcctgatcccacttctttttaaagagaaaaccaaaaggttgtatagagattcttatcaattactcttgacatttttaatagaaaaaaatggtaaaaaaacatccttagagctttattattgatctgctatgtttttttctaagaccttttgaaagaaattatggatcatggttaatttctggcatgaaaaaatggataaagacattactagagaaggaagaaactcaactgtgtttaacttctctttttctctttcggtgtctatgacgtgctgatagtactctggtctagtgtctcaaatgaatatatgttgaagaaagatttatttctggtggatgctaaatttttaaaaaagaattacttctcctgaggctttcctgaacaaactctgggaccaagattattgctctcttagggaatatactcttctgtaatttgactgcgcagtcagaagaaatgattttattttgggggctgccaccctccctagagagctgtatctaagccaagagatagtgatagtgataagaggttgttttcaaagtgctaaaaaagcctcttcattagcaacatttaaacttagccttttaagatagcaaactgagcatacatatttagcatccccttattctcaaaccacattgaagtgacagtgaagattaaatgaatttttaaaattaaagaataagtttgtaatagactaaaagtagcgagagggactattagcaccccagtgaattttggcatttctagatgacagcatacaggagggaattgtgttgataaagaaggagtccttgagcctacatccctgatctggaaaagtctgaaatggaagtagaagctattctctgcctagtggaaagggtccaggctagctaggggtgagctggtacagagaacagagtagacagacagcaggtaaattaattaagaactctggaacagctgtcctggttgccctcctcttcccttccctattcctccttcatataaagcatgatttccaaggctaaacctagaagactactgtctccaaaatttcagagtttactaggggaaaacttgggttcctaaggcagaaattgacaacactgaataaaaccttattttgcaagatgaggatagccttgctactttctcccagcctatgctccccctctagaggatacagtcagtcctccgtacaggacagaagcttgttcaaaaataaaactattaaagtactgaataaactacacttgtatacagttaagtatacaagtcaatctagtctttcattcgtgtaagtaggcaatcaaggttcaccagacatttgaagtaaactgcacaaaacagaagatccaaaatgaacacataaataaatgatgcaagaggaagaaagtatgattcatggaacagagggacctttttaaacatcttaattaggatcataaagaaaatatgatatacataaaacaagaatactatatgtcaccttgaaaaagagttgatggttataaaagatatgattggagaacttatttttaaaaagtgtagtgagaggttgaagtcatagaaatattccaaaacttagataaaataaaaaatagaagatatatgcttaacgaacatggagaatggatttaagatattcagcacgggactaattccagagaaaacacaggaatggagtaacgaataacgttacgttggaatactccaatgttatgaatgagccttcatgttgaaaaaattaatgcataccaacacaatgaatgaaaaacaattctagacagtctaataaaatctggatatagaaaaaatgccaaatcccctaagagatgtaacaggttaactcaaaagtagcaaaaattatattggcttcaaatgtctctggcagcaaccatatattaaaagacgatgaaaaaattaatgtacctttaactttctggggatatatgaatttgaacttagacttctatgactagccaaatgttattcaagtgttgggacaattttaaggctcaaaataatgttatacttactcctttcatgaaaattacctaaagatgttttattgcaaatgaaaagaggacacaaaaaatagaaacctaggatccaagaaagggtagaataagcccaggtgagcaaggagaagatatcccaggatggagcttgcagcagacctagaaaggaatcagctaaacttagaataagaagcagaggctaggcgcgtggctcatgcctgtaatcccagcactttgggacgccgaggcaggaggattgcctgaagtcaggagttcaagaccagcctggtcaacatggtgaaactccgtctcttctaaaaatacgaaaattagctgggcgtggtggcgggcgcttgtaatcccagctacttgggaggctgaggcaggagaatcgcttgaacctgggaggcagaggttgcggtgagccgagatccggccacagcacttcagcctgggcaacagagggagactctgtctttaaaaaaaaaaaaaaaaaaaaaaagcagaagcagaagagggctccaggaggcctcttcaagaagtatggaagtacatttcaataaaaatactgacatggtgaataagtttatacttctcctaacaagcaaaaaaaaaaattaaatattccagaaaaaaaaactataaatatgaagcattaaatgtgtcgtgattttaaacaattggtagaatgcatcagaaggaagtccatttgactgtaatgctagaacagcctccataaagtggcacatttttagtgaagtgcagtgacttttttttacttgattctacaataattaacatataattattgtatggtaagtattctcattgttccactttttacaaccaattatagacaagatattgaggaattaatgtaaaatggtcattattgccccaattctttgcccctccctatattcttactcttgttttatgacatttaaatcctcctataaggagaaatatatttttctcaccccttaactttgggtttggagatatggcttggtttggccattgacacgaaatgacaataagtttcttatgagcctaggctttgcatgtttcattttcttttcggaacttcttccatcatcacagcaaaggagcaaaagatagctgttgtaccctcagcttggatctctgaatgatcacacagggagctgacttcagcccaaacctcagcaaggaaccaagcccagcagacctttatctcaaagtagagcttagtgtagcccactctagatctcttgacaccactccccagcaacactcagatgtctgagaaataaatacatgagtatcgtatgccatggaggttttgtgattgttatatcaattaactgtagctgtagttcactggaacatgactacagaacagaatatgttgtaaaatgtaaatcaaattctgatgttaaaaataataacaaggccgggtgcggtggctcactcctgtaatcgcagcactttgggaggccgaggtgggtggacctcctgaggtcaggagctcgagaccagcctgaccaatatggtgaaatcccatctctactaaaaatacaaaaattagctgggcatggtggcagatgcctgtagtcccagctactcaggaggctgagacaggagaattgcttgaacctgggaggtcaggagttcgagaccagcctgaggtcaggagttcaagaccagcctgaccaatatggtgaaaccccgtctctattaaaaatacaaaaattagccgggcgtggtggggaggtgcctgtagtcccagctactcaggaggagacaggagaattgcttgaacctgggaggcggaggttgcaatgagccgaggtcgtgccactgcactccagcctgggtgacagcatgagactccatctcaaaaaaataataataataaaagaataataacaataggactttaaagccaagaaagagatatgaagggtgttgtagcagccttaatggctaaaactgatgaacaagtagtaggtttaaatacattatttaacaaaattctatagggagtataaagtaagaggtagttttgaggggttattttcccgtttgtataatgagaaatgttagctattggtaatgaacagaataaaataaaagccatgggctaaataattgtacactcacagaaatatatggctgatagataataataaggttccagttgtgcttatctgtacaaaattacagtaacctctgtattttcataacatatgaatttagtatagtatattagtatctatagtgttctaaagatttcaaaaatatgtatttttatattcaataaaataaattcatcaatatatcttagtcttttttctacctctgcatgtctttacaaaaatatttaaaatattgcagtacctcaaggatggattatagtttgggaagatattaatatcacctctaaagataactctgtagcttatttaatcagaactacataagccctcctttattctctgaaacatggcagaaggagatttaatgagtgtagggaagtaagatgctgcataaactcaaatctttatactaagggccaaattaaacaaccaaattaagcagacgatgttacacttactatttactgacatttagtccagttcacaagtcattggattttattaaaaggaactaaacattttttctgcattaatcttataatagcataacagagcaatgcagtttctaataagacccattcctctctgacagaataggaccatttatctaagcacttgttatggagatagcccattattttaatcaggttcattggataccatggaaattgttgtcttgaaggcttcctttttcaatgtaaaattatgcagtatgtaattaatggaattgaaatttccatcttaatgtatattaaaagaaattaataatgaaaatctcctttaaacatacatttttataagtttttaaagttatatccttcacagaagcaaagagagggctgggagcagtggctcacgcctgtaatcccagcactttaagaggctgaggcgggtggatcacgaggtcaagagtttaagaccagcctggccaacatggtgaaaccccgcctctactaagaatacaaaaattagctgggcatggtggctcatgcttgtaatcccagctactctggaggctgaggcaggagaattgcttgaaccgggacccaggaggcggaggttgcagtgagcctagatcgtgccactgctctcctgcgtgggctacagatctagagtccatctcaaaaaaaagaaaaaaaaaaaaaagaagcagcaaagagaactagaaaattattattatttcatagttcctgtatgaaaattacaatctcttgaatagatcataggagtacagaaaacatacacatcaatgtacttcatgaacttccatcagaaaatttttctggaaaagaacagttagggaaggtatagctaacccccgttatagttttatatgcttcagatttctgatagtcaatgataacaaaaacaaattcaacctgaaaccaaaaatataagagcaatagaaaatcttgcaatgatactaattttttccagttacattaatttttccccattcatctttatttaaagcttcttgcaaagactttcttgagtggtggaaacaacctgcaaagtaggaagtaaactaccttaaaaatcagtatttttctcatctttatgaatacagctcctcctattactatgttttattaaactactcagtctctcccataagacctgcctcttttcatttggactgcatggttctcacattgaaataaaagtatattgtacaaaaacctttcttttgtgaatttgagaaggctaatgttcctcattagttctgtgggccttttattgtcatggagtgtcggggtgtgtgtgtgtgtgtgtgtgtgtgtgtgtgtatgtgcgtgtgtgtgtatgcagttcttagtttacagacaaaaaatatgtggattataaaaatcactttttgaaggttttattggagtataattagcgcagaataaaatacacaaatttaaaatgtacaatatgatatgttttgacacatatatgaacctgtgaatccatcatcttactcaagatactaaacatttgcatcacatcaccctcagaagtttcttccccactgtaatccctccttcctgccccttcaacttcatcccaatcactgatttactttctgtgatgatagattagttgcatttctagaaatttgtataaataaaatagacactgtatattatttttgcctgatttatttcactcagcataactattttgagatcaggttgtctcaggtttggggttattactatagtaataaagctgctatgaacatccatacaagtctttgtgtggacatacactctcatttgtcttggataaatatgtaggagtagaatggctgaatcatatggtagacatgtgtttaagtatttgaaaaactgtcacatggttttccaaatggattgcattattttatatcagaacagcagtgtatgagagttcaattcctccacatcctcaccaacaccatctttttaattttagctgttgtaatcgttgggtagtgacatcttattctgcttttaatttatatactctaatgacaaatgaggttgaacatctttgtatatgtttatttaccactcttatgtatattcttttaggaactgtcagttcaaatatttttcccactttttattgaattatttgatttcttgttgagttatgagagttgtttatatgttgtatatacaagttctttatcatatttttgatttgcaaatatgttctcccaatctgtggtttgtcttttaattctcttaaaattgacattggggagcaggagtttatggatttgatatagaaaaaatagttttaagtttcactttgtaatctacaatctattttgagtgatttcttatgtagttctaagtgtattttacatatattcaattatttcagcatcattttttgaaaagactacatttatctacagaataattttgatgtcttttgtaataacgatgtgcctttttgtagctttcttcgtgtttcttactcttgggatttattgagctgcttagatctgtgagtatagttttcatcatatttggaaaatttgggctataatctattcaaatattttatactttccattttcaaggactccaatcacatctattttagactaactatatgtgttccactgatcactgatgcccagatttttttctgtatattttattttgtatattttcaattggtatgtcttaaaacgtctaaaatttttttttatttttgcatgtctaatttgctattattcctttctggcatatttttcatctcacacattgttagtttcatctctggaagttcaattaggctttcttttttcacatctctatttaatattttcaatatatggaatacagttttaataactgttttaattacttctctgctaattttaatatatactgtcttttcaactatatcttttttgtttcttgagtgttaatcttgattggattccagacatgaattttatcttgctgagtgctcagtactttgtagtcctatatattctcttgagcttagttttcttatatagttaggttatttggaaacagtttgatccttctaggtcttgcttataagattcgttaggtgggaccaataatttatttaatccaggtttaattatcccccactactaagacaaaaccattctgggtcctctgcccaatgccccatgaaacagtttgctttccagtcttagtggtgggaattggcagttctcttggcctagtgtgggctccaagtattgctccctctggtctattcagatgactctttccccaggagtttgctcccctgtgaatgctaatctaccctctgctgagtactttagagagcacggcagtgttcaggactgcagatctctgtggtgaactgtctctgtgtagttctctcctgttgggtatattctgttctacaaacactagcctccgtcgactctccagactcccagctccctctctttcactagagttcaccaggctctgcctggattctccctccctatgccatggcccaagagggagagtcctttgtgtcttaatgttcagtatgttcaacactgttgtctcacgtattttgtctgaggtttttttttttttttttttgtcgtttttgttgttttttaaaacaagagggtctgcctgaaaattctggtcccttttactatgtctaggccagaagcagagttctcatgaatcccaaaattatcacttttaatgaagaaaatatgctgatttggcatacttaccaataaatatgggataaaaatatataaaaagtaatggcttggagacagcatttttagcactgagtagtgagtttgttgcttgaagcagattcttccatggtggccttgagtgtaacagatgttttgttgcctctagctctgccaggaacccacaaaatatcctataattttgtagatgagattctggaatgagggaaatctagccacccagctctttcaccttgatgaggactgaaactcctaagaatttaaaaaaggagtcttttctgtatttaccaaccccaatttaagtctttaagctacagatgtcagtgatctatcagccaaaattgataaagagttggtgtgttagtttaaaaaatagtaaatgtcaccattttggaaagaagtatattaagagtatttgttgaattatcccattcagtgtattaaagtttccacatgctttgcaattttttggataaatgctgcctttcattcctctccaagacagggctactcttctgtagaatatttataaaaattctacccatttatttactctgatgataaacccaaatgtagaagtatgtgtgtacagaaagcctcatcagaaattcacctatattttcctccatggccataaccaagaaacactctatcaaacaatatgaatatggtttaactcatataataataaggacagttatatttgcagtctttaaagtttacaagatatttttctcataatttacctcattgaatccttacagtagctttagaagtataatataatccttacaatagctttagaagtataagataatttagaaatctcatttaggacatcatttttgtttaattatgcccataatataaaatttcaaagatatcagaatatagaagcaggaagtattcttaattttattatctgagtctacatgtatctgtgtataatagttgatttattaggttccttttaagaaattaattcaagggttaggcaaaattatctttctgtataacaaaatttaactgtgtatcagtgcctgttattgaaatgtaacattacttacaagctttcagtggttaggcatttttagtgtgaggtgtttttttttttaagttaaggtcattgaagaaaaaaaatgtaattgaacttggtgaactgaaggttttatttcattcccttaaaagccccacttggtaaaaacgtatcttaaaaagatttattggtgttaagcctttccactctccacttccacataaagtgaaatagtggttacctgcaagtttcatatagtttgtatcttcaaaagtggtattaattggtgataagagtgcaaattggcataaccaccttaaaatcagttgggtattatctattaaagttaaatatatgcattattatgactcctccatttcactcctaagtgtacccagaaaaaaaaattcaacatacttgtttgtcaagagatatgtacatgcatgttccctgatgcttttatttccaacaccactactaatgccattagccatagaaagaaaaaagcatatggtacattttatggtaaaatactctagagcaatttctctactctgcagtgaaaatgaactcactgcagtcacctgcaacattttgaaagatgccacaaacagaagatcacatacagaatttttttttttactataaagtttagatacaggcaaaaataaactctttgggaataaatatttaggagacgaaattataaactatacaaagagcaagtctgtgacttccataccaagcaggggatctgtcacctttatgtgggtgtaggggagggtttgaatgaatgtggcacatgaaggctttggactgctggcaggattctggtgtttgcccttggtggttgttatatgggttgtctctttataataattcttgtaactttactgttttgtgtccttttaagtatatatgctatttttcaaacatttttacataaggtgaattgtgaccgagaaaaaaaatgacaaaattttaattctataggtatgaaatatatcaatgccctctaaaaaggaaattgtgtaacaaatgtaactcctttcatctgagtgtaaagttaaaagatatgtataaaagactgtaggaggcaaggaaattcatttttacataagcaagtggttgtggatttcaggaataaaaagggaacaaatgcccattaaacccaagccacttaggattttgaggaaattactaagacgaataaagggattggggaaaagtgtattccaaactaacattttaggactggagtctttaacctagaggagaaatgccaatattaggttattatcaacgttttgagaacaaggactatgtgttatcctatatctgtccttcttagcacataaaataataccttgaaggctggtaagaagaggtgatgaagtgggagtactaatattccctagtgatggtgaaacatatgggtgattagcatagattctggagacaaattaaattatctgggctttaatctcagtttggccacctgtgtgactctgggcaacttatttacactttcagtttattgatttcctcatctgtaaaacaggcataataataataacatttagcttgtagactgtgttaatacatataaaaggcttagaacagtgtttggtacataataagtaatctacaagtggaaggatgtgctaattgttatccattaactgccatcctgtagtgctgtttggctatacttgtattattaaaccttatgtagaggtaaactgtaaaattataaacagaatgcaagcaacaaattttaatttcagcaaaagcctaaggaagattcttggtccataatgattttccactgtaggtagtttttgttagggtttgctgaatatacaaaatgtaaagcatgaccatatgctgaaaattaaaatgctcataggaaagggaagaaaaaatagggagaaatcacatccaattgacaattcaggtagggtttctagataaaatgtgcccaggtaaatttgaatttcagataaacaaagattttcttataaatatgtctcaaatatttgcatggacactctctgtttttatttaccaaatctagcaaccgtaaatattaggaagtctatatacatttcgaaccaagctaagtatttaaacataccaaacgtgattatagccatcctactacctagtctgagtgatatggactcaacataaatttcccttctcactttttgaattatttttccaaaatgataccagtaatgaaattttagagaatgtgaatgagcttctaaaatgcagatctattcaatcccatgtccccttccacccttcttgagttctctattaactctccagtatccaaggactaaagttcaaactccttaagttgattgatacggccataaaaatctggtcccagactacatggtcgccattatgcagagtatcccctcgcacagtccctgtgcatgcttcagaaattcaaagtgctcagctctctctgaaaatatgttctttgtgtttcttcctaatttaatacagctataaaaactcctgctcatcctttaagcaccaaatgtattacctcctgcaagcaatcttccatatctcctttaggcaaaactactgctttttctataatcttagtacattttgtacataatgctctaaagcacatatttcaccatattgtattataattgtctgtctcctgtgtagaagaatagaaaatgaatgatctcttagaacaggagctgcttctatttacagatatatccaattatgtattttaatgcctgattcatggaaagtgcttctcagaattctaatgaatgaatgagtgaacaaatggttaaagtcaagctatgtgaatcatagctgagcttctaatacaaatcctatctcacctaagccagtttggggtttctgataactcactataggaaaaactccaaaatggttgattattaagattgactgctaaaaccagagagagaactaatttgacatgcagctgaaagaatagagtagttaattttagataaaacattaaaatatgcaattgtataaataataataaaaataggaaaccaggaaatatataccttacacacttggagaaaagaactatgggacaatgaggagtcactcttagatctgcagacaactgataccaggaaaaatgaaatacacattaatttagaaaaataactttacagagtcaactatttataactccatgtaattcaaaagcacttttccctagtcagctagactccttctctaaaactcaacatcccctagtctgccagaccaatttagttttgatatttggagttcctttgagagtctgtgcattttcctgttatagcccttgttaccttacactgtaactgattgtttccttgtctatctactctactgtaagagcttcagaaacattacagattgtgacatattaattgttgcattcttagtacctagtgtagaactaaggatggatggatgcatggaaagaagggaggaagggaggaaggaaggaaggaaggaaggaaaggaggaagggtgggagggaggaagggaggcaaggaaagaaggaagggtggatggatggatgtgcttcataagcagaggttctgttcagtgtttgcaaacattggctatgcttcagagtcactggaatgccttttaaaaagtatattactccctttgtctctcccaagaccatttaagtcacaatctctaagtgcatgacttgtgcattgatatgctttaagagctccaacttttaaatgaagcattgctctaatttcatttttccttaatagaatcccattagaaataggctggagcacctgccccaagcaagggactcactggtacagtacatacatgatgatcccaaggttactaatattcccggttctttcttaccaattaacaaatatttattgcagggccagtgactatgctacatgccactgaggtaacatcccttgttgtggtttgctcttttgtgaaaatgtttactgaaagaggcatctgttcttactggcctctgcatatatatatatatttaaagtcatcaaatatttgagttatagagacataacaccctcttgataacccctcctctacctcccctcattttggcttttatatcccttggaatagctgtcttgtcatactggccaaatatctgtgtaaatgcaaataaaactttattggaataattaatataaacaacccagataattgggatgaatattgcctgcgtactagtatcaaaggcatttgcatctaaataaagatcttaaaataaatactaggatgtcaggatagagatggacagagaatatgatctttattagatggagacaatggataaatatctcttggatttggggcttttgttatgctactgttcttgtaagtgaaggttatcaataaattattataaaaggtttgtgtgtgatacgttctgactgaataatgctgattttaattagccactttaaaatgaattactagtaatatagcagaaagccacatcaaaagggagttcaagaacagaagattcaaatatatactaaactggtcacagaagtgactgggaaataaattatctagataattctgattgtgacataattaagttcagcatctgagtgggagaatcaaattcctagaaattcatcttaaatagaaattcaatctttaaagagaaattgaaagatcataggctttaaataaggaaaaatataaaaggtcaaactttaaaaggcaatcactcatgggaggtctggagaatatgtaatagctaatggggagcccagggaagatgtgttgttaaggatcaaaaaatagcaggctctgaaaaataaggtcttgccaagcaattagcagtcaataacaatattgccggaggaaagatagcccaagggaaagacataaagaagttgagaaatttgtcttcgcaaaagaaaaaaaagcttgggggggggggcaccgtctatcattgtctccttttaatatatccaaaaaagtatgttcagcccaagaaccatgttccttcttgatgttcttgggggcctcaatgtacttacttatgaagaggagatagatttatggttgaaatacattgtctttgtcttctctaggaggaggttagatagatatctatccccagaaggattagatgtcctggtccaaatggtggtcagtattcaaaatatctaagccatgttggtgaattaaatgtagctaaactactgaggacagatggcattttcctgaggagttctgagagaactcaaggatgaactgggataatgatgtcccagaagtgaaaactgctaccattcctactctgcagattgcaaaggtgagccagttgaaaacaaactaattaattacttactaattagttttaaaagtctccagagatggagattcctgggaattagactcaagaattctctgtttcatctctggccaactagcggaatctgtaatgaagaatgagattattgaatttttcaatataattctctgagaagaagccacacagtttctgtgacaagaagtcatgcccagacaatgcattgttttgaaggcaccaataaggaattaacaaatataatttccattttaaaaactctttgacagcctaccactccaaagtcaatttcatgggcttttggctataatctgtacaataatggttctgacaaagatccaggacaaagaagaccaggtgtaactgagcatttctcaggatgtggatgtgcataaggtgaattgcctaagggaggagtgctcaatatgatagatagatagatagatagatagatagatagatagatagatagatctatgtatatatatatatatatatatgtgtatatatatatatatatgagtagtttgtcaattactggagtaggcttctcacagcgaaatctccagagtgtgcatttctgctaggaaaaaacccaagccaaagagaaggacgatcaaacacatttacaaatctgtaatgtgggttatgtatgacataccgataaagagtctgagttatgcatataaaatcaatgaatctgtgtaattagttataacagaggcaaggaactgggaatacttgtaaagtactttttggttcaaagtaatttgtgtttcctttcagagaaattcaactatttaccttttattattttctgtcctctgtcttccttcttctccttctttcttcttctttcttcttccaccaaaaaatcaaaacaaaatgtaatacatatatatcgcatatatgtaatatattatatataatatatataattatgaaatatatatttcataatttcatatatatgaaattatatatattatatataatttcaggaaacaagggtgagtcatgagtttatacctggaaactcatgtgcagctctcatcactgtgcctcagtgacacaagaaggttggcagcaaagttttataacttcaggactcagctgactgtcttgattataaagtcatattttgaagctgttttatgaagcaagaccttataaatgatattattattataaataaactataaatctgaccaaatatggaaatttctatttcatatgggggctactttatcagttttttcttcattaattaaatggtataacctagtagtatatttggaatggatgtggacttttttctggcaatgataatgtcttgatctgtgacgaagataggtgtatgttatttattgcaaatatgtttaagtttcatttcattgcactatattctgtgaacgtttttatctagtctttaattaaacatgatttatacaaattgaggtcagtttccatttagattgcttgcagtgttaattacagtgcaaatagccttcactgctgaaagaactcctgcattatacaaatacgtaaatgcttctgtgtaatttgcaactgtcttctaagcttgtgtattactgggtatgtacctatgcagaaatgttttactaacttagctactgtattaaaaaatatggataacttaagataacatgtatatttttatgaatttagatttaagtagtttttgagttttaaaaacattgaaaaatgcacatttaaacaatgaaaaggtcattctatcacaaattgagtgtgtctacaaagcatttccatttcagcaaatgcattccaattcattccacttcatcttaacctctgggtaaaggtgttaactgttgattttttagaatcggatgtccttaattataacttgctttgctgatgatttatagatggggcctgatgagcctataactggaaggtttaaaggttgatttgtctcaattagatttacgctcacatattttaattactacttacggtgtaaagacttggaagatttaaggaggcaaaaaacagcagtgtctttgtatcgttaatagtatgtataataattattgattgttctcacactggctatgagaacttccttctattaacattacaaatcagcaagagctgggtttgattttactcatgatatatttcaatcttaaaatgagaaaatatatagagcctcttacatgagacttaaaatatatgttgtacctattaacatcaaatcttttgtgggtttctgtcccatcttcctttattcatttctcaagtccatctcacatatggcttcactaggttcttctaaagtagaagggtgaaggaaataccctttaatccttctcatcctgctccaaatgttcattgccaaaaaaataaaacgcagttgcctcagcctgcactaagggttcatcataatctgttccctatctacattctctgacatgggattctagcactctccttcatcttctctgctccaaaatgctttactcctgtacctaaacacacgatcatatcatgaacattcttcttcaaagttgtgattcattctggctccctgcttggaaattgactgtcatctatatcacatccttattagtcttaattaaactttttcttcttgtctaagatcaaattatcttttgcttatgtgggtccttcagacatgaccacttagtttcctctctctaagtatatatgagaataaatttttgcatctaactttacaaaatacggcagtgttttctctaagatatgaagacattaaccagttacacgttctcatctaaaacaaattgtagtagagaggatacaggttaagacatattgggcatgttccaaggtagccaaacattgttattgtcatgcataattgagttggcaacaataagtagcatttcatgtggcttacaaaatttaatgaaaatggtttgtgtgttagtccaatataaatatagtttaatattaagactaagtgaaattttgataagatcaaagagagctgagattttattatatttttaaaaaggaaagaaatgacttatactcaccttttctttcccctccctccctccttccctccctcactgcctccctccctccctcccatccatccttcatttttgtacaggttcagtatcaaatatttaggagtctatcatactttttttcccccgagacagagtctagctctgttgcccaggctggagtgaagtagctcagtcttggctcactgcaacctcagccttcagggttcaagcaattctcttgcctcagtctcctgagtagctgggattataggcacacgccaccacaccagctaatttttgtatttttagtagagacaaggtttcaccatgttggccaggctggtcttgaactactggccttgtgatccacccgccttggcctgccaaagtgctgggatgacaggtgtgagccaccacgcccggctgagtctatcatactttacagcacacagatccatctttttagagattagcagattctgattttatcctattatttgaagttatgaggtactcaaattatttttattttttctgaacacagtcatgaattatctctgttcttaagctatgattgtcaaccagaaaccaaaagggctgctttttgagagaaagttattacctaaggaaatttagaccaggctttctacagtgaacttagaatgagaagttgaccaactctgctttctggaggggatactaattagaaaaaaaaaatgtcaaaagaaagggcaaaattgagattttcaaatacttttttccttgtttccttttagaagtaatttaatgatcttcttgctttaagcaactgtaatagcccaagacttcagaactatcatttgatatgttatagggtatcagaaggcacattacaaatctggaataaaatgttttaagattgtgcacatgactatttctattgttttggtagaaagttggtcaggaaacatttattgagcctcagtagttttccagatggagtgtggcattttcaggaatacaaggaacagggcaagataggaacttcatttgtggagctcactttctgacaaggtgaaaggggctaaatataaacagacaatttccaagtctgtaatacagttaaaaacaacaacaacaaactgttatggaaatgaaagcagatagggagctcaactggaatagctcataggatgaggaagagatggggagtggtgtgtgctctccaactactgtactggctcccacagaatccagcatggtgctttgctaaaagggaatgatttgtgaatatctgtgattgattgaattagtcattgtttcttttgtgttcaaagtcatatttgttttctctgttgtccaaaattagcaaggaaagtagtataatttgctcgatgttttatgtttcatgtgattttgcatcagatgtaatagtagtatatcaaaggtaagtccctttagtcatcctcactttagaaatccttgaatgagattaggaagtgatcaccatttacatttattatactttgcatgtaacgagctttagctattaactctaatttgcttctcatcgtattcatcaaagacgaactatttagaaactaaaacatctctgtcagttagaattgtaatgaattaagatgaaatgagacagtgttaattggcagttgttgctgcaggggaggtttctcgatcttgtaagtgaaaccaattcatctttctatcagggttaatttgtttgatttaattctaaggatacactgaatatttccccagactactcatatttattttcagaatgggagagtggtttagttccattggcctttcgtctgtattctgaattttatttgaaattgattaaatataatggttattaaattgttggttttaagcagcatttgtattactgactaaacacacacatgcctacacacacacaaaggaatagcattactaagacatttgtatttcaaatgttaaaactttccaatatctaatcattttttaccaataattctcttcctctgtcctttctgtttttcttagacataaatgaatgcgaagttgagccttgcaaaaatggtggaatatgtacagatcttgttgctaactattcctgtgagtgcccaggcgaatttatgggaagaaattgtcaatacagtaagtattcacgtgtgtgtatgtgtgtgtgtgtgtgtgtgtgtgtgtgtgtgtgtatatgtatacacacacacatatatgtatgcatatatatttttatgtacatcatctaaatttattttgaaatctgggccaaaatcaatattatttgccttcagagtgcataatccattgaaatggcacttttcatatttgtggtatgttattaatgcacacatattctctagggtgtctcatttagtgcacaatatgcatagaaatggtatcttgtgacctgaaaagaatgataacatttcctcagatactcaagttccacgaatcccattttggtttatgattatgcatatgactgaaatttctaccaccaaagtgacactttggttctgagagtaaattcagggcattgaaaccagatagacagggcacactggctcatgcctgtaatcccagcacttttagaggcctcagcaagaggagcccaggagctcaagaccatcctgggcaacacagtgagaacccatctctaaaagaaacgaaataaaaataaaataaatcagttagcctctgttataaataaaacgtaaaaataaaggaggatgcatttgggccgtcccacacgctagcaagaatgttgcacactatttatttgtcttattggaagctgaagaaagtagggtcttgaaatgatgcatcaaatgacagggcagttatttgccttaagtgtttacaaagaggcagaaagcaccacttacctaaaaaagaaaaaaaaagctgggaaaaaagtagtaacaggactaaagtcaatgggatggggcctaaaatgggcccaaacacaggttagtaatactagtgctatagccttataattgttggacaattagaggaaagttcatactgctactgcttcgatgtatatcgtatgatctgagcaccacaacaacattatgcaaattccaaatgtagatgcagatgagacttcagatgcacaaactgagacacacctgatgttgtttgcccaagctttcacagctatttagtgagagaagcagtgctacaggtttctgattccccactcagtgtattttcctcaagactgagatacctgtttaaatagagaggtataatataaacatgaatatacatgacacgtccattctttatcacagacacagacacataccacatagttctttctcttcagccatagtaagaaatgtatttctcattttctttttctttctttctctttggccatggtatttataaaataaaataggaaatattgttgaatgatatataagtatatataaataaaataatgatataaaatgggatgctcattactgtagtcctgacaaaccacacaaaataattaaactctgaatatcatagagaaatcttgaattgggaaaaaaaaaactttctaagcttaaagtaattgaggaaggacattgagcatgagttgatgaagaaaggtgcagggcacagaaggatggaaagggaaggctgagtaagtaggttgaccatacagccaactagaccaatagtcatccaaccaactaacctagaaaccttcccgtgaagcatttaactaatcacccactaagttaactcaagctcaggttcagcttctctttggcctgtcccaggcacagcacttgcatccatttctgtttcatggaatttgaagatggctgctcagtcaacactggaagttgtgctaaaaagcacctccaagatgtctgtcagtgaacatcttattaatattatgatgaacaaaaaaactgatgtcagtgactatttcaccttcattcagcaaaaatagagaatttgtacctgaatagagaaccttccaggaaggaacttcggcatagattaaaacaatacctggattagagcatgtctaggcagggtaagaccacctctgacccataggaggcctgactaggggaacaattgcgggggagaagccttcccattttcctaaaaggaggattgaatgggggacatatcataagaaccctgcctaggaatgagtgtcactctgcagtgatgaatgagtctaagaagtggcacatgagggtgtggatatcctagaagaggagacctagaatgtggagctctagggcatggaggaatagggaaacaggtcgagtggataggctggggatgaagggtttatgagacagacagtaaggctatgaaagagggagagaggcccctgccctgtcattagtttgtgcctagtgtcttccaaccagtttttcatgttgtgtttaatgaaaacctttgcttttctgtgaattaactttatattgatacaacatttatatttaaattcagacatctctttgaagatgcatgtgatagtggcatgcctcccttcaactgtcatatgatctggcattctagcatttcctgtattctccgtgtgctgacaaagagatcagaaagagtcacctagagagttccctaaaatattttcctattggggtgtttgcttttattttattaaattttaaggacatataacaaattaaggatctttattctgtctattgtctaggtttcttaggatatggttctacttttttctgtagtctcttaagagattttagaaaatctagagtaaaaaggggtaatgatttagttttgcacatggagaacttagagaatttgcttactgtggggtacatataagcacctacaggttacaggtggtaccagctctaagctgcttgaaggtaagatcttggaagttgttgacaatacatagatgataactcctgtgctggtttctaccctggaatatgattgacaacctttcttctggactttgtatcatgcatgtcccagagggcagcctttccctcattttttaccagactttcaattttaaactgtatattaaggctgcctttgccaatacaattaaatgaaatattttcaaaactagtgatataccacattttaaaaactcaaatatatttaagttaaacaattaaaagcaagatgtttttgttgagatattaccttgataaatattacaaaaataactgtgaattatttactgtaatgtgtgtctttaattaatttagctattaagcacctttactttgtaaggaataaatttatatctaactctattatgacctgttgcaaaattacatggtaaaaattattatgcaaatcaattacctattgaacattttcaataacaatgaaattatttcatgttaataataaaccttttaatactaggcaaaaaaagtttcctgtagttttttaagtaattattttctaattatacttataggggagttaaggcaataatacatatttctgatttaaataatttcagtttagacttctagatgtgattcatacaatttatttactttggaagatctcaattcttttttagtttatttatttatttatttattacaaggtttggttaagttttattatttttatattttacataaaattacgtttaatatgtgaaaatcatttagatgttcctgtagtatttatcacaccattacatcaattcttctaattaaagtcctaatttaattcccttgttcattttatttatttatttctttattttgagatggagtctcactctgtcgcccaggctggagtgtagtggcacaatctcggctcactgcctcctgggttcaagtgattctcctgcctcagcctccctagcagctggcactacaggcacgcaccaccactcctggctatttttttttttttttttttttttgtatttttagtagagatggggtttcagcactttggtctggtctcaaactcctgaccttgaatgatcttctcacctcggcctcccaaagtaatgggattacaggcatgagctactgcgcgcagaccctcattccttttaaatgttataagctcaagtgttctgacagttatttccataaacagcttgaaaatgatgatgaattggaatgagaaaactattctcataagaacagataagctttgtcatgtaaatttaactgaacatgatgtttaaactagattaagtgcaatgaaaattaataacactttagttaactaatctaaaaataactaggattgttctcatttattggactatgtggcccacaatacctgtatacatttccctcctggttgtttaaatatgacattattaaatttcaggaatgccactcaaattcatttttatcactggcactactttgggaaagtaagacagatttcaagggagctcttataatgcaacatccacaaacaattatgacaaacaaacaaacaaaaaaacacttgggtgatctcagagggttttactaaaaattaaaactaaaatcttctagtaaggactaagtgatgtttccaaatatcataattatccagtttttgcaaatttaataaaataatctagataattatatagttgtttaagaattctgtgataaggatattaaaataatacctatgaatatattttgaaagtggtaaattaatattttcttatctcattatttgagcagctttaactgttttagccataattataaattagctagtatttccaagcacataaacatagacaatatatactgtgtgtatatttatataatatatattaaaaatatataaaatatatattatatattaaaaatatataaaatatatattatatataaaatatataatatatattaaaatatatattatatataaaatatataatatatattaaaatatatattatatataaaatacataatatatgttaaaatatatattatatataaaatatataatatatgttaaaatatatattatatataaaatatattatatataatatatataatatatattatgtataaaatatatataatatatattatataaaatatatataatatatattatatataaaatatatactatatatgaaaaaaagatatattatatatatattttttctttttttttaaagacggagtctctctccgtctcccaggtggctagagtgctgtagtgcgatgtcggctggctgcaacctccacctcccaggttcaagcaattctcctgcctcagcctcccaagtagctgggattacaggtgcctgccaccacgccaggctattttttttgtatttttagtagagacggggtttcaccatattagccaggctgatctcaaactcctgacctcaggagatccgcccacctcaatctcccaaagtgctgggattaaaggtgtgagccacggtgcccagcccctatattctttcttttgatatcaatgtgtactaccaagtatatttgtttaagtacatacttgttcactgaaaattgctgaaacattgtagagataaatacatgatgagatttgtattgttatgctcaatatttaattattgctttttaaaagacaaatttataaataatgacaggcaaatcttttttgtttactaaactgtatcttttcaccagttcatgtatgttgattttaagcattactatgtgtcaagcactttcctaagtactttaaatattgattttttaatcctctcagcattctttgtactagatactctttactactgattccattttatagagcagactgagctattgagtgattaatttgcataggttggcctggctagtaaacttcagaacctggccttaatcccaggcattgcagttgcagagcctgcagccctaagcatgatatgatcctgttttttgtagggtaaagggatgctgttattatactctacatattaaaaacacttacacttgatgagtggccttggcaagtgacaacagcataagaggaaagagtgcaggctttacattcaaatagaactggaagtttaaacattttctatttgtaactatatgtcctgacaagtacattgccccttctgagcctcagattctttatctgcagatggaattgatactatcttttgatggatgtagattgataggcagattaaaattcatagcatatgtaaaatacctaaaatacctagtaaaacacctaggtcaataactgttataaagaaataattgcataaatatatatacataggattttttagttatttgaaaaaaaaatacctgtatatctcaccttttcttttgtcataatgtgtgattttaagttttattatttatgcaaacaacttgtccttctttagtaaattagtgtatgtccttgagaacaagcagtgtagatgttaggtataatgcctacataccatgttttacagatacataagtttaaaaattcctgtggcattaatataagtttaaataaatattatttacccaaaatcattataggagatagttgctgtgttttttgtaaaaggctatcaaaacatatgaactacaaatacccaatttgatttatctttttgtatgtttgcagttattgtaagatgtcactgttatttgatcaggtatcttagcgaatgacaagcaaatgaatgtttgcagtgattttagtgaattacaagagcagaattaataattccagtattttcttaaaaagtggtcagagattatagttttatataatataatactaaattcctactcttccctatccagctgtgacaagacaaaaggaaaacatagagaaattctgaagtaaataatttttttaaaaaaggtgtctataaggaagtgaaaattagaatgaaaacacacataagttttacaagaaaactgcctaagtctgatgttgcaatatagtgaatgtattcaattatatgatcaaataaactagccacaaatatttactgagcttttcttagcgtaactgtgtacaagattacaagaacatacatgaataaactcattcattcaacaaattgtttcaccctctaaagccgggacaacaatggtaattgaaatgaattcagttcctactctcatagaatatacagattaatgagagagaaaaaagaattatgtattatttaatgataagatatggtaagtgccatgagggcaaaaaagagggagcctatgacagggaagccttttgtttgggggagttaggaaagtggcatgaaagccgagaccataagaatgtatagtatatactcaaacagaaagaggaggggtggtagagatgagaattttacaaagaaaatgatgaataaatagatcctttgagaatcctcaagaataaacagatcctttgtttatcctcaagaataaacagatcctttgtctttaagaatcttaatatttagtggatgagttaagattgttatttaaccaacatgtgatagcacctttagtatatcttatcttttaggccttaacaatatagagtcatgaaatttcatttggggttgtgatctgtccatgccaaaccatgtttatatactaaaaattcatcttataaatatgtttttgtgcaatcacaagggatttttaaaacatcagaatagattttaacttgtaaatgtaacaagaaatcaaagagaaacaaagaaaaataaatatttaattttaatcctattttattccatataacaaatatctgctctgttttagaaatttgaacagggtactttggtaatgatttttgtctctgaaagcattggctaatttaacttaagattgttctactttgcttgaaatacataaaataaaaattaatccaaaactccagtgggacagaaggacagtttgcctcaggctgataccttttgtgaacattaaaaataaataaataaaggaattgactatgggtaaatctgaggtgcataacatttaaaatctacctataaatatatagagatacatttacaaataactgtaaccatatatacttgaatatataattattttaacttaatttctcacttcttttaaaacatatttttgtgagttaaaaaaatccagaactctatgcaagtatatcaataaagaaagaaacaatttcaacgttactgcaggatgaagtttttgaaacaataaacacaaaaaattgactcaataacaaaagcaaattggattatttgtgcctgacatggaagttctatcttccttcagatgcctctgattttccaaatgttacacaacagttttgtacagaattatcacactttgaaggttcacctactgtaccttaaagttataatgtagtaaaggaaagacaaacaagtatctgcaaaatgttcaaatagaccatgtgggacttgttaaatacttccaacaaatggagtcgtattctcattacctgacagttttgtatttaattgcaaataattactgaaacattccgtaagaagtttttgttttcaaattatttcaacattccccttatgtgctaaactgtatatgtccagggattataatttagttttgcatttattctccaggctaaaacttgctcttatattttccagttcaaagacaaagaaagatgaagtactcagacatcaagagagtttgagaacggcataacttgatttagttctcataaaatttagaactgtagtggatgattgaaaaatattgcatttttctcaaactgaaaatatcactctttcagctatcactccaaccctcacccttacaaaaggagcagggggacaacccaaataaaatatatacaaaacaaaaaacacaaaaaaacctctctgttaggaaactactagaaaagaagtcatcctgggactagaaagttggaacactgttaaattgtaatttgtgggccagacagtatcttctacatgttaatgtggcgttcttgggtacttaggtgaaattttgggccgactgtcagagtgaggttcaattggttatttcacaatggggaaattatagcacaaaccaccgggatttccgcttttatcacactgctgataaaagcagagacaaacgcctttctcagaagagaagaaagaatatagatggttcctgatctttcaccaaatgtgcacaatttttcaaacgatggcatgatttcctgagctctcaagggttccaaatggttgcaataaaacttgactggcaactatggagctgagtttggcagtgacagcaacagctagtgtgaccctagccgcagttttcaactgaatcagcacacttggaagtaatggtttccagcagcatgtaagtcataaagccaaatacatgttttgagttcccaccttcaaagcaatcttcttcaactgaagaatgagggcacagcaacctttttcactgcttaggcatattgaattttaggtgcaattgggacatcctgataagatagtacagctagttattaaaaatgcatattgtagttaaggaaagcattggtaacaaagattcagatttacaggtcacatgagaatgatgaagtgataagattagatagcattgccaagggagaaagtaagagagtaaaaagtataaatggctaaggataaaatttaaatcaggcaaaagaagttctatttgcaaaggtacgaaaaaaataaaataaaaggataatccaagaaacagaagaggaatacagaattagagcaaggaaaagagtgtttccagaataggaactggtcaagaaaatgcaggcctaagaaaagatacttttaatgtggaagctaaaaccattaatggcccttatataattgtgtgtctgtagagaagaatgccagattgcaagtgttccagaatgagcagatgctgagtagaaaataatagccacaggctgctcctcccaggttatggtgcactctactttgagcatatcttaaaccccaaagaaccattaaggtgactaaagtcctaaaaagaaatttcataatagttaccttaatagctttatctggtcaataatacacgttctttttagagctccaaagggaatggaaacataaagtatccaacttaaaaataaattgaacttgaggaatatggttctataaaaagaaggagagccagagcaaagtcagtaaatccaatactaaaattcaaggaaaacaggagcagggacagaaaataaactattctgacaagaaaaatggatagaactatagttatataaggaagcctataaatactcagcactattatctaactacgaaatcccgaaaaattgaaaccgcagctcttagctctgaaaaatccagagatatttgtggtggtttgttcaaaagaaaatttgctttatattttctctggtacacttgggcagacacaaaaatttttaaacatccccgaaatgacaatttggtatataagtgttgcctcatacttacttggcagtaacttaataatgctatttccttttccaatagaattatttctggattctgccactgttaatagttttccgtttaccagaacattagcactttcctacaaggattaatataagggcattctcagtcccactctgtgagtgcttaatgcaaggtttttaaccctaggtaaggatcgcaaaggataggtggacagaagtgtcctttgatgagaaaataaaaatcatctgtttatttgtattattggatgactgaaatttaaaattttcatcaactacaaatataggcaacaaccaatcatagtgttagcagtacctatgattttgtcactaatagaaatcacagatattttcatttcacataatacatgtcacaaatgtaaaataacattgacatttttcactaatatgaaactatagtagatctgctactacttaatgtattaatagatcagcatatacattgataagtcacatatttttaaatattttgatgattgccttcaatttctttgtatttcattttatatgtttgaaggcattattctgagaagggtctttaggcttcaccagactgacaaaaaggtccatactataaaaaaggtttagaaacctgagttaatggtttatctgtttcaaaagatattttctcccaaaataatgtagatgaagcttttggagataaaagctgtcaatgagccattttcattgaatgtccagtcctggcctttctgctgaattttgttctctagctccatgtataaaaacatgtaagtaaaatagcagacgatgaaattgtaagcaatatttttgtcattgtatttacagaggtcttactagcagggttgagcttttattgaattcattcctgcttctcctcaactgtgcagatttagtcactttgtaacctgtagagagatgatgtattctaaattacctaccctatggacttgaacccacatttaaaagactaaggaaaagaggtaaactaaagagcaaccatcacctgttcacccccacatccccttccccatcacctgctgctcaggggctgctatctgaagttgagcatattcaaccgaaccttttcagtctccttaaaagtgattattatccatgtaaaatttcataatcaatttagttatttggttttccaatgccttatacaccatcactttagaataatgcagctggtataagagttcaccaaaacataccagtttttcagaatcataggattatgtataaagtaatggggatcactccgtacttggggcagggggagggagaatgtccgcctgttaacttagtgaaatttctagttaatgtgcacatcagtttcaaatcatcaaggtactgccactaaacacacatgtaattctcttttttgatttagttcctttcttgtatcagagttcactcacacctagagttatttaaggaagtgtatgcttcccggacatatatgacgctatcattgacatgaccttctttctttaaggaagttaagcttttgcagacttccaggtgtcaaactggaattttaaaacaatagaaatgacttatcgtctaaaaacttagacattttgcaaaatggctgtggcaataacatcatgcaagtgatgagacaaacatcaaaataattgacacatgatccctgatattaagtcactggaaatattgctctgacatacatttgtctggtatttttgattccaagaaaacagacccattcagtttacctctgtaaaatgaggactattttcaagtttgtatgttaaccacattacgatgaaggtttacatactactcgggtttctggcccctctgtctcattctcattattcctatttgtagaccctatagtcttttagaacttttgcttctctctgtttttactctgcatccttgtcttcatgaatgatcaatttaaatttaataatattcctcatattaattaataataagtagttcaagggattgtgcatgaaaaggttaacaccaagaaagcagtcagtttataagtgtacctgagaaggaaaacaattcatttagtattattcaactgttcttcatagtataggaaaatgtcatctatttatacacatttaaccttttgagtagtcaggaggattttgtcataggagctttggtgagttcattcattatgcaaaacactacaaaagttcccacaaagctattaaccgtgtccttctggtatttggtctaatcataaaaagtaaaactatttttttttgttccttgggtagcagtattattaacctaacaatatacaaagtaacacataaaattctgtccaatgaagttgataagccaatatgataagaataaagtaatttttctaatgcacaattatctatcaattaatttctagtgggcatctctgtgccacttagcaggtgacaatagcatctccgatagagttttcacttggaaaactgttgacatttcacctgttttgaacaaaaggtccattaaaattttcttaaacatgttttctgattacaaaagtattccatatctgaacaggaatacttgggaaccacaaaattaattattcaattttatttcattctaaaatggagttcatttaaatcgacacatgtaacataccatcagaggctatgcatataatatttacatattgttacttggttctttctacaacgtgtcttcccttgtgtctggttggccaaatcccttttccgatctaaaatttgtcggtaaaatagacattgtttcttcagtgtacttaattttctctttggtaatacctaaaatacctgcataagtattttatgcatacctggataagttgggcatttgataagttcaggcagtcgagtggctaagatgtctctgagtttagtaagaattctctagggagaaagttaccttcatctattttgattggtgtaaaattgggaagcagataaacacttgtttaaacataatgaacaggcaactggatacatttaatccaagtttaaactgaattttataaaagaaaaaatagtagaaaactgcatagtattggtcttatactttttaacaacatgtaagtaaaaaggaactactgtttttcactctagtcacacctccactgcttccaagaatatgacagtacatacagtttttgaaattttaggagctggatagacaagtaaattgtctacaaggctgcttttattactcattgaaatgatgtttttttagtattctaccttaacaataaagtactagagagaagtaaaaacctataaaaatcatgtttcagttaataattcatgttattaattagtcatgcttttgagaaatgggagttaaaactaacttttcaaatgattgcaaggtgtgtgaagtaaacataatcaattgatttattttactcaatttactttctaatctgttgacacagataatgagccttggctctacattaacgtgaatatgatagaaaagagaaatatacaggcaaaatccaagtttatgcatatatgaatgtttaattggtatttgcttattcatttaaggattgttgtgtacatacatgaaacacaagactattagaaacaaatttaaccacagcaacaaaaatgatctgtggttgggacacaaaattcttgataaaataatgattaaaattttgaaatttatacataaacttttaccttttaatgctaaatcagactaatgtcataattgcccagatgctggtttcatgtttgaagatgttagcattgaaaataattgcctccacaatttatcctgaggcattttcttaaacagagaaaaatgcactatgctgtaataggctttcttaaaagaggaaatgtgaaaatagttattaaattgtagagagaaaatacacagtgagagagaggaaaaataaggctgtagaagttcttgaggtaggcagttcaccatgttcctagtctacagatgtctcattataaaattattctgaatttagtttctaataacctgcttcagctgtaaaatcactttcaatcttagaaaactaaagtattaaatgttatacctctgctttgcacaaagaagaggctcaataaatattagttaaatgttgaatgaataacagtccatgttgaatctttagtccaaccacggcagaacaacggtgacggagaacacaaagtgagttagatcactgtcctacatcttcataaacaagacatctaagtgccctcctcatcattttttatagtttctccacactccttaaggcatatgcagcaaacagaacacccccagcgtgtcattacaatgtttatcatgacccattggtaatagatgtacctgggttcaaatcctggctgtaagactttaggggagttacttaacctctctgagtctcaattgcctcaattacaattggaaataaagatactctccatgagggatagcattaggagatatacctaatgtaaacgacgagttaatgggtgcagcacaccaacatagcacatgtatacatatgtaacaaacctgcacgttgtgcacatgtaccctagaacttaaagtataataataataataaaaagatactctccatggggttgttttaaggccaaaatgcctgacatatttttctctgcagtatgtatgtgcaggctccatttgtattttttaggaagatctgtgagagaaaagataaatccatacctttggaaggggagcaggaaagagttatggacagtccacctaaacaagggaatcaacacatttagatattacttatcttagttgcagaagagaaagatattggatgaggagatatacaagagtgaagtgcacttgaggtgagaatgggtaaaatgctgcaagagtttgcattgcaaggtagagaaccatcctagagggagatactgtctgttatgtttgcctcaattaaattgatcaatgatgtttttgagcagctgttacttccaggctctttataagatgcgaggaataggcccatttatcggtcaggacccagatataactgttgtttggaagaatttacaatctaatgtggaagacaaattcttaaatacataaatgcccattaaaagtatatttaaatgctcagtgctatgatacacatatgcttagagtctttttgtaccccagaattggcacaaataactctgtttgggggaacgctgggacagcgaagaaaaggacagaggcatgagctgcaaaaatacttcctacactgtcatctaagtaaaattcagtctaaggtttgcagtttgatattgctagaaggtaaatttcaagcagccaagaggatgaccttttttttttctgaccaatggggacctattgaaaaaaaaatgtagatagatagatagatagatagatagatagatagatagatcgatctaagttagtgaactggtcagataatggggaagtttattctgaatgcagtgtgtaggatcaataaaggggacgccattaagaagaaggaggcggtagtactggcagtgagattctgggctacaacagaattggctagatgagaaaagagaggacaaataggagaatgagttaagcagtgaaattagcacataatttaatagctgatataactaataccatttattcacaacttcacttaaaatattaatttttgttgttttaaaatcttttccagatagaagcttctgaattagttatcagtattttgatttctcactttcagcaactaagcagatagcaatgaaactaagttggaggggttagacccagattcgtaaggaatgctcaacgtatgtacaccagagtataatcactagagaatatccacctccttaataaactaattgtacagataacgtatactgtagacaatagcacaatataattctaaatcattaaaacagcctgatttacttttcattttatagtaatcccctccctactgtcactgttacccattggcatgtatgaatgaggactcagtggcaatctttctgctgaaattacagaccttttaggaacacaggtgtttagtattatcattattccttttcatattttttttacttagtgcttagtatttctaaccccaacaggcttcagagtgtgcagtcaaaccttaaaaagatcatactcagcccatgtcttcatgaaaaagagacctgtataaagacattttcctttggtttcatgtgattaaactatctttgttttctaatgctactgatacactttcaaaatgctgtcttccagtcaggatgatatttggatatactcaagaacaaaactaataggaaggttaggaatttctaattttatttgtaaaacggaatttttagtcatggacaagtaattaataatgacaacggaaaaaaattgctctttttagatgattttcatgccacggcatctgtgtcatctgaaggagtaaggaaacagagtcctaaactccaggtgttatattaacaatctttattaaaatgataaaatatttaaagtagtgttttatcaagcttccttccatccatctcatcttcaaccactagtcagccaagtgctaggcaatgctgaggttgatgactggagaaggaagatgcaaatatattaagaataatcactcagctctttagagattttaagtggatattgccacccacttgacttctgtatcaaaataaaagccacactcctatatatagaacaaaaaagccagaatattttattgtaccacctgaaattttttatcatgtgcttttgacaactcttgtgcaaaggtgtgcaattcctgaatttaccatactttttttctgaaactgtctcattttactttctttatgtgacacttcataagaaatcaatagttatgcatagttttttttaaaaatctcaaaaacagattatgaaaagagttggctgggtaccaaggggcattttgtgaatttttttcccaagacatcccctttatgtccttagaaatcagaaacaatgaatattaacattcttctcaaatttattgcaaatataagtcatgatgaaacaaaaaaaaggatatgctgaagatacagaaatcaggtattattcaatttggggggaaatggtttgttactttactctcatttgtggaattcaagaaatgagattttgttgattgctccaacaaaactgccagcaggtaaaactttatctccatttatcctaaagataagattactcagatattaaagtgggggaaaaactcgattataaaagtgcttttcagaattgtaatctgatttatcaaagtgttaatatgaaacttttccgtaggacatcctcattttgtaccacaatgaagaaaagtgcttgacagacccagacctattttaaactaagattatttaattagtaatttttatttccagtgagtctggcaataaactgtggggaatcatttcattttcattcattacaagaagccatagtttatatttcccccaggcagagatttttatctgacaatttgaatgctttggtgacagaaatatctgatgataaatatggtattaaggagatgccaagtggcatgatagtttgaatcatttttggtaacagctcatgattaataatcgtgcttatgtatgtattcacgttttttattattgaataacattttgcatgggaaatgggagtagatgttctactccattttcatttctgtgaaaaaaaaaaaaaaaaaaaaaaaaaccaaatgcatgtaaaacatggctgaactggtagcatatgtttaaaccatgtgtctccaggtagtaaaagaggtcagtctcctccaactacgactttttatctcttatttttgttttattgtggtaaaacaacaacaatgtaaaagctaccatttactaaaggtatattggttgccatataatttactatgtgctaaccatgtattctttcaaacttatgaaacaaacctgtaaaatgggtgttattctccctggaatacacattattaaccagcacagttcccatattttggtgtatattggtatcactgagaactttaaaaatatatatgtctggctcgtaccccaaggcattctaattgaattggtactgtatgagatgtggcctggcattggaatttttaaagcttcctgtgtaatcctaatgtgcatcaaaatttgtacaccactggattaatctggagctgctgaaagattaaacaattcccccaaggccacacagctgttaagtagtggggtagaaattccaactctaaactttctggcgtcacaactgaaatgcttccatgaagtaggacacactttttctttagggttctgttcagagtagagatttttgcacctgtatttgccttcatatccttaaccaaaattccaatgaggaacagttttgataaaatgatataatagaaagtttgtgaagactcaatgaggtgctttatgtatattataagttaccactacactatacttgttaccgtagttatttcccaattaaattacctgcatttgtaaattgtatgatctgatgaagttgtgcacctataaattaatctaattaatctataaatataaactgagtgattctattttctttttatcttttatctatgtagctttagttagctgagctgataacttttcaaaatatgaaggcactaaggatatattaccataaccccctgcctgagcaatttttagctcactcacacaatctttcctttttttgtttttttcgttgttgtagtttaagaggattttagtaattaaataaaaatgttcaattaatgagatactttcttactaatgtaaggtaaaatttatatttctggtttgctttgtgtatttttatgcaatttatcttccctgtatattaaaagaatgactatatcctgctgtatccataagactattaagttaaaaaatatccatttactgttttttgaagcattggactaaaaaataatgatttctaagaaaattcagtcactattctcatttgtacaaaattttttagaaatgaaattaattctgttatttttattttgtggtaatgaatatgcatcattttatgtttgtgactttatagtccctacctagttcctggttcatcccataaattaacctactagagtggtgagctagccaacatttgcaggatgaaagcttctgaagaaattagtcttttttataaagccaaaatgaaaaaaaaagtattaagtcctcttttctttaaaagcttaaggtaagcaggtaattctattatgggctttttttttttcaaaatttactacttcataatggacaagcataggattatttacaactttgcatttgtcatatatttttaatatgtttataagaagtatatttgtttatttacttaatcactaggccaaactctatagcaataatgtattctgctgcaacattttagaaaatagtaatttatcccattatggatattttgttgaacacaactaatattccatacccatttcagcagctaaagattttagtatgtatgtatgtattattgggtagtactagcaaattctgtatattgtttttactacaaatattgttcaacaaaaataagtacttggccgggcgcggtggctcacgcttgtaatcccagcactttgggaggccaaggcgggtggatcacgaggtcaggagatcgagaccatcctggctaacacggtgaaaccccgtctctactaaaaatacaaaaaaaaattagccgggcgtgatggtgggcgcctgtagtcccagctactcaggaggctgaggcgggagaatggcgtgaacccgggaggcggagcttgcagtgagccgagattgcgccactgcactcccgcctgggccacagagcgagactccgtctcaaaaaaaaaaaaaaaaaaaaaaaaaataagtacttaacttggatactacataatgtcagagtatactttattattacgtacaataaatttgaaaagaaacagaagtcaactttcatatttcaataggctgatccatattcattactgataaaacacatccagtatgaatctctactgaataagagataatgtatgaaaagctggcttagcttcaacaggtttataataaaattgttactctattaaatccttctcgatattcttttataaaattggtaaagcatcctttgttttagtagctttacatttgttatgtttaaagttctatgttgaattattcctttcaggattaccaaagccactgtaaatacaatatttaaaacatttgtggcaattttatttgtaggaaggttcaattagtaaatacatattatcaagaattcatcctctatttcaactttatactggaaatgttggcaatttttttttaatttggaaagatgaaacacagcacagctgaggttgtgacttagagagcaggctttgaaattaattgcaagaatgtttaggtccctgacccaacctaatacttttctgattatgcaggtattacctattatcttctaaatgaaaaatattttcttacatttttaaaagtaaatgcataatatagatgtctctagaattcaaatgaacaaatcatctactatacttttctaggctccattttgctctctgtcatttcttccacaacttttcgaagtgtgctagtattagacagagctcagtatgtctttccttggcacctgcaatggcctcctgtttcatctcttggggttttttttttttttttttgacctctggaacactaaaatttcatactagacctaaattaacatccagtgtgaagaaaagataactacattgtacagaaaacaaaataactagatatagctggtaattgggtttggtactatgatttatctctcaaataaaaatcagtgcctgacatggcagtaatattgctttataaccaaacatcaaaggcaatgccttagggcacgtagcctgatgtgcatttgccaaaaaatcttaaaacatataaataacttaaaagcataggaatctgtcttctacaagcactgtatggatgtttacattttgtatttgactcatgtttcttcaagcaactcagtccctcttttagcattttaaccttggcattatacccttcttagctctttcctatgtagatatatgttttgtcagaaagcaagaacaggtgtacagctacaggtttttgaatttcaggcttttgactttacagacaaatgtttcatcaatccatattgtttttaccacatgaaaaatccaaatactcttccattttaaaagaatacatcttaagcaaactacaatgaactcttctgttgtcctacagcagaactgtttactgtgataagaggataatcgtcttagattttgtcaacttttgtgaattatctcaataagaattttggcctttgaatactggagttcataggctctactatttaaataataaccattattctgcatcaatatgctcacaaatcaatttgagaaatattaatagacaatttttattatagtttagcttattcatgggcttcatttttttctgaattgaaaacaattaatttaaactgataatatatcataattggcttgagataacacacagtgtgaagaaaacatagccacattttaaaggaaatagctagatggctgataattgcatttgtgactttataaatgtggttttcattccaaatatagtatttcccctacctccaagagctgattcttatatatttttaagcctgccagtatatgaagaaagcatttccgattttaacacccacccagtatgttgaatccttagagtgataatatctacattcagaggactaatccaccttcaaaaaagaaagaaaagtaattccaaaaagcaatgatttgttttagtttactttatcccgtaatattgagagctgcccatttgtaagcactgtgctaagtgctttgaaaacctaaataatgcaaaaggcatcgtctctacctgtaagaagcatattgtctcagagggaaaaaaaatgcacaaattgctgttcatcttcatttaacctggacaccttctgagctttcaatatggaaaataatagaatataggtcgtaataaaattgagagaatgttttcccagcgaaataccacagaatcacagtattcacaattgtgagaaaaattagcatttatctaagctatgctgcccatctgataggaagaaacagccttttctttaaggtacacgtgcaatttatatggaatccaagtaagtttaactaatttttgaaaacagtattaaggatttctcaattactagttttcctaaggaaggttactgtgactgtatgtaatgtttataccccaatacaaagaagcaatctcagtgtggagagagatgaacatcaccaagtggaattttcattctaattcctttgaaggtgattattctcagtgccataaccagaggctgacacccagggggtgctctgcaggaatttgggaatgagtaagtgaagctaaggctgtgttgtgcatgtttaccttcacattctcactctgtatccgggaaactttttggccatttttccatctcctacacctgaactggaatattcaggccctgttcccgaatcaccctttcttaaacttctcatcttcactccatcccctgacctctttcttctgatacaacttcctaacacaccagaaaaatgatagccttgagagaaatcaaatcaaatgcatgggggcttagctgacacgactcatcaaaaaaaaaaaaaaaaaaaaaactttagggttcctttaaaccctcaggccacagcgtgagaaagagtagccttgatccctccctcaccaattaaagcctggtctcaagacaactctaaaataaaacaaatgctaggaataaaagaaaggctgttgtccaagtggcacagaggaaagcttacatttgaatcagcattaatttctgcagtactggaggtcatcactaatccattcaccagtgcttgcattcagcacaattatcacgctgtattaagcacagcagaggactcactcgtataagatgagatgctcggagaaagggaggactggagatgtttaaaggagatttgtttcttacatggttttaatttgaaatcctttcattctgaagatgtctggatattgagatagagcaaatgaaagcagtacattcctgttgcggattcagctgtgcatctcacttatttgaaaggcttaatcagcacactcaggaacaagatgcgagacatcttgaggcactgcttacttgtcagctgcaagatcaataaaatgcagaagccattctttgccatactccagagaatgaatttgcagagtgagaaggactccactttgaagctattttattcacatccctcttggccaaagcagaaaagttgctatggggaggcacttgaagtttggcccccagctagcccagctgctcctgctcaacctgccaggtgactcacttgctcagtattagtctgaacagcagggtgtcaggtcagaaggcacttccagtctactcagacaattcaggcagtgtaattattttaaatgactgtataaaaggtgcctgaaattctctggtagccaatgttgaatggactcattaatttaggattattgtcgtacctgacaaaagcaagcacaataccaaggatgcataaacacagatcttacagccaggaaatgcagactaccatattctactaccgtattctatttttgtattcagcattgatcgaattgccactatgccctctctagaggtaacaatggggaatttcagaaatacctggtaatgctgtgtggcagtgatttgaaagagaagagacccagacagaccactatcagttacattttttttaaatagtaaacaagtgctcttctttactcatcataaaaaaaatttctaaagaaggcctctatatctgtgtacctttgagagcatgtaagtgtaagtgtaaatgatttttaattaaaaatgaagtatacaaataaaatggtaccatattacctgccatttgtattgtttatttacctttcatatttattttttagaagtaattccctctaccgacatttattaaatgttcactgaaattgaagcttgctgctagatactgtgaggaatataatctttgcctacaaaggggttctctatcttgtgagaaaacagatgggcacacataaacatgtggatgagttgtggaccagggaagtactggacatggtttgagcatagaagcagatttttacatctcaatcctgtccctgcagcctgattgatatgagagatgttgagagtagcccaccaaaatcagtatagcaagagaaggaaggtaagacaagcagatcctcccacattcaatccaacagcaagaatgatttttgataaattttaagagaggaatttggtccagtgatgttatttgtgaaacgtggccaatctcaatgaaaggaaacacctatgtttgctctctggaccctttgaaattcaaacactccatttccctcctctaccttgcatctaatcattactagttctgcctacttttacctcttaaatatttttgaactcttcctcttctccgcccctctttcagatctgcattatttttcacatggacaactgtagtagcttactctttggacatagttttgtcccgtcttaaatctactctttatggcacagtgggaatgatctaaattaaatgaaaatgtggccatagagtccttcaaaaactccccatcactaacagaaccaaattctatcatcaccgtcttctgcaaaataatctagcatttttctacttctccacttcatctcttaaccattcccccaccaacccatcttgatctagtgatactgaactgcctctaattccctcatcatagcagcctgttccctgcctgtgtctatcctgtctcctctctccactatgcaagctcctattcttttccgggaatcattcccagagccccaagctaggttattattccctcttctcttctcccactgaatcttctgcattcaccaacacaatatctgccatattatataaaaatgttcttatttctctgtgtctccccattacactgaagccccttgaggaaaccagtactgtaaacatagccagctccttcttcccattcagagatgagacttggtgtaacctctcagaaaggccatctctgatcacctgacacccacacttgattcacccttctttttttccttcatagcacataccacttcatggtattttcttgtttaagtgtttgtttattatttgtctctccactagaatgtgaatcttttaagagcatagaccttttctgccttatttatccctatgtcactactacctagaaaagtgccaaatatgtagaagggcttcaataaacacgtattttcaaaactgaattaaatgaacggatggagtgatgggtggatgagcatatacttagaggtcaataaattaataagaacagaatttgcctatccgtattagataagcagagtataagccaatgatggtatcaggttaattttaacaccttaggagacagacacactataaactgtaggtatttaattctgtgactgaatgcctgtattagttcattcacacattgttataaagaactacctgagactgggtaatttatgaagaaaatagtttaattgactcaccattccacaagctgtataggaagcatggctgggaggcttcaggaaacttacaatcatgggggaagggcaaaggggaagcaagcatgtcttcctatggcagcaggagtgagtgtgaagagagacgtgccacacacttttaaaccaccagatctcatgagaactcaccattatgagaatagcaaagaggaagcccgtccccatgatccagtcacctcccatcaggtccctcccccaagactagggattacaattcaacatgagatttaggtggggacacagaggcataccatatcagtgccatacattatgtactgttgcagtggatcccaacttgtgaaaactccattacatcctcagtgttactagtgatatcttgtatgttcattccatgttaatgttcctgttgcctcccctaggatgcataagtatgtatgcttcacataatatagcagaaggaaaagatccgagtcaaattttgaagaattactgaactctccacattaaattacacagtcatcttttacaagcttaacttccatcctcacaatttttctaattcatgaaatagtcctgaaaacatttttttcttgaagtattatttcaaagattatatgagaaaacacatgtgggtacacttttcaaacttcagagttctcatctgacattgattacttcatcaattatcatttcatatatcttctatcatttgttgatagtaaaagcaatgtatattttcatattatctttctttttaagcatcctgttattaattgcttaaggtcacttaatcttaggtgtatattcatttgcattctgaattgtaattccttcactggtttttataactgttgaatttaataggatatgggggaagtggatagcacaggcaaaaggaaattggattttgaactttttattgtgatgacatccatttgattgtggtccacatgattagtgaagaaaatctgctgttgtgacaacttcgcagagtgaaataaatctaaggcttggatttgcttattactttactgtttagaagcaaaaaaagcccccaataacaacgttcagtgcatatttattgggcttttcctgtgtacaagccaccatgagcatctaaggatataacagtgagaaatacctagctcctactcgaaaggggctaaaaagccaggattacttcagttgaggtcctctaaaaagaagtatgaaaataaccttacagaaccaagctcattattttttcagcaatttatagctccaaaagcaaagctttcattatcttgtcttcttcacaactgataagttaagtgtcatcataaccccgattttaaaaagtaggaaaatgcagaatcactaactcaaggcagtaccttgacaactcacagactcacacttcattcaagaatccccatcacagtcatgcttcctttggtggccttttttgactatatgtaagtgacagagtgtggtatgcaactgttggaaattggtttttggggggtatttttgtttgtttttgtttgtttaaagcaacaatatagaatcgaggactggtgatacttgtaaatttgacatcatggcaatgaaatagctcatgcaaaaatactttgtataagatataaccctataatatatcatgtcaatatatattatttgaattgtggagggttttttgttttgcttttttgttttgttttgttttttgagatgaagtctcactctgttacccagactggagtgcagtggtgtgatctcagctcactgcaacctccgcctcctggcttcaagtgattctcctgcctcagcctcctgagtagctgggactacaggcacatgctgccatgcccaggtaatttttgtattttcagtagagacagggtttcaccatgttggtcagtctggtctcaaactcctgacctcaggtgatccacctgcctcggtctcccaaagtgctgggattacagacatgagccactgcgcccagcttgaattatgttttttgaaagaattaatatgcaggactaaagagcatagcaaagatttggaaccttatggcagagtgagttgcacatatatattttcaaaatcgctcattggtatttggcttatctgataaatacaacagttcaaagtcaatgagtttcctgatatgttagctactaaagggaggttgatagattaaacaatgaagtagaattataggatattgtgatttgagatctactctctgctttaaaatagttacaaattctgtgaagatatctaattcagcataaggtctttagaggtatacaactaaatggcacagagttatttttaagtctgccatacagctcattaatcaattctggctctctagctctgctagtctacttactggcctacaataaatggcctgcaataaaagatctccctgcctgtttcatttttccatccaaacattgtacaaactaaggacaagatgcttgagacccctttgatgacaatattattaaaaagctaggctcctgccattactaaagtcacagtgtcatcatgaaagtttcttagtacgtttatgaagtctgtaaagatcttgaagtttaaaatggaaagcaaaataagggtccaaagaattaatatctgaacttttaacgttaagtttttgggaatgtgaaaatcagattatcatctgcagctcgtaagacttcaattctactaatgaatggcttcttaatttaatgattctaaagtgatatagtatactttcataaagtgctaagcagtcctaattacatgttaaaaaaagatcttattatctaaatttatcataccaagtaattttttgtcaatggcaaagatgcaatttttactgtattaatgttgtctttactaatacagtctgattaagatgattacttatccatatatttttatcttctttataaaaaaatttaaaaatttgaaagccatcagagctacttaccatgtttatgacaattaaaaatatggttaacagtgagaaatatcttactaagtttcaaaaatattataatttggctcctaatattttttcttattttcaacctcaatctaagtgtaaacatttaattactgacaaatgttggattttgacagtaattaaaatctaaaatgtacttggtcataatcaccaatcaagttgactttcatatactgatatttagtagtagcaatgaacttctttcttattttcataaattctgataaattattgtagtatatttttataatacaattatcgtatatattatacaaatctaaattggcaaaatattcagtatagtatatgaaatgttaatgaaattaagaacatcttttccttatatcatatccctacttattctgaattttcaaaactgaatttaaaagaaatgtaccttctgctgaaattttataacgcaattaagaatttatatataattttatatataatacaaatatatatgtaattttttaaggatggatttatctccatttctaatttgaaaaactaaatacatttggtatctgagaacatatcatttgagcataatgtgttttaatcttagtattttaaaatttcattggaaaattttcttaagtttctcagttgcaaatgtgaagatatacatgcagaatcccaatatgtagaattgtgaatttgaaactaaagtgctaataagtattttaatatcttgatttactgagttgtacacattgtcatgtataatgttgtcagagagtttacctgctctctttataaaaataatttgtctacatatattttataatttataatatatcatggggtattataataatatttttaaatgttaacagatttacccatttcccttttgttgtggaagcataactgatggtgggtataaaaatttaagttataaagtttatagtagtgagaaatgctaaattagtacaaaaataactttgaaaaaaagctcagctttatgataataaagaaataatggatggaaaaatatttgttgagagcttataatttgtgaggcatgctaatctccgggaatataaaatatgagataagccttttaagagcattatgcttttgttgacgtgatcaacaaccagaagctatcagtacagaaccagaatcataatgcagaagggaagtgtctattaagtgactactttcaaagcaaagaaggaagagagggtcatgagaagcaagaattatttccttaatttagagatcgataacagatctgtaaaggggatgaagagtaaatagcatggtggtgcaaattcaaatcatttaaaaaaatcctatcaaatcgaacagacacatgttgtatatgcattgtttctaatacattcatattttttcctgtttttgtttccagaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcaggtaacagatgggatgggacaaggttaatgttataagtcatttttaaatgattctggtcattttaaaaagcagacaaaagggaactcagtgtgactcttccttatggtcagaggaaagggtaatttagtgaagagttcaaattagctcccaattctgagaagtaaaaaacatgcacattccattaagaagttagttaaagagatcaaaaacgttaaaaatattcaggtataaatatcactgttttaaggtgcatatcaaagcaggagactttctgtatactgtgtgttcattaccactgtgataacgtttagcagcaacttatgatactttaagaacataaaaattatatcaatgttttctatctctaagaagtgggtccacaaatgcaagtataaaatataccatgcatcataataacaatacctcaaatgcaccttctttcaagctgagggtgtttcatttcatagtgttattcactctcatcaaccagctattttttaaaacaggagaaaacaacaatatactgaaatattaagtgatttcccagagggggtagcaaggcccagagcttatatttctgtacatttcaatgctttttgagcatttagatgaactatgtactaggagtacagaaagatgatcaaaactgatgtctgtgaaagagtaaacctctgttggggaaagcacattaataaccatctaacaagtcattgatgtgtactaaagggaggaagaattcagtattctgtggtcagaggaagaattcattaattatcttgagaaactcacctggggcagatagcttttgagctaggcctgagaaggatggctttcagtagagactgaacatccagggaacagcctgattaaagatgctacatgacaatctggggaatattatgtagaaaatcatgactagagtaaaggttgctggagggatgtgttcaaattcattgtacgagtttgctgtgcttcgggagtcatactaaaaggtattagccttatttcagtagagtagggagatattgcagagttttgattagtttaggtgattgatctgttctatctgtttactacgtattctaagtcaaagaaacatggaaatccctgatgtgacataattaggtgtactatacaagaactagtttacaggcatttggtataaacgaaaattgatttatggctaagaggcaagacttccatacttgaaaaactgggccaaaatctccttcagatactttctttgttcagatttcttaggcattcttatatgtctcataaacatttcttttatctatagagctctaataaggttgcctgaagttcttgttttgtattatgaatttatatttacatgaagttgttaaaattgcttcttaagttacacttgactttttcaatctatagcaacatgtgcaaaatgaactccagatagtggaaatggcacatctatacagttttatcacacttgtgaaggatcgattaaggtttaaaatatgcacagaataatagaaaataattatatcatatttactaatgaataatcattccagagacatttttaatcactctagttgaaatgcatttgtaggactgtggtcatgataaaactttagacattaatattcatagccaaaattcagaacagttgagagatgatatcaccagtttacatcagggtttctgtttggcaaattatgttcgtgagcttcaatgattgccatctttctataaaccataagtagcatgcttttccagtgtttactctgagaaacaccttattaatgtttcatatccgattgttcactttactttgtcccagtattgcctacttaacactatgcatcattcttcctttcaaagtattgtgtgaagttttaattccctttatcccagtggctgtaggcagaaataaccttaatcgaacaggacagtgatcaacactgagaaaaatttagatttattctcttaagaacaatagttaaaacttattttacttttaaggtcagtgggatgatgataatttgcttttggtctgaagatgataatgaactcagagaaaaacagctaaagtaaacatgaaaggttttatattagagtgagaacctcaaatataatgggtgaaaaactaaaaattattgttattcaataaatttttaggaattatattcaatgtattcattttataattgtgttctttaataatatatttttaatgttattttttacaaaactttaccaattttctttttttttttgaaacttttattttaggttcaggggtacatgtgcaggtttgttatataggtatacttcatgtcatggggtttttgttgtacagattattttgttactctggtattaagcctagtatccattagttatatttcctagtcctttccctcctcccatccttcaccctcaggtaagtcccactatctgttatttcattctatgtgtccgtgtgttcccatcatttagcacccactgtaagtggtgctaagggaaaacatgtagtatttggtttcctgttcccacattagtttgctaaggataattagtttgctccagcttcattcatgttcctgcaaaagacatgatctgactcttttgcagctgcatagtattccatggtgtctatgtatcagattttctttacccagtctacaattgattggcatttcggttgattccatgtctttgttattgtgaatggtgctacagtgaacataggcgtgcatgtgcctttatcatagaacaatttatattcctttgggtatatacccagttatgctgtggctgggctgaatgttagttctgtttttagttctttgcggaatcttcacactgctttccacaatcgttgaaataatttacactcccaccaacagtgtataaccattcccttttctcctcaaccttgccagcatctattattattttactttttagtaatagccattctgactgttgtaagatggtatctaattgtggtttcatttgcatttctctaatgataactgattttgagggtttttttcctatgattgttggctgcatgtatgtcttcttttgaaaattgtctgtttatgtcctttgcccactttttaatgaagttgtttgttttttttcttgaaaatttaagtttcttatagatgctgaatattagacctttatcagatgcatagtttgaaaaagttttcttccattcggtaggttgtctgttcactgtgttgatagttcctttttctgtgcagaagctctttagtttaattagatcccatttgtcattttttgcttttgttgcaattgttttccgtctctttgtcatgaaatatttgccatttcctctgtccagaatggtattgcctaggttgtctttcagggattttatagctttggattttacatttaagtctttaatccatcttgagttgatttgtgtatatagtgtaaggaaagggtccagtttcaatcttctgcctatggctaaccactatcccagcatcatttattgattagggagttctttccccatagcttgtttttgtcagctttgtggaggatcagatggttgtaggtgtgcaaccttatttctggtctctcaattctgttccattggaatatatgtctgtttttgtatcagtatcaaaacagtacttttggttactgtagccctatagtatagtttgaagtcaggtaatgtgatacttctagcttttggggggttttatttttgttgttgtcttcaggattgtcttggctattttaagatagtattttctaattctgtgaataatgtcattgggagtttgataggattagcattgaaatctataaattgctttgggcagtatggccattgtaatgattttgattcttcgtatccacaagcatggaatggtttttccatttgtttgtgttatctctgatttcttggaccagtgttttctagttcccattgtagagattgtttatttccctgataagctgtattcctaggagggttttttcgttttttttttgttttgttttgttttgttttagcaattgtaggtgggatggcatttctgatttggcacttggcttgactgtggttgctatataggaatgccagtaatttttgtatgttgattttttaccttgagactttgctgaaggtgtttatcagcttaaggatcattcgggcctagactgtggggtttcctagatccttcgggcctagactgtggggttttctagatatggaatcatgtcctctgcaaacagggatactttggcttcctctctgcccgttttggatggcttttacttttttctcttgcctgattgccctggccaggacttccaatactatgttgaataggagtgatgagaaagggcatccttgtctcatttctgttttcaagaggaatgcttccatcttttgctcatttagtatgatgttggctgtgggtttatcataggtgattcataattttgaggtatgttctttcagtaccaagtttattgagagtttttaatatgagaggtgttaaattttattggaaggcttttctgaatctattgagatgatcatgtggtttttgtctttagttatgtttatgtgattattcactcttattgatttacatatgttgaacctaccttgcatcctggggataaagcctgcttgatcatggtggataagcttttagttgtgctattggattcaatttgcttgtattttgttgaggatttttgaattgatattcatcaaaatattgtcctgaagttttctgtttttgttttgtctctgcctggttttggtatcaggatgatgttagccttgtagaatgagttaggaaggagtccctcttcctcgattgtttggagtagtgttagtagaaatgctaccagctcttctttgtatatctggtagaattcagctgtgaatccatgtgggcctgggctctttttggttggtaggctatctattactgattcaatttcagagattcttatttgtctactcatttgaatttcatcctgactcagttttgggagggcgtatatttccagggatttatccatttcttctagactttccagtttgtgtgcacagaggtgttcacagcagttgctgatggttattagtagtatctcttttgtcatttctaattgtgtttatttggatcttctcccttttctcctttattaatctagctagcagtctatctattttattagttttttcagtaacaacctcttgaattttttaatcttctttgggtgatttttaaatttaattctcagaataattccatatagtaggtgtaattatcatcactttataaatttagacagcttgaatcaaacaggttaattatcttatccaagttgtcagaactttaaagattacaaaaaatatataattagcctaattcacagctcttacaatttctttatgaccagtatttttaagctctcaaatacaaaaatatagtatgtttattgcaacacaggtcggactagtaactgtcattaaattaccattggaggatatgtagtgttgtccaatcagcaatgtactgaactcagattgaatattaataattctaaaaggattacacaaattaaaaataaaactattggtgttgtaggtttgttttcaattcaagctaaaagtgagatgacttggtttccactaattttttttggcaaaagaaaaagggccttaagttctcatgttctataattttctaatagtaataatatatttaacaatttaaatggaatagcataacaggactatttccaaactatcagagtaaattgagctgaatttttcagactgaaatcaaaattggtgtatttattgaaaaacaaacacaatttctcaaagaaatataggtatcgctaagaaatattatcagatgttttttaatttattatactttaagttctgggatacatgtgcaaaacatgcaggtttattacatatgtatacacatgccatggtggtttgctacacccatcaatccatcatctgcattaggtatttctcctaatgcgatccctcccctagctgccccactcaacagtccccagtgtgtgatgttcccctgtctgtttccatgtggtctcattgttcagctcccacttatgactgagaacatgtggtgtttggttttcttttcctgtgttagtttgctaagagtgatggtttccagcttcatccatgtccctgccaaggatgtgaactcatccttctttgtggctgcatagtattccatggtgtatacgtgcctcattctttatccagtctatcattgatgggcatttgggttggttccaaatctttgctattgtgaataatgctgcaataaacacacatgtgcatgtgtctttatagcagcatgatttctaatcttttgggtatatatccagtaatgggattgctgggtcaaatggtatttctggttctagatccttaaggaatcaccacactgtcttccacaatggttgaactaatttacactcccaccaacagcataaaattgttcctatttctccacatccactccagcatctgttgtttcctgactttttaatgatcgccattctaactggtgtgagatggtatcattgtggtttcgatttctacttttctaatgactagtgatgatgagctttttttttcatatgatttttggctgcacaaatgtcttcttctgagaagtgtctgttcatatccctttgaccactttttgatgggtttttttttcttgtaaatttgtttaagttctttgtagattctggatattagccctttgtgagatggatagattgcaaaaatgttctcccattctgtaggtttcctgttcactctgataatagtttcttttgctgtgcagaagctctttagtttaattagatcccatttgtcaattttggcttttgttgtcattgctttttgttgttttagtcatgaagtctttgcccatgcctatgtcctgaatggtattgcctaggttttcttctaggatttttatggttttaaggtcttatgtttaagtctttaatccatcttgagttaatttttttataaggtgtaaggaaggggtccagtttcagttttctgcatatggctagcccgttttcccaacaccatttattaaatagggaatcctttccccattgcttgttttggtcaggtttgtcaaagatcagatggttgtagatgtgtggcattatttctgaggcctctgttctgttccattggtctatatatctgttttggttactgtagccttgtagtatagtttgaagtcaggtagagtgatgcctccagttttgttctttctgcttaggattgtcttgactatacaggctttttttggttctgtatgaaatttaaagttgtttattctaattctgtgaagaaagtcagtggtagcttgatggggatagcattgaatctatgaattactttggacagtatggccatttttacaatattgattcttcctatccatgtgcatggaatgtttttccatttgtttgtgtcctctgttatttccttgaggagtggtttgtagttcttcttgaaagggtccttcacatcccttgtaagttatatccctaggtatttcctatacaccaataatagacaaacagagagccaaatcatgagtgaactcccattcacaattgttgatcttttgaatggcttttcatgtctcagacttcagttcagctctgagtttgttactttttgtcttctgatagctttgggaatggtttgctcttggttccctagttcttttagttgtgatgttagattattaaatggagatctttctaactttttgatgtgggcatttagtgctataaatttccctcttaacactgcattagctgtgtccaagagattctgaagtgttgtagttttgttctcattagtttcaaataacttcttgatttctgccttacttatttacccaaaagtcattcaggagtaggttatttaatttccatgtgatcatatggttttgagtaattttcttagtctcaacattgttattcagtaattacttactgattatgttcaaaatatatattttgttaatgcattctttaataacatattttctaagttattttttagaagaaaaaactttatcaattttgtaagattaaatcacctataagacattctgtgaaatcaaatgatataccagagtttctgtgttgatcattcattgttaatttcccttgtcacctaagtctattatttatattcagtccttcaaatgaaacctttgagtacttcgcttaaactcacttataatgagcacagtaaccccctaatctttcaggtgtatgacaaacatgcactaattagtattcaatttcattttcttcattgtcttgatgaaacgaaaattgaaattgccattttacatttatatgttcagcatgcaattattaatagtaccacaatgctcataactggttctggatttaaagagttggtaaatgcagttaaacaagttttttttttttttcagatttctagttttttggagctttatttctttatgtagattttttccaactaataattaaccactacattaaacattagctcatcagcatcctagaatatcagtttttctttctgattaacatgttagaattagcaactttgcacaattatagaaatatgtcttggattataacaagtgtattttaaattctgggtgctttgctaactaactgagggtcagccagtataactatttcttatttattttcaagatatgcagtgtcaatttctctgtgtttttcttttcttttatagctatttgtagtaaaatattaattttattttttaaatttatgggttgatttttatttatatatatgtgtttatgtgtgtttttctagaatacatatacattgaatttccagctattaatttattcatgtattccacaaacatttactcatgaatgtgtactctacactctatccactactaggcagtagagaaaagataacacctactttcaggatgctctgaatccagaaaagataaaagtaagctgggtaaacataacacaaaacatatgtggcctggccttacatggtttgctaactactccatttgaattatattatatccaaacagcctatttttattaggacttttattaaagtaaaaactacattaacataatatttacataatacaaggaaagaaatttccattatactatgtattaccgttgtgtgctgatatatttgatgtgtatgatatagtataatactagggcaatgtcacaatttttctttcgaaagttaattcaccagttgttttttcagttctagtattttatcactgagaaaattgggtttggaactctcttacctttttagaaatgtggctatgatcttaatatgttccctttttatgtgccatagaatttgtgagaggaaaaacagttatttctcaaacttcaatgtgcattgaaaccatgggtcacttggtgtattagtctgtttttatgctgctgataaagacatacccgaggctgggcaatttacaaaagaaagaggtttaatggacttacagttccacatggctggggaggcctcacaataatggtggaaggcaaggaggagcaagtgacatttacgtggatggtggcaggcaaaaagagagagagcttgtgcagggaaactcccgtttttaaaactatcagatcttgtaacttattcactatcatgagaatagcatgggaaagacccgctcccatgattcacttatctttcactgggtccctcccacacatgtggaaattatgggaactacaagatgagatttggatgggggcacagagccagaccttgtcattctgcctgtgtactgtccaaaatctcatgtcttcacatttcaaaaccaatcatgccttcccaacagtcccccagagtcttaactcatttcagcattaactcaaaagtctgcagtccaaagtctcatctgaaaaaaaccaagtcccttcagcctatgagcctataaaatcaaaagcaacttagttacttcctagatacagtggtgatacaggcattagttaaatacggccattccaaatgggagaaatcggccaaaacaaaggggctactggccccaggcaagtccaaaatccattggggtagtcaaatcttaaagctccaaaatggtctcctttgactgcatgtctcacatccatgtcaagctgatgcaagaggtgggttcccatggtcttgggcatcttctcctctgtggctttgcagggtacagcctccctcctggctgctttcacaggttgcctttgagcatctgtggcttttccagacacacggtgcaagctgttgggggatctaccattttggggtctctaggatggtggccctcttctcacagctccactaggtggtgccccagtggggactctgtgtgggggctcttaccccccgtttcccttctgcactgccctagcagaggttttccatgagggcctcacccctgcagcaaacttctgcctgggcatccaggcatttccatacatcttctgaaatctaggcagtgtttcccaaaccccaattattgacttcataaaaaaatccgtatgtgaaatttgtactacagaaatttgtaacgatttattaccaagtccctaggctgcacacagcaccggggaccctgggcccagcccacaaaaccactgtttcctcctaggccttcaggcctatgatgggaggggctgccatgaagacctctaacatgctgtggagacaattcccccattgtcttggggattaacattcagctcctcattacttatgcaaatttctgcagctggcttgaatttctcctcagaaaatgggatttttcttttctattgcattgtcaggctgcaaattttccaaacttttatgctttgcttcccttataaagctgaatgcctttaacagcacccaatacagctcttgaatgctttgctgcttagaaatttcttctgccagataccctaaatcatctctctcaagttcaaagttccacaaatttctagagcaggagcaaaatgctgccactcactttaataaagcataacaagagtcacctttgctccagttcccagcaagttcctcatctccatctgagaccacctcagcctggatttcattgtccatgtcattatcagcattttggtcaaagccattcaaccattctctagggagttccaaacttacctatgtttttctgtctttttctgagccctccaaactgttccaacctctgcctgttaccccattccaaagttgcttccacattttcaggtattttttcagcagtgccccactctactggtaccaatttacacttggtaaaaatagaaacttctaaattgctccacaggcctagtgcaggtcatgctcagacttcacagtaaaaatatgtctcgtctccttataaatcttaggtttgtactgccctgagttacagtaaaaatataaataaataaaataaaaaacacttttgcttgatgatgtgggaaccttgttgttggaactgcaagtagtgatgaccacctaggctggagggagaggaaagaacagtgaagaaaatgaggaaagataatgggaaataagtaacccatgaaaattctctgaacttcaggcagacagccttggcagcaactcacaagtaagcattatccatcagtcatgaaacagttaatgtttctaaatggctatttgatttttctttgttataaaacttaatatatttaaatgcaaaaccatataccttctgcatttttaagaaaattatagttaatgtagaatatatcggcccaaaagggaattaagtgagcataaattgttataaatttctgtagtacaaatttcacacatggatttttttaacaactttgttaacagtgggattgagaatgctacaaaaaaagaactaatcatctatttcatttcatatgtctgtatgtaatgtgtataaaaacgtttttgatatttatagacacctggagctttttcagatacaaaaatcattttcaaaagaccaggatttaagaagtagattttttttttcattttcagccttttttctagttacagaagctgaattacatacaatctaattcgtttttaatactgccttattcaagtggaaaatattttagccttttctgttgaagaaaaatactacatgccaatatatactaaactatattcccattcttaccatacacctctttaaagctaattatatctggacattaatatatttctttttctaatgatattttttaaactatgatcccaggtggaaaattatgatttctatttgaattgtttattagaaatgagtttttcatacatagttgtgtgtttttaaacagatgtttctttttaaattaaaaaagcactatgcattaagtaaagatgtcttaatgcttctgtcctgaaaagtatgttttgtctgaaattatttggtcatttaccacagttatagtagtggtagtgcatattgtattgcttgccttttttctctaaaaagctgtgttttagatcttaactctagattctttggaatacatgatgaaccatatagcagttgctctgtatttttaaaaagctgcatctgggactgggcatggtggcccaaacctgtaatcccagcaatttgggaggctgaggcaggtggatcatgatgttgggagctcaagtccagcctggccaatatggtgaaaccccgtctctactaaaaatacagaaattagccggttgtggtggcagacacctctagtcccagctacttgggaggctgaggcaggagaatcacttgaatctggggtacagaagttgcagtgagctgagactgtgccactgcactccagcctgggccacagagcgagaccccgtctgaaaaaaaaaaaaaaaaaaaggctgcatctgaaatctcttctgcttcctctcccactttgagtacccagtgcctcactaaactgaatttcttgctgttcttcaaattaatccagcttattctgcctctgcgcttcaatacatgcactgcatggttcatctattgaccagcttccagtcttctttagattcagccccatcattcccttctctgtgaagtaatccctgaaagccctgccttttatcttcaaaggtagaagtgactacaatccttttatcccactcggtcaactatatatcaaaatcatagtaactaaaatacctttatagtcattgtttgcttttccttctcctcctataccataaacaacttgagagtaggaatcagagttagtttaagtctattcccatggcacctttaaataaaactatgttaaatagatgtcagtaattgactaatagaagaatagggaatactgaacaaaaaaaaaaaaggagaaagatagtatttgttttcacatggcaattattctgcactgtgtgatactaagaatgccctggcgactcagtttactatgttcggctgttatagattcacattttaattggctaagcatgatccattggtaccacatgtggtgcatttatatttatacggggagtgcctcaccaatccagagagcagaggaaccatacttcctgtaaatcctagtgacccatactttactccataatcactgcaaaccacttttataggcaaggctagatgggcttgggcagtatttgtaggatgtttgccaggaagtctaccagttaaaccttgtaaaacttctgccttctcctatcccacttctgttttttgtttgtttgtttttgttttttttttcctcaaatgttaaaagaataaatgtttgatttagcttcttgcacatttttataaatgtattattataatcacaccatgagtttagaaactttagatgtaatattgttaatgtaaaattatcttctccaagattaacttattttagaaaagaagctctaaaatactagtatatttatagcttatgaaatttgtaatatttacccttgtaaaaatgtcagatatacaaactatttttattactgtttctcataaaatacagaacacaaagagttatagagaattactttaacacagtttttagcatctactagcatgagtttagcagactctcagtagacaattcagtttaaccaagcttattatataaaagactttttaaatatacttgctatacattttgaccatgaggaaaacttttctaatttcgctattatatttacaaagtttgagattttaaatgccttcttgttcagttggtttccatttgtttcatgaatattaccaaaataccttctttttatttagtttatgatatggtacagtgaaatggagaaaatctgaattgattgaaggtaacaacttgcttttatcataaaaaaaattcaaaattgagaacctctggttttacaatctacctcagtcacattcatggcaaattcactctggttccgtcttgatatctcttcacatgaccagttaaattgcccctggactctgtatccctatttctggcacttaggactaaaggagttagcacgctgagttcctatcatttttgagttcctatcatttttgagagtttcttattgtaactcttctcctatgttggtaaatgcactctccagtattcccttgcgaatctgaaactatctcaacaaaaggtattaaaattgcttatgagacctgcctatgggaaatgctatttatgaattagattctcatattgcctctaatgtaacaattagttctaatagaactgcatcagggcttcttgcaagagcatagaaagtttactggcagcctgttctcaagtccccaaaggtgagaaattcagagaagcagaagtaagtgagcatctgagctaaaggtttcgttgtctcttcatgtttatcttctgggaactagtgggattactatttgcatagggctgaagaaatcccttatgtccacagcagacactgtgcaaatttgttctgccccagtgcctcactgaaaacctccttgtgttgaaaatgtgacagtactaagccacgtggtctgattctgaaaggtttacttttttgaagaggctattaatttaaaaccatttctatttaagggagtttgttgttgttgcttaaaactaattgaatgtagttagacttaattgtagaaaaagttatatattttccatatttaggttagaaattagtttcattgtccgtagtgttatgtattagctttaagatctaacagttagcacttcagcactatgtgctgcagtttcaactgctctgcatgtattgactgtaattccgtctaaccagtattgttcttatccccattattcaggtggagaaatctaggcacagaaagctaaataaattgtctatgtttactaaacttagtaagttgaaaagttgggagtcaaacccaggcagctagtgtgaggggcagccctaaagcatttgtaacctcttcactatcctctctttgacaactcttggtagttcccttttattttgagggggagcagtggacactgttagtgactgtggggcagtcttggattttcttaaggctatattaagtaactgttatatcccataaaattttaattttcttttttctttttttttttgtttttttgagacagagtctggctctgtcgccaacctggagtgcagtggtgcaatctcagctcactgcaacctccgcctcccgggttcaagcgattctcctgcctcagcttcccaagtagctgggactacaggcacgcaccaccacgcccagctattttttttgtattttcagtagagataaggtttcaccatgttggccaggatggtctcggtctcttgagctcgtgatccacccacctcgacctcccaaagtgctgggataacaggcatgagccaccatgcctggccaaaatttgaattttccataaacaagcagttcattcatctctagcctggggcaatggttctcaaattttaaccacataaaaattatctgaagagctttttaaatatggttcccaaccttaaagtttcttatttaggaggtgagatttggaacccaggggaacacataacgggcagatacccccagcgaattttgatattggttatcccgagaaaatgtagaaatcactaccgtgatggaactcatagtctagcaaaagagacatacttcacctaagatgtgtccttttattattagaaacaacttcattaaataagtcaaaatgctggagaaaagcatattgctcttcaaaatgagacatcagtgtgaaacattttaaagcaatggatggcatcaagacattacaaatccaaaacataacaatctatgctgccttgatggtattttattattaacctgcctctactagtgacatccttaggtggaatccacattcctccatgaactaaaaatggtaataatgcttaattgtttccaagggattggatttttgcctacaacatgaggccttcaataattaagttatgactaaatagtaaaagggttgtgaaaatattcacaacctcataagaccaggctttaaatgttttactgttaaatttttaactgggtcctaggagttcttaagaaatacttgttttctgtgcaactggaatataatgaaaacatcgaaaatccatttacattttaattattaaagatggtttagcatatttagcatctttgaggatgacattaaggaagttattccagacagagagaatagaataaacaaagtcgcactggggatggagaaagctcaacggacatcagagtaaagtcttattatagtgaagagttgcatatctgtaggggtaataggaggataaaagattgaaaaggtaaggagatgccaaaatgtgaaaatacatcacatttagactaaggtggcacttgattatggaagggtattgatactgtcagaactagagtttaggaagatgacatgtaagtggtccgtgttctgaatacctaacacaatgcctagtgctgatgaagctttcagtaaaatttaatggaataattgttgaattgtgctttagagagaggggaacctatgagcaaggataccagctaggaggcttttacagctaactgcctggaggcagatataaggagggcctaaactagactggcagctgttgaaataaaaataaaagatgaaatactaagagagcttgaggatgcatcattaactactaagatatctatcaaattcaagaaaaggagttcatcggctttttgattaacttggagaaaaatcctgataagggtgtatagcattgagttggaaaattacttgttgctctggatagagagtggaagtggattaaatggacaccactgccatgtgacacttctgcttctaagccgttggccatttatgagtcccatggccccatctagtggagtgggaggttgagtgacatccacttagagttgaaagagatagttagggaacatttgggaacttctaaatgaagtttcatcttctcctatttccattttcatcaaaacagtttctgagactatagctcacctgaaagtatcattttgcaggactctagagaagagatacactgaactttgaggttctaaatgagtgtatttattctcctttaatgcctttttcagaacatttcttttttatatcatatgttggttacattttctccatgtatttgcttttgatgtttttgctaccactgctgctgttttcccaaaactgatatatttaattaaagtagtagctatttcatcctaatgctagtgtacttggtatagatcactttattttgttatgattttggctcttgaagaaaataatcaagctctcctttttccccccacaaatagcctgtcacattttcttgcttctattatatacttaatgcttcaatcactttgaaacatttatttctctgaattcataatacatgggctgtattttcatttctcagattaaaaaaagaaaaactatgttcaatgcaggtctccttagtttattactatcattagtgttgttaagagatgaagtactgaattttagaagtatatgtgaatatttttatcttacttttctttgcaggggcccagcctaagccagtatttttacataatgtcagctttccagaagctcttaaaccaaaatgtgattctcacagaacaaaacaaaacaaacaacaaacaaaaaacccagacatttaaatagaattgccaatgtatcttagcttcttttttttaagagcatgcattagcctggatttggaaagatgtacataaattttgaaacatcaatgcattatctgatactttttggaatgtttttctgagtctcaaatctacagtagatgaatgaatatttgttgagcagctactatttgtagagagctatttggacaatatataagttttctctgcccatgtgggcttattggagtggagaaaacatttcaaattatcttatatggaagttttctacttcattctgtggacatttcagagagaaaaagctatttgatttcattcaacaagcaattatgttctgggaaatgtgaggaatttactctgtgagttccagccacatgggacttcttgaagggtacttcattctttttttccatgcttagaaaaaacatattcccaagagacccccaacttcatttaaattaatgaatttattcattcattcaatatatttattatttcccatgtgccaattgctgtatagatgccagttcctcagggaagctttccctaaccctatccctctcctcaactagattccattctaatatatattttcacagcttcttgttcttttctagcacagcccttgccgcagctagtaattagactatgtaagatattgtttattaggtaagctgcatgagggcaggaatactatttgttggctctctttgtattctcgtcaatctcagtgactggtgactagtgactaacctttcataaaaaaatgaaacagatatgctatcataatgttttcatatccccaagactgagaatattttttatttgctcagtaaatatatttgaatgcattaataaataaagtgaggataaaccacattacctgttctctggatgtttaaatgtaatgcaagtgaagcacatttacataagcagttatattatatggtgaaggaagaggatgttcaagatcagtgatcctgggttctactggccattgactgtcaccttgaacaaagttactgggccactcaaaggtatgtcttctttatatacaaagagtcaacaaaaatagatggcctcttaaaattgttgtgaagattatacaaaggatgtttagtcatgtattggccataaagccagtgattaataaatgcatgttctcaataattcaacaaatatttattaagagttatagtcaggacttttaactgttacccaacatcctttccatctgttttcatattaaagagattattagctaaatatatttcccaacctctcattcccaacaatagatgtggccaactattgttgatgagactctcaaatggtcaaaggcatataagcaaaagtgtcacatggtggttcctaggaatttttttttaacagagagtatccacacatcctcttctcccctcttcatccctgcctccatccttccaggaactcagaggctgccatcttggaccgtgggatcaggtatatacactgggtaacgagacagaggatacctggggccctgatttatcagccccttctgcgtagtcacacatttacccaaataagaagcctctttctatttaagacatagttagtttgggttttctgtcactcacaactgaactgtctcatacctaatatgagtcagcaaaataccatgttcacgactagattcaaggcagaatatgatagtgctagtcccttaacaatttcttaagtgtaaaaaaggaagccctttttggaggggccaagatggccgaatagaaacagctctggtctgcagctcccagcgagaccaacacagaaggtagttgatttctgcatttccaactaaggtacccagttcatctcactggattggttaggcagtgggtgcaacccacagagagcgagcagaagcagggtgggacgtcgcttctcccagaaagcgcaaggagccgggggacctgccctcccccaaaacaagggaagccgtgaaggactgtgctacccatcctgggtactacgcttttcccacggatttttgcaatccgcagatcaggagattccctcatgagcctacaccaccagagccctgggtgtcaagcacacaactgagcggctgtttgggcagacactgagctagctgcaggaggtccttttttgtaccctagcggtgcctggaatcccagtgagacagaagaaccggccactcctctggaaagggggctgaagccagagagccaagtggtctcactcagcaggtcccactcccatggagcccaacaagctgagaaccactggcttgaaattctcactgccagcacagcagcctgaatgaagtccacctgggttgatgagcttggtgaagggatgagtatccgccattactgaggctttagtaggtggttttcccgtgacagtgccaaagaggcgcggcaaagcagctgtggccagactgtttttctagattcctcctcactgggcagggcatctctgaaggaaatgcagcagccccagtcagggacttacagataaaaccttcatctccctgggacagagcacatggagggaggggcagctgcaggcacagcttcagtggacttaatctttcctgcctgctggctctgaagagagcagctgatcctgacaagggggattctcccagcacagcgcaccaactctgctaagggacagactgcctcctcaagtgggtcctgacccccgtgccttctgactgggagagacctcccaacaggggtcgacagacacatcatacaggagagctctggctggcgtcaggttggtgcccctctgggacaaagcttccagaggaagaagcaggcagcagtctttgctgttctgcagcctccagtgatgatacccaggtgaacagggtctgggagtggacctccagcaaactgcagctgacctgcagaagaagggcttggcagaagagaaactaacaaacagaaaacaacaacaacaacatcaacaaaaaagacccccacacaaaaactccagccaaaggtcatcagcctcaaagatcaaaggtagataactccatgaagataaggaaaaatcagcgcaaaaatgctgaaaatttcaaaagccagaatgcctcttctcctctaaatgatcacaacaactctccagcaagggtgcaaaactggacagagaatgagattgacgaattgacagaagaaggcttcagaaggtaggtaataacaaactcctcttagctaaaggagcatgttctaacccacatgtttgtatgtttcacacatttacagttacaaattataaatcccaaatcctaagactcatatgatttttaaaattatgtaaaatttctgctaacaaaataccctgattatgttattaggacattcaaaataattcaaggtaaattacaatgcaaggtgaatttttttaattgaactgtagattttttaaaaaattgaactgtagattttctccattcttagattattgtctgttttcaaaacttcagtggtttccacctcttaccaaaataaaacacatacatttttcactttggcaaagcatttgttcctctatcatttataatgttcttgtgtttcaatttgttgtttatgcgtcttttcttttctagaatacatgtgacaagtgcaaagatctctcctgtctttatagatttccatgcatctagcatagtgtttggactctgtagacaggcaaaaaaaattgatgaattaaatacttttagttgttatttaaaagcaaaatgcacgtgtaataataatcagagatacagctggaaaaataagttgtaatgaccttgagggaatttgtgaatgccagaaacatatatattgttctattcactcttcataaaattaactgtaaaacttgtgttacagatgcaattcttttatgaatgaatctagtcagtgatgagaatgaggtagcttttgatcattaaaaataatttgttttctaaatttaggtcagagtaatgaaatcaaaaaataaaagaatgatgttctctcaatttataataatttattcttcaacgttagaaaacgttagatcagattatattatgctatttagaggaagtagaaataaaactttataaaacatagaatatgtgagtttttaaaagatttcctaactgccaacatctgtttggcaaaattactatttttaactgatgagatatactctatattttccctcctaaatttcaaataatttatttcttgctatataggagtgtttgaaactttattttttgaaaacatataaagtatattcctaccttattaagaagttgtgagtttggtttttctctgtgtattctgctctttacttccaaggaagcagagatgaccacaattccacatcttcttcccctacttgtaccatactgaagaccagaatcatccaatttattttttagggttaatataaagaacaaatgaaatactctatcatgtatataaaagtatttcgaatgaagttaattttaaaaagtcaaaaggacttgatcagtgtgaattgaaaaatcatttagttctttgttactcatctttcttctatatttgtaaatgataaacttaatttccctcttttctgagaagaatggtaatgataacaaacaaccaaaggcttaaagatgcagggtacctaacggacaactttaagactcagataaccctgtgagttggatagcattttactaccattgtatagatgaaaaaattttggcttaaaaagttaaaaaaaaaaatgcccaaggttatgttagctagtaccctagcatgggtgggttacaagcctggttttcagaagacaaacatcttgctcttggctagagtcatcaactgttagatcacaaaactttgcttagaagaaacaaaacttttattgttctttcttttaacatcctggggtcaagacaggaaattttgcccttcagtggtcatattgtactgatgaacacctagaaagaaggagcctctttgcataccctaaagacagtacaggactcccaattccaggcttttgcttctcatctttccagcatgctcatagcaccaccgttatccctaagaagtccccaacccagtaagtccagtcccaaatcttgatttgttgtgcaaaacactgacttcaaatttcagtatctattcactcataaagttattcagagcatcaatacactttaagctattttatctttcctattttatttttaaaataattaaatatttaaacgtagtacccacatgcccatgaaaatacaatgcaaattaaaaattcatccctgctatagaaatgtataagcagctggaaggattaaaagatatgacctcttccaggtaaacgtcattacagactgcaatgaatcttttgtatcaggggacgtgttaagagattacggaatattgacagtgtaggtctgattttggacaacatattaaaaacttactcctaatatgtctaatattcaataatctggttaattcagcataaaacattcctagcagctacctttaggtctatagtaacaactcaataagagaaacaactaaggaatatttagtttattgatacacattttttgaatcataaacttaaattctcaagaaaaaccataatataaaagcccttttgttatttctcagaacatatgttaatgtatttcaatgtgacaatgagatttaattcctaaaatgtatttattttattttatttttgaaatgcaaatttaagattgtatatatttggattacagtaatgccagaaaaacacaaagaatgtagaatgctaagttgtcccttgataatatctattgtgtatgtgttccaaaggcagccactccttctgtttagctctctcatttctttttttggttaattcattcacattctaccatgctagaaattaatatgctagaaaacatgtcgccctttacactagagtgtatgtttgctttgtagacttcttttatcatcagtgcataaaaataaagaacatcacagttttctgtttcccagaagtaccttttaactttttatttgtgatatttgtttttgtcttgatgtttaattgatcccaagtcagaatttaaaataccaggacacttgctaccactaccaataatatttccacacatggaaaggtgtagagtattatcatagcaaaacttggaaactgttctgttggcattgttgttatttgcatgctgcaaataatatactggattaagaaaaatcaggggccataactggcaatccattctcatctgcctgctaaccttttgccatgctggatggagatatgattatcagagaattctgttttcggttaggacatacttaaagtaattggatattccatttttatttttctttcttattcactcagcactgtactcagtttgaaatccactcagtgtgatggcaaatgccaaggagagcattcatatggaccctgtggtgagattcttgtccatcatgcctgggtcagctcttagaagtaatgcacctccccatctctctgttaaaaagtttttaactaataaactccttaaaatgtttcaacagcaattatttttctgtttttttttcttttggttgaacaggtttgtggtgattattttgctgtttgcttttgtacagcccatttcacaacaactaaagagccaatgcttattggcatgagccacctatagaaatgtaagaaagtcaagcctcgcacacagcattcctcttccctctccccttcatagcacacttactgcccctgagattgtgcattaaagacttttttttttctttttggtaacactctggcttctttcaaaaatattcattagcaaagtgaccttaatttcattgtttctaatgtggtttttattgggattagcatttctactcatgtgctgacatcgtttgctctttttattcctcttgtttcttcttcaactttatctttatttacaagagttcgagactaccttaatatttacaatttcatcaaacttgatatacaagctgtagttttcaaaaccatgtagccccagttcagttcactcctgaatgtgtagctgtgggtgatggaggatgtgaagaaactctaacagctggtaccaagagaggagagatgagtacaatatagtggaagcccttcagaaacaggtggaaattcagatgaaatggttatacctggccccgactcctggaaatgccaacagctttcacccctggtggtgtattgctcctgttacatgctgtgtaatgaatggggtgtttcactttaattggaagttttaccaggtgcagagaatcataaagagattatagttttatgtttatgcatatgtgttcttttcccatggttattcaaagaggacaattaagttaattgaacacatgtcaaaggctaaccagcattcagaacatggaggatagtttaaaggtccttttatctggagcatcagaactagtgtttggttagttactaaaaaccttgattaaaataaaaaagcatttaaattccatactatgtttcttagataaactacgtcaagaaatttataattgatacttctttttatttcattgtttaaacatattggtgaagttattcaagtatagaatcctagatatcaattaattatcccaatattatagactctttagtactatgcctttttgaggtttttcagaaagctttttcatgtttttatagaaaaaaaccttttcttttccagtcacattttatcaattgtgtttaattagattacataagtagaataacaatcacaacttgaaaagaaaacagattggggaacaaacacaaatgacccttgatgagcgtgcaattaatctgcaagaacagaagagagttggcttagcagagaacagcccaaagtgccagatgtgtagagcagcaattatgtttcacagcggcagtgaagagtgtcagtgctcaggttgttgctgatttggaggtggtttaagagagactctactgtagccactaggactagttatatttgagttaattttttttttttttttttgagacagagtctcgctctgtcacccaggctggagtgtagtggcagcgcgatctcggctcacttcaagctccgcctcccaggttcacgccattctcctgcctcagcccaccgagtagctgggactacaggcgcccgccaccacgccgggctatttttttttttttttttttttttttttttttgtatttttagtagagacggggtttcaccgtgttagccaggatgttctcgatctcctgacctcatgatccgcccgcctcggcctcccaaagtgctgggattacaggcgtgaaccagagttactctttttatccttaaacacctccaaagccttcctccttaggtgtgttcatgatgcttctcaccacccaagccttcacagaatgtgttaatgatgcatttgataaaatactttatattaataagataatgtgaaagaacaggggagttgcaaatccctgtaacttttttaactgtgctttttaactggaaactttaggtgatcatgcttgtctgtttatttttttaaatcccttaagtgacatatttgcaatccaaatcattggaagtctatttagaactgtctgggaagctcaagttatttctggtatcacccaaaacagatggttacctgttctttttgcctgagacacatttgtattgccagctcccaagcaaaagccctagtaggagaattgttttcactgtgaccagttgaaaacatacttgtttgagatagaaaaaaaaaaatttcctactctttcacttaacactttacttctggtcacaaaacggtgattctccccaccaacaaccagttattcagtggacactgactgagtattctacagttactgcacactcttacactaaccccagttactgcacacgccataggttaaaggcccagtcccacaagacttcctcaagacagttccacgagacttcagacgctaattgcatctgaattggggttcccactacaccctcactgggttcaaataatttgctaggatgcctcacagaactcagggaaacacatttacttgtttattataaaggatattacaaaggatacagatgaacaagcagatgagaagcatagggtgagatatgggagaagagaagaggaacttccttgccctctctgatgtgacaccctacaggatcctctgtgtattcagcaacccgaaagctgtctgaaacctgttctttggaggttttatagaagtttcattatttaggcctgattgatgaaatcattggccagtaatggtgaactcaaccttcagtccctctcctcttcctagaggacggggcaggggtggggctgaagttccaaccctccaatcacctgattggttcccttggccaccactctcatcccaaggctattcaggagcctatcaagagtcaccacattagaacaaaagaggtttctatcacccaaaaaattccaatggatttaggacctctgtattcaacattcctatcacttttgtaggtaactgtgctattgcataatatggccatacttaagtcattttccttgagaatagagaagtaaaggagaaaccaatgatttttcccccacttcagatctcacctgccagcactgatgtaagacttcacctccctatttcaaggcacattattatcatcagtctgggtaaggtatcttgccatttaatattaaattgttattctcttcccaccttccttcctattcctcttcctctatgtgagcccaacctagtagctgatgtgtaacctttcattctaccttctttgtgttgatttgaagtcaattattggagagtacatgatgttatatcataaggtgtgtttttaaatttacatacatggtactgtgtgtatttaattatcttgtttctttttcacatattcttatgttttttagatatccgtataaaaacccagttcatcatttctgattcttagagagtatatttattgtgtgagagctcacacacacacacatacacacaggtacactttatattttaatattcgattcctctggggatagtcacctaagctgctctcctttgctaacataaaagttattacaatagatatgtgtgtggatttcttcttgagcacttatgcaaaagtttttcagggaaaaatacccagaaatagggttgcttaattttactaacaactaacagatagaaatggctatgctagtttacattcccatcatcagcatcagaatacttcaccaatacttgatattatttgatatttttgttttgccattctgttggctgtaaattgttgtatctttttttaacaaaattgcatttctttaatagtgaagattttctctgagttacctttaatatcatttgctccattttctattgatttcctcatctctttgcattgtgtgtgtgtctatgtgatttgcaaaaaaaaaagaggaagaaaaagaaagaagaaaagaagaagtggaagagaaaagaaagaggaggaggaggggaagaggaagaaagaagggagaagatatgatttgatatgatttggctagatatgatttggctagatccccacccaaatctcatcttgaattgtagctcccataatccccatgtgtcaggggagggtcccggtgggaggtaattgaatcatggggacaggttttcccatgctgttctcatgctgttctcatgatagtggataactttcatgagatctgatggttttataaagggcagatccctgcatacattctcttgcctgctactatgtaagatgggactttgcccctccttcgccttctgccatgtgagccctccccagccatgtggaactgtgagtccattaaacctctttttctttataattagtcagtctcaggtatttcttcatagcagtatgaaaatggactcatacacccttgtatattttagatcagttattctcacctgaaaatgcagttcacatatcccttgaagaagcaggggatcccaaagactcattcaggagattcacaaatcaacacaattttcataatatttctaagacgatatttgccacttttactctgttaacgtttgtactgatgccacaaacagtggtgagtaaaactgctagtgccttggcacaaatcatgacgatagcatcaaactatactagtcatcattgtatttatctctattttacacacttatgagtaaaaaaagagagtatccaattcatttaagaacatccttgatgaagcagtaatgataactaattctattattttattaaatgtcaatcctttttaagtctatagtattctgtgtgatgaaaaggggtttatgcataaagcacttttgctgagtactgaaatgtgaccattgtctacaggaaaagcctttgcaagattgtgtgagtttcaaggtaaacaactcctttcccctacttttttgtatcatgtttacttcaaagaacaactgacagaccaactatagttattcatacctgggtatcaggcagatattgtcttgaaaatgaatacagcaatcctgccacatcaatgaaaacagctgacagtctttgttgctagttataaaattggaaatttcaagtgaaatttataattttggaaaacttgtaactatcaatgtgagtttcatacattccaataattaaaaacttttctgatgaaattggtggtgatattaatcagtgcaagtttttgtattatatagtgaaatgtgtcatcgcttagaaaatctacgtagctcggtgagccagtatgttgcaaatgaccaatgtataatgttacaaaaccatgcatgggtgaaaaatccattcaaagtgcaaaatagaccaatggattttaacacaaggaatacaaaatcttcattggtagatttcagattccacaaagcatctaaaatttaacaaactacttttgttaaaatttaaaaagcaaacttttcaagttttggtatggtatcaaagaatatctacagttatctggaaaagttgctaagtcatctcttcttttctagctgcatatttgtatgaagctacattttcttcctatattgcaaccaaaacaacatattgcaatagattgaatatagaaacaaatatgagaacctgtcttctcttaagctagatttgaaagagatttgataaaatataaaataactctttcttagtaaatttttgtttgtttttgaacaatataattattttcataaaaatgtagtgttaatggtaatatttaacctgttcattattgtcatttttaggtgaattaatatatttttaatttgtcagtattaatttctaatatgataaatatttatatatatatatatatatataaaacccacaatggcacgtgagtgtgtgtctgtgtgtgtgtgtgtgtgtgtgtgtgtgcgtgcacacttttgcacgtgtttgtactttggggcttttgataatttgtacaaggtttaaaaaagtaccgagaccatatggttgagaactagtgtacttagtaataagcccctgtgggccgggcacagtggctcacacctgtaatcccagcactctgggaggccgagacgggcagatcacctgaggttgagagtttgagataagcctgaccaacatggagaaactccatctctactaaaaatacaaaattagccaggagtggtggcacacgcctggaatcccagctattcgagaggctaaggcaggagaattgcttgaacctgggaggcggagtttgcagtgagctgagattgcaccattgcactcctgcctgggtgacagaggaagactccgtctcaaaataataagaagaagaagaagaagaagaagcccctgtcaaatttggatgttgcaaatatcttcccccagattatcaccttcctgtgaactttacctgtgatgttcttgtaataaaaatgtttacttttttatttttatttttattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtacccagagtgtgatgctcccattcctgtgtccatgtgttcttattgttcaattcccacctatgagtgagaacatgcggtgtttggtcttttgtccttgcgatagtttgctgagaatgataatttccaatttcatccatgtccctacaaaggacatgagctcatcattttttatggctgcatagtattccatggtatatatgtgccacattttcttaatccagtctatcattgttggacattcgggttggttccaagtctttgctattgtgaatagtgccgcaataaacatacgtgtgcatgtgtctttatagcagcatgatttatagtcctttgggcatatacccagtaatgggatggctgggtcaaatggtatttctagttctagatccctgaggaatcgccacactgacttccacaatggttgaactagtttaccgtcccaccaacagtgtaaaagtgttcctatttctccacatcctctccagcacctgttgtttcctgacttttgaatgattgccattctaactggtgtgagatggtatctcattgtggttttgatttgcatttcgctgatggccagtgatggtgagcattttttcatgtgtcttttggctgcataaatgtcttcttttgagaagtgtctgttcatgtcctttgcccactttttgatggggttatttgtttttttcttgtaaatttgtttgagttcattgtagattctggatattagccctttgtcagatgagtaggttgagaaaattttctcccattttgtgggttgaatgttcactctgatggtagtttcttttgctgtgcagaagctctttagttttattagatcccatttgtcaattttggcttttgttgccattgcttttggtgttttagacatgaagtccttgcccatgcctatgtcctgaatggtaatgcctaggttttcttctcgggtgtttatggttttaggtctaacatttaagtctttaatccgtcttgaattaatttttgtataaggtgtaaggaagggatccagtttccgctttctacatatggctagccagttttcccagcaccatttattaaatagggaatcctttccccattgtttgtttttctcaggtttgtcaaagatcagatagttgtagatatgcggcattatttctgagggctctgttctgttccattgatctagatctctgttttggtaccagtaccatgctgttttggttactgtagccttgtagtatagtttgaagtcaggtagcgtgatgcctccagctttgttcttttggcttaggattgacttggcaatgcaggctcttttttggttccatatgaactttaaagtagttttttccaattctgtgaggaaagtcattggtagcttgatggggatgacattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatcatttggctctctttttgtctgttgttggtgtttaagaatgcttgtgatgtttgtacattgattttgtatcctgagactttgccgaagttgcttatcagcttaaggagattttgggctgagacaatggggttttctaggtatacaatcatgtcatctgcaaacagggacaatttgacttcctcttttcctaattgaatacactttatttccttctccttcctaattgccctggccagaacttccaacactatgttgaataggagtggtgagagagggcatccttgtcttgtgcctgttttcaaagggaatgcttccagtttttgcccattcagtatgatattggctgtgggtttgtcatagatagcccttattattttgagatacgtcccatcaatacctaatttattgagagtttttagcatgaagagttgttgaattttgtcaaaggccttttctgcatctattgagataatcatgtggtttttgtctttggttctgtttactttttaagaagaagaagaagaagcagcccctgtcaaatctagacatgcagatatcttctcccagattgtcaccttcctgtgaactttacctgtggtgttcttgtaataaaagtgtttactttttaaaattttggggagtatgcaatacactgtcctgttgctgaagtcttactactctttccacagcattatgctaagatctctctctctccctccaccatccctccattcttttctcaccccctctgttactccctcccttcctccttcattcttgttcttatgttttacaagtaaatagtatcttcttttctgtactttttcataataaaattacttagatgcctatttatagatactttaaattgtttgaatttgtgttttattatatacagtgctgtagggaataactttttgccaacatcagtttactcatacttgtaggatacattttttaaatagaattgctgagttaaagaggatgtgtgtttgtcattgttacatataaccaaattgtctttcataaatatgatgtcattacactatcacatgaaaactatgtcatttatagtctcatagatataaacatgcctagttctccatattcttgctaatattgtgtagtccaacatttttatttttgtttttgataggtgaattatgattacttggtgtagatttaatttacttttttatgaatatgattatcttttcatatgtttaaaatccatattcattccttttaatggctactaatcaaatcctttgctcatttctattgggttagttgtgttttatctatcaatatgtataatctaatatctttgattgatcaaccatttgctatgatataatttgtaaaagtttaatccccatttgtcatttgtatttattttgcttttaatcttgcagaaatttttactttaattaataacatttttaaatctagtgtcatgaatagaaacccatttttttatctctgagattgtttttaattctgtgttttcctctgataattttgtggaacttattttgggataggatgataggcaatgatctaaatttatttgagaaatctatcaaattgtcccaattatttaatactctgtcttttttcctctcatttaaatattatttatttcatatacaaaagtttcctgcatattggagtctattggttttctattctgttctattcatctgtctccatgtgtgccggtatcacactattttgattatattttcagtcgataattgctggtgtagaatagttatatgttgatcttctattaagcaaacttgcagaacttttaaattagtttttactatttcttgcgtctctagaattttcaaagtaaattgttagttgcatcatctcccaatatgagaaatctcagcaatccatcctcttcccttctggaaagggttttataacactgtcttgctgcttactagtttatattcttcagctgtgtctctttgcttctttgctattgaaaccactccattgggaattttatttagacaattatctttttatgtccaattatccagtatcaccaattggttcttatttatatgcttgttcctgtcttatgtttcagaaaatcttcgtcttttcagggatttcttttgaattttaaagtctgaatctgttctccattagactacattttattctagtattagttctgttttttccttttgatcatggtgcttacattccctagagaatttgttattaataccttagctagtgatgtatctagaaggaagggtaaaattcatgtcccagcttcagctactacaaatggattgagttgatgtagagaggataccttatagcagaattataatctgtactgactctacagtcccctttcccacaaaatacttcatctgccttagacactgctcttaccaggacctcatcactctgatttacctccttagtccataacctgtgatgtggagggcagagggtacaacactcaggcctgctagtgcctgcagactcctgtctaagcctggcccacatttttccactgcttctcactggcagtgggctggaactgggtagatcagaaagagctcaataagcaaaatgagaatgagaaagagaaatagaacatttagaaagttcttcccaagcctgataacctttatgagcccttggagttaccctcaataaaccccagctacacaaacatacactgggatctcaaatttccacttacactaaggctttaccatagtttttgtgttcaagtacgataaatttcaaagcctgctcagcaatgttctgttccagggcatcttaagtgctggattcagtagagaggaccagtagcccatgctagttgctgtcttgtcaagaacccattaatcccaccccccatggtaagactcatgattagatttaaacacacacacacacacacacacacacacacacactcttaaccatagtagccctaaatgtcttattagtatatagctttgaaagttgtttgcaaaattatctttatatgcttgttattgaaacgggaaaagttcccttgtcccccttgcaaggtgtgtgatgggatgtggctcccttcttcagtgtctcactgtgcaaaacccttagggggaggagacagatgggcaggtcattgggagcgtgggctctgaccccacagcagcttctaggggtaaacgtttacagttcctgaagccccaccgggcatgttacagtgtgctcttttagttttgccatctgtaggcagcttatgttaatcagctcaattagaccttctaccttgtcacaaggacagagggctttctctatcccggggttcttgccttggtgtaccggaaaaatcagatcacatgttggcttggagaatgagtgcaaggttttgttgagtggtggaagcagctctcagtgaggtggatggggagccaggagggtatggagtgggaaggtggtcttcctctggagttgggctgctcagcggcaggactctcctccaactgtcctggccaaattccccttggtatccacatcattccatgggtcgatggcctgctggcgtctaccggtgcctgtcggtggtgctcttctgctcctctgctcctctccacatccagccacctgtgtgctcttctgctggtctgttcctctcagtgcccagctgcttgtgtgtgtgcccactagggtctgggggcttttacaggcacaggatggggtgtggcgggacaggtgctcttggaaaatgcaacatttgggcatgaaaacactagtgtttgtcctcacctagatccgtgggcacaggcccgagggtggaacgctcgccagggtccctgcccttctcctcccagcacttccctgtcgccaccccatatcgttatgattatcggcttttataatacacttctcaaaatccaaattttctggcattgagtggttaaaggcagaagatgtaaagaaaatgcttttttgctctttttcatgtaaaaaaaaaccaaaaacttaaaataaaaaacatgttctaagtgctttctaggtggcagatgttgttaatgttttacatgcacatatcatataatattcacatattttattaaaacctcctttacagggaggaaattaaatttcaaaaagcttagacaaattgttcaagattatataggtcggaagtgacaaaaccaagactgaaacccccattagtccattcctcccttctgcatacccttagcatatgttctaagcattctagattcagattatcattctatttatattaatgtaggaggctaccatttgttcaaaataccttagaatgcacttctgctttttaaggatacacagtgttcctaccacccagtggaacaacaatttctctgaaatcagatacataaatgaaaatattttatttccttttcaggcatccaccaagctcatagagaataatttaggcatttctgatgcaatcctcaatagaccttttacatagtatgtgggatagttcatacagggagaataaaattaagatcaccttttagccattgttattttacagagatatcacaaaataatgttggaatgggatggaaaggaattacttgcagatacttgtaagtggaggtgtttccaaaatcatactatatatttcctccaaggcttacttagtttatttcctatagcaacatagtttactggtattaaatttgagtatgactatgatggtgacagcttagcttccttatattgaattattttccaagcttaatagtgctagatacatgaaaagtcaaaagtttaaaacctgtaattactaaaacttagtgagcctgagcctgtatttttataaattttttcattttaattttgtgtttaatggaaacagtgccaaaatttaattacaaatatctactaaaagttagacacaacccaaactgggtgatgcttaactaactgcagttccatcttcctaaaatatatatgcagagcttctaaatattagagcaaagagaatttttacatgatttttaatgatttagagaaaaatacaaactattatgcatctacaattaaagctttagaaaattagtgtctatagcttatgagccaaaactctagcaaagataatttggctgtctacaacaggtataaacaagataattgaaatgagataaaagataattgaaaaaggaatgttcagcaacatcagatgtgaaacttggcttccaaaatgggagaaaacatgattcaaagtgtccactgtgcatattgtatgtattggaaatgtttaaactacaaagagtctcagattaaaaaaaaagaaaatgtcatgcataagataatgaaagaatatgactctttcatagcgatgtgctaattgacctaacatactgaagtaaacatctttcaaacattccctctttcaagttgcatagttaaaactccaaaatcaatctttaaaggactaatggagataaatgtagataaatattaagagtagtaagtaaaatttacattcatgagggatattgtctttttgaacctccaaagaggaatgggacttaaaatgtactcatggttatagttgttgtgtgatgtctgaacatcaaaatgagaaaacctaacttggatatctgagtccatccacttagcattgttcaaggaaaaaagggaccatcggcccagaattttaacacaaaaaattgtactcatcaaaactccagattttctttatatatgaacaagactgagaatcaccttgtgggaaatagttgagggaaggattttatgaggtttcaacggggaagatgagactttgggagactcagaaacaatggcgatagggtggcagttttcatcatgcacaccgtggaccatttcaaatgctaactctcaaagtctcctcctacagtggaaaactctaatcacttacatgaatctgaagattttctgattttctttggaaaataatatctgaatcattaacttaatattatggtatgacatatttaaatttttccaatttatatttttggagagggtgatttatagcaatttatcaagaacatttaaaagattttatagacatcataaaggcattttaattttaatgtttacaatatgtgaaattttaatgtttactatatatgaataaggcacttttctacattgtagcatttgatttagttattaagtgttaagtgtcaaaaagatatctctattaaacatgagaagaatattaacaattttatttgatgtatgttactcctgaagcaaactgttgtaaagggatttggaatggggagaaaatatggagacagaaaattccagttagaaattttacttataataaaatgaagaaaaaagcaatcatttaatttttttaaaaaatgctccacagactacagtgtaaagatccagaaacttaagggatacttgtttgtttttggtttggacatcatttttgtctttactttttaaaattctggtattcaaagatctcagtgaaattgtcatgttttattgtaaatggaaatttctagaagcttaaatcagtttatacacattaatagttatgttgacaatagagttttatagtaatgacactgagattattttgacaagagaatattccaagttttcagtttattaagttacatctgcatatcgtgagaacgcagatgctttctatacttatgtttttggggcacattgcccttttcaaagcctgttcacaaatatttgtttacttaaaaatagtattccattacagaaagggattttgaagctaaatttaatatatgcctattgtaaacatttatccatgaaaattattagctttttatgttattattaatctgcattaacaatgtttcatttctaaaattcgtattttcagtattgttatcctgaaaacaataagattattgttggttgtgctcgtcttttcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtaagaataatttaacctacttaatttaaaagaaaaatgtcattgataattattgattatcaaatgacaaggtcttcaggagaagacttatgttgatgaaaataaattaccaatgcgtcttgtttttaattgggctagtgtgatgaaggaagtagtaattctccagtttataaacttaaaatggctgacatttaagattttcacagattttaattggtggtgctacaaatactttgacacaggtggacacagtcttttgtatgacaattaagctttattttaatgatacatttttattgctttcgtgattaacgcactttttttttttttttttttgagacaaagtctcactctgttgcccaggctggagtgcagtggcgcgatctcggctcactataaactctgcctcccaggttcaccccattctcctgcctcagccttctgagtagctgggactacaggtgcccaccaccacgcccggctaattttttgtatttttagtagagatggggtttcaccgtgttagccaggatgatctcgatctcctgacctccttatccaccggtctcagcctcccaaagtgctgggattacaggcgtgagccaccgcgcccggctgattaacgcactccttaatgagataactattatattaatgaaaactattttcttaaaagcaaaaaagcactaagtgatagaagagatatatatctttatatgcttcatattggaagaaagatttgttacttagcaaaataaaatattttagaggtattgaatattatattcaatacttccttttcttttcttatgatattctcaattcttttgttagttcttcatcgaaaattttaattttaaaaatatcaggactggagatcattccatttaatcaggcattataccagactctaataaattatataaaatatttttaaaattacccccttaaatgaatttaaataaggtttttggattatcaggtttacataaaaggtaaaataagaataagccttaatgaatttacaatgacacattatagtacttgaattttagaggcaaacatagtttttagctggaaattttaataaggaattctattatccaagtacatgggactggttgatgaagacataatcttcatgagtcaaaccttaaagcatcataaatctaatcatagcattagagagactggatgatccggaagcagtagcaaagactggattctacccccaaaagtatgaatactaagtaggaaaatgagcagacagtcccagattaaattgaaggatttaaggtgtccatttctcaaaaaaagagaagagcgctgccctggttctgaaagactggccttaaaattgacaagaccatcacagtggaatatagatcatgtcatgagccacagtggtttatggctttaattaggagtttatggttgggttttatattcagtgctcatggcaaggcacttctcaaatgctccatgctcccaaataatgtaatctgttcttcgaacaattattttcgataaggtatagatagggtaaatatgtaaaaataggtaaataagctgttgcagtgaataattttaaactgtttttacacaggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggtaagtctcaaattaactatttctgtattctatttaaagaaaacaaaaagcatatttgtatgtagcctgttactaacctacaaattcaacaaccatagaaatttttttctggggaaaaatgtctacaacatggttcagggaaaaccagtgtgtgtttatgtatagaataaacaagttctaaaacatgctacagggtagaattaatgtagaaagagtaatgtgttttgttgagtggtcaaagaaagcacagggaattctcacgggaaaattgtcacttttaaatgtgtctcattgttttgcataataactgtgatctatgttttccgacaaaaagtttagtaaaaactggaatctgtcccacctcataaattgcagtaaaggttaagctatgtaacacagaaaagtaagctttatctttgtccatctatcataagaactttatctttgtctgtctaccataagaacttttttttaggttttatgaaacatttaatttctcattcctcaatacttcaataccaagattgctaatataaattcattcttggatcattcttagctagcaacctgtttattgtaaaaatagtggttatccaactcaaggataacctatcaaaggactcagagttaaataattcttgtcccccaggaacatcaatattagctataaagatgaggacttaatgtgtgaatcttacagtggccccatttcaatatagctagattctgaatgaaatagaaaattgtatctaggcatttcacttgttatatttttggtagttgttcttacatttctggcatcacaatttacaaactatctttgctgcagtggcctgaaattattttgttcaaataactgtgaagaaaactaaaagtgcgtgtgtgctccgctttttagtgtaaccctgaagtgaggaaaaacctttaccaaatctaaaacaataccacttaattaaaaataggagaacaagtccctgcaaagagacaactgtgagctttttattcatttcaagaggttgcctataggttaaagcgcatactttatatctgtttctcttcctaaatttatttgtgttgcctaaaaaaggattgattttcaagcaaataaaatttactattaaatagccaatttttaataagcccaatacattttaagaattaaagtaatttgtacagtcaagtgagcctattttaagaatcacattttcatattctatgttggtgtattttttgaagcaaccaacatttgctttagtaccattaattttcctaacagagatattttccttattttggcaatttaatccagtttgtttactccagttattaagatccagtaaatcttagcagacttattgctatacagtgtttgtattgcatctcactatatcaccacagaccagtgtcatccctaagccatttatcataaagcaatcaagaggaagccacaatatgatgagatctgctgcaagccacatggtttttagttgcttaacatcaccttccacaatttttcagtcttttgattcatgagagtcagtctttcacacatggcacggttacacccctaagatgtgaatatattttactcccaagtttgacaagacattgcacctgacactttacaggttttattttctcaaaaagaagcagtgctgcatctcccagcacagcaaattgattttgaacttgcatgcagagagtaatatctctcaatggatgctttaaaaaactagagcacttcattatagaaatacccatttcattgttaatacttcattttgttcaagtgctggccacactggtaagagagttaattaatttatatgcttgaaatcatatggataagaagtaaaatttgtggcatgaggcacattggcagagaggttagctgtaacacctggaaataaacactaatgtaatgtaccaaactactccccacaatccagtggaacactgtaaagccttattgtattcagtaaattgctattaaaatctttcaccctgcctagaagatgagcaggtaatctcttctcaaacacttttgaagatcatctcctaaatacactgaaagaagtatgacttaagatatttggaataaaatagattatgaccctaattagaggaggaatactcattcattcattctatgaaccaataatttggcaattctgagataaatactagacaacagaatggatataaagtgaattttttggctaagcagaagtggtcaaagtaaagccattccttttctatccagtacttcaatactatgttatatcacaaaaggagggaaacaactatctttcctcttcccttgtatctcctgcaaactgagcaaagttttcaaagacttggggggtgggatgcaggtagaggcaaagatggggataaaagaacaagtcagaatttttcaatgtagacaatgcatgccactatgaaactaacttcctgaagataaacagcttgccattaagcctgttagaattttctagactcttagagaattgttatgacttttttttcacccagaatatacaggtaggcattacagctatctttaatatgaggcttcagatacttatctcctataccaaaatgtactcgtgttaagacacacagccctccatgtcatgttttccatgttttcataggatatgcatttcctagatggtggaggtgaagggaaatatggggagcctcaagaaggtagaagtaatctagatagaccaggacagaaggcaattagttatagctaagagttattgatcaatgaagagttctaaagcacctcttttatagtttagactccaaaaaaggtctagttttagaaactgtacccaataattaaatattattgagtacttgttgatatgctgatatttggggacttaccattgccatctgttgggatgagttttacagaaatcatacaaatagttaacattgactgaatgctgtgtgccagcactgtttctaagtactttatgtttattaagtaatttcttagaatacttccttgaggtagtttctattattatcaccatcttacagatgagaaaatttaggtagaaagttgttaaataacagggcaaggctacacagctgggaaatgggagacagtagagtgtgaggagaaagtattgggttggaggagtgtcctcttgtcatctttgtttctttgatgatcaaacttaccttgtgagttacttgaccaaaatttaacagtttcacataaagaagactcagccccgggctcatatgatgatagaatcatgctttctattacaaaaattgtaaagagcattttgtcacagttgcaatccaagactgggaaattttgtgtctatgtatacacacacaaacatatgtgcatgcatataatttttcaaggacaagcaagccaaaatttttaccgtattaaactcaaaaatacatgtggtagatttgagaatcttacaaaaatatctaaactttataggttattgaatatgattgaaataaaataatgtattaaaaggtttgttcagtggtggttattgctagaattatcttattatcttctgttatctattagtttaaattatgcttgcacaatgcctggcacatggcataccctcagtaaatactagattcctctcttacagaagaagccatgttggtgctataagaatcagtgatgaagattaacatatttcttgaaaaacaaaatgctgtccggtttagaatacagcagtagagcagcttgtgaaaatgactttgtactgagggaattttcatttgcagtaatttgaaaacaaataaaagaaaaacaatactttgtgagaaaatgtcccatttttaaagacacaatgaaactgttgaaaactggggagcagtcaggaggcctccagtaatgagacaggagagagcatttcagcattgttttcattttgcagaatcatctatcacagaaaagtagtttaaattgtctgtcttgttttcaatttttccaaaatatattcagacaaaatagcttgaattgactatcttgtttttcgattttgtttcagatttatttctgattatagcttttttttggatttagatgttttctctttggaggaatgaatagcattatgtttaatcttctcttgcctatccaaaatgaatgcagaaaagttccaggtgatcaattatttttctcatggagcccttctcattttctttcaggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtaaagttttccaaaactgtttcactacccactgttcctctttcttagaagatttcctgttgattaggtgagtgtcagagtcgttaccttcacgctaatttaaatgtgccttcatcttcggtttaactaaattggtaaaacacaaattccttatgaaaccatgtctgtgggctatttttacgctggtgttggtttatagatgctagtgtaagcttgatgcaggagactgtaccagatcacactatgtgtatgtcaattgattgattaggagagcatttgcatcttaactctcatccattctaatactttgtattaatattggctttgaaagcatgacagcaagaatccaaagggcattgaaatcatgccactgacctgcaaactgttcacgtagaatcatgactcatgacatattagctccttacctgtggttgctaagcaatgaagatatttgattacattctcaaaacagatcttgcttatagaaggaaaccatagatactgcagagtttatcatttgcaaatgaagtaaggttacagtcagtgctttttaaaacaatcttcatgaaattctcttatttgtggagcacgtttaaatatgcacaggtttgttagtggcttctgtggcaaaaagtaagacaactcaattcgataatgagatcactttatagtgaaagatacgagttctgttcttgttgatttttatgctgtattcatgagtttaaaaactatagtagttcattgcattcccagaaatcatgaaaacaatttaaaatagcaaattccacccctatcaaacaagatttgccaaatctgtaactgttcttaccaggttacctgaaatttgcaatagttcctcttctcttctctcctctctgctccactcctctccttttttgagacagggctcactctgttgcccaggctagagagcagtagtgcaatcatagctcactgttgccttaaattcctgggctccagcagtcctcctgcctcagcctaccaaatagctaggactacaggtgcacatcactataccccgctaattttttttttcttttgtgcagacaggtgtctcactgtgttgctcaagccaatctcgaactcctagcctccaccaatcctcctgcctcagcctcccaaagtcttgggattacaggcataagcccccacatcaggcttcttttttcagttttttcttcagttggccttactttttcttatactcacaagtagaaatactcacttttttctttactttcccttaacattttttattgatctagagctttattcagctctcattagctagcacatgctataggtaataatgtaagtctttctcctattaccgttctatgaactttttgaagataaggagtatgttttctaatatatcatcccagcacccaaccttataagtagcagtgcttactaaattaaattatttatttaacaaatgtttgtgatgaacctagaaagcatcatataacatgataagtagtgatgacatataagtgagcaacacactgttgcttaagacattaagatattaccccttgcttaaaatattcctgttatctgacttagcttacaccattttctattttcctccatcctcgtagcagatgtttcccaatgtcctttcctggtcacacttcttctcccaattatcttcctgctaacatctctttcaccagctccacacactaacattaactgatttagcaagtattggtaatttcaactatgaaaaaatgactcaaatatctgaaaatcatttcccatcttaccatccccactgctacttctatcaccagtgctaccaccctctttcacctgggtttcacagaagcttcttaaccagcttttccgtttctagttttactctttaaaaattcatttctaaagttgtaactcgtgtgtgtgtgtgttttgtgtgtctgtgttttcctaaaaggtaaatatgattctcttactctcctgtttaaaacccttcattactccctctgtttcagaataatgtgcaagttccttaatataacctaagagttttttgcatgatttggccccagttcgtttcttaccctactcttctaaatttgcttgtactcaaaccaagtactatctccttcttcccattcctttataaatgtcctcttgctataagaaatgaatggaaagagcctctacccacagcattatctgccttctgttatatttaaatccttcagcttcagttcggatatacctttctctgggaatattttgctgccaaatccattctgcccacgtctgacttaaatctttatcatgtatactactacatcgtctgtaattttgtcactataccattttcttactgtattggaaattgtgtttttatgctaggctgtttgtttcaagaggctgagaccatgcctgtcctgactttcttaacttgttgttcagcatctaactaacctaacacatggtgggcattccataaagatttgttgaatgaataaatgaatgattcattcaaaaaataattcaagttattggtttgagccaacatagcatataagtttgatacccaatttaagaggccaactggtacatattctcaatttttcaatatttaaaagatacatttaaaatttcttgttgaagagctgacttttttttaaataaggaaactaaatttttataatatatagccatcattgaagttttcaggttcttactttgaagaaaatctcctttccacttgttagacttgacaatgatcaacttaaaatttttcattgctgtatattctaaaattgtaaatattccagtcatgtatcagattggctgcgtatcgctaatgttatttgtgagtcataatgctgtgtggaataaggcaaactattttacaccccataagtagctcaggaggttggtagactctagaaacatccacataaagggattgcaaatggcatatttctttggaaagataaaaattaaacaaatatttttacatgaatcagggcataatcttcagtgtgagcctccatctatcactttgttcaagatgatttttcaactatcttcttaaaatcacttgcatgctaaaattgattcattgtgttcataatagactttgtgttaattcaaggagtagttcttctaatatatgtctaatttttgttgtatcaaaacatattcagaatctccaaggcaaagtaaattgacatcttttccttttatttatttattttgtgacatcatgcaagaaaaaggcccagaattgtgactattttttagtgttttcccctcaagagaatataatctgttcaactgtatattgttatgcttgttagtgtttctgttgaaaataagattaacattttcatagataacaatgtatggggtgattttctttttcagttgtttatatagaggtaacatagaggtcaatttttatcctgaatgtatttataaaatcagacgcctctgaattaggtatatttttaactaaaatgcatcagttctgagcagtagctcttcagaagaaaagccatgtctgccacttaaattcccttccttcattatcaatctcttgctatttttttaaaaaatgtcttttatataccagctaaaaatgtgacgctctaatggagttttatttctgtttaataggtttttctaaaacctaatcagatatctggcaatacaattgtaaattcagccccccaaaataccctcatgcctaattgtcatatagtttaagaaattcttatgtgtcctttgggaattcgtatgtattcaaatctcattttaacattctttatatttttttattatactttataagttctaggatacatgtgcacaatgtgaaggtttgttacatatgtatacatgtgccatgttggtgtgctgcacccattaactcgtcatttaccttaggtatgtctcctaatggtatacctcccccctcaccccaccccacaacaggccccggtatatgatgtaccccttcctgtgtccaagtgtgctcattgttcaattcccacctatgagtgagaacatgcggtgtttggttttttgtccttgcgatagtttgctgagaatgatgtttccagcttcatccatgtccctacaaaggacatgaactcatcattttttatggctgcctagtattccatggtgtattcctagtattccatgtgccacattttcctaatccagtctaccattgttggacatttgggttggttccaagtctttgctattgtgaggagtgctgcaataaacatacgtgtgcatgtgtctttatagcagcatgatttatattcctttgggtatatatccagtaatgggatggctgggtcaaatgatatttgtagttctagatccctgaggaatcgccacactgacttccacaatggttgaactagtttacagtcccaccaacagtgtaaaagtgttcctatgtcttcacatcctctccagcacctgttgtttcctgacttttgaatgattgccattctaactggtgtgagatggtatctcattgtggttttgatttgcatttctctgatggccagtgatggtgagccattttttcatgtgttttttgtctgcataaatgtcttcttttgagaagtgtccattcatatcctttgcccactttttgatggggttgtttgtttttttcttgtaaatttgtttgagttctttgtagattctggatattagccctttgtcagatgactagattgcaaaaattttctcccattctgtaggttgcctgttcactctgatggtagtttcttttgctgtgcagaagctctttagtttaattagatcccatttgtcaattttggcttttattgccattgcttttggtgttttagacatgaagtccttgcccatgcctatgtcctgaatggtatagcctaggttttcttctcgggtttttatggttttaggtctaacatttaagtctttaatccatcttgaattaattttttataaggtgcgaggaagggatccagtttcagctttctacatatggctagccagttttcccagcaccatttgttaaacagggaatcctttccccatttcttgtttttgccaggtttgtcaaagatcagatagttgtagatgtgtgttattatttctgagggctctgttctgttccattggtcggtatctctgttttggtaccagtaccatgctgttttggttactgtagccttgtagtacagtttgaagtcaggtagcgtgatgtctccagctttgttcttttggcttaggattgatttgcaatgcaggctattttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcattgagcagtggtttgtagttctccttgaagaggtccttcacatcccttgtaagttggattcctaggtattttgttctctttgaagcaattgtgaatgggagttcactcatcatttggctctctgtttgtctgttattggtgtgtaagaatgcttgtgatttttgcacattgattttgtatcctgagactttgctgaagttgcttatcagcttaaggagattttgggctgagatgatagggttttctagatatacaatcatgtcatctgcaaacagggacaatttgacttcctcttctcctaattgaataccctttatttctttctcctgcctgattgccctggtcagaatttccaacactatgttgaataggagtggtgagagagggcatccctgtcttgtggcagttttcaaagggaatgcttccagtttttgcccattcagtatgatattggctgtgagtttgtcataaatagctcttattatttttagatacatcccatcaatacctaatttattgagagtttttagcatgaagagttgttgaaatttgtcaaaggccttttctgcatctattgagaaaatcatgtggtttttgtctttggttctgtttatatgctggattacatttactgatttgcatatgttgaaccagccttgcatcccagggatgaagcccacttgatcatggtggataaggtttttgatgtgctgctggatttggtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgattggaatagtttcagaaggaatggtaccatctcctccttgtacctctggtagaattcagctgtgaatccatctggtcctggactttttttggttggtaagctattaattcttgcctcaatttcagagcctgttattgttctattcagagattcaacttcttcctggtttagtcttgggagagtgtatgtgttgaggaatttatccatttcttctagattttctagtttatttgcatagaggtgtttatagtattctctgatggtagtttgtatttctgtgggatcagtggtgatatcccctttatcatttttattggatctatttgattcttctctcttttcttctttattagtcttgctagcggtctatcaattttgttgatcttttcaaaaaaccagctcctggattcattgattttttgaagggtttttgtgtctctgtctccttcagttctgctctgatcttagttatttcttgccttctcctagcttttgaatgtgtttgctcttgcttttctagttcttttatttgtgatgttagggtgtcaattttagatctttcctgctttctcttgtgggcatttagtgctataaatttccctctacccactgctttgaatgtgtcccagagatcctggtaagttgtgtctttgttctcattggtttcaaagaacatctttatttctgccttcatttcgttatgtacccagtagtcattcaggagcaggttattcagttcccatgtagttgagtggttttgagtgagtttattaatcctgagttctagtttgattgcactgtggtctgagagacagtttgttataatttctgttcttttacatttgctgaggagtgctttacttccaactgtgtggtcaattttggagtaggtgtggtgtggtgctgagaagaatgtatattctgttgatttggggtggagagttctgtagatatctattaggtccacttggtgcagagctgaattcaattcctggatatccttcttaactgtctgtcttgttgatctgtctaatgttgacagtggggtattaaagtctcccattattattgtgtgggagtctaagtctctttgtaggtcctaaggacttgctttatgaatctgggtgctcctgtattgggtgcatatatatttagaatagttagctcttcttgttgaattgattccttcaccgttatgtaatggccttctttgtctcttttgctctttgttggtttaaagtctgttttatcagagactaggattgcaacccctgcctttttttgttttccatttgcttggtacatcttcctccatccctttattttgagcctatgtgtgtctctgcacgtgagatgggtttcctgaatacagcacactgatgggtcttgactctttatccaatttgccagtctgtgtcttttaattggagcatttagcccatttatatttaaggttaatattgtatgtgtgaatttgatcctgtcattatgatgttagctggctattttgctcattagttgatgcagtttcttcctagcattgatggtctttacaatttggcatgtttttgcagtggctggtactggttgttcctttccatgttcattgcttccttcaggagctcttgtaaggcaggcctgatggtgacaaaatctctcagcatttgcttgtctgtaaaggattttatttctccttcacttatgaagcttagtttggctggatatgaaattctgggttgaaaattcttttctttaagaatgttaaatattggcccccactctcttctggcttgtagagtttctgccgagagatccgctgttagtctgatgggcttccctttgtgggtaaccccacctttctctctggctgcccttaacgttttttccttcatttcatctttggtgaatctgacaattatgtgtcttgtagttgctcttctcgaggagtatctttgtggcattctctgtatttcctgaatttgaatgttggtctgctttgctaggttggggaagttctcctggatgatatcctgcagactgttttccaacttggttccattctccccgtcactttcaggtacaccaatcagacgtagatttggtcttttcacatagtcccatatttcttggaggctttgttcgtttctttttattcttttttctctaaacttctcttctcgcttcatttcattcatttgatcttcagtcactgataccctttcttccagttgatcaaatcggctagtgaagcttgtgcatttgtcacgtagttctcatgccatggtattcagctccatcaggtcctttaaggacttctttgcattggttattctagttagccatttgtttaatcatttttcaaggtttttagcttctttgcaatgggttcgaacttcctcctttagttcggagaagtttgatcatctgaagccttcttctctcaactcgtcaaagtcgttctctgtccagctttgttccgttgctggtgaggagctgcgttcctttgcaggaggagaggtgctctgatttttagaattttcaatttttctattctgttttttccccatctttgtggttttatctacctttggtctttgatgatggtgacatatggggttttggtgtggatgtcctttctgtttgttagttttccttttaacattcaggaccctcagctgcaggtctgttggagtttgctggaggtctgctccagaccctgtttgcctgggtatcagcagcggaggctgcagaacagtggatattggtgaacagcaaatgttgctgtctgatcgttcctctggaggttttgtctcagaggggtacccagctgtgtgaggtgtcagtctgcccctactggggggtgcctcccagataggctactcaggggtcagcaacccacttgaggaagcagtctgtccgttctcagatctcaaagtccatgctgggagaaccactactctcttcaaagctgtcagacagggacatttaggtctgcagaggtttctactgccttttgttcggctatgccctgcccccagaggtggagtctacagaggcaggcaggcctccttgagctgcggtgggcttcacccagttcaagcttcctggctgctttgtttaccttctcaagcctcagcaatggggaacacccctcccccagcctcactgctgccttgcagtttgatctcaggctgctgggctagcaatgagcgaggctctgtgggcgtgggaccctctgagccaggcgcaggatataatctcctggtgtgccgtttgctaagaccactggaaaagcacaatattagggtgggagtgaccggattttccaggtgccgtctgtcacagctttgcttggctatgaaagggaattccctgaccccttgcacttcccaggtgaggcgatgcctcgccctgcttcagctcacgctcagtgcactgcacccactgtcctgtacccactgtctgacactccccagtgagatgaacctggtacctcagttggaaatgcagaaatcactcgtcttctgtgtcgctcacactgggagctgtagactggagctgttcctattctgccatgttggaactgcctcaaatctcattttaacattctattgtttttattactctaatgtttcatctactcacttctataagatcaaaatgtctggaacttctcaagcaaatattcttgtgtgatttttttttttttttttttttttttgagatggagtttcgctctgtcgcccaggctggagtgcagtggcgccatctcgactcactgcaagctccgcctcccgggttcacaccattctcctgcctcagcctcccatgtagctgggactacaggcgtgcgccaccatgcccggctaatttttgtatttttagtagagacggggtttcaccgtgttagccaggatggtctcgatctcctgacctcatgatccacccgtctcggcctcccaaagtgctgggattacaggcgtgagccaccgcgcccggccgtgtgattttttttaagaggtgatcctacctaattggttagctttcttgagttgctgctaatcataaaattgttatgctatttctatcgggacatggcaaaaatgtgtgagggcctcaggcagccctaaacagaggcatttctcagacctctgtgtatgatggtttgtaaaactttaaaattcaactaatactttgagcaataaagcttaccaatgtgttatctgaaagcctcccaaaggtcaaattttagtttttaactttcaaaattcttaccaatgttgaaattggaacattctgagccaattattccatactcctaattggacattcctaactcatggttaggatagatattaatctttgttataaaaataaagtaacatttaactcacagagatgtttttaggttaagactattagcttccataggtagtttccaaacaaagaagtcagaaattgtgatgactcttaaagtggattaaataaaacaaataacagaacagtggaagcatgcagtaggtactcagtattggatagatcccttcttttcctttctggtggattgtgtacctcaggagaacagaatttgacaccaccaattttaatcaaaagtgaagatttgcatatatattcctccaaaatggaatttccaataaaataatgaaatgtaaaataatacattgttaaatcattgcaaactgtaggttgtgttgataaattatatatattggcattggcacataaaaactttgaaatgtctatatctaggtagcatcagatttttcagcttctttacccagtagtaataatttaaagtgagtaatttatcatttgccaatcttctctactgaaactgtatttttactaaagcagttatgtgtttttgtgtctgttatcactggctttcaacagaaagattaatttcttttttacttctgctcagattagacaaattgaaattaaacattgttaagatgcttaaagacattctatgaggagcagggacattgctaatgatcatgctattaattgtgaagaaatatgctgattcattttggttttgttcacggaactaaacaaactgcactcaaagaattaacttggattaactaaaaacttattttaaagtaaaatactacaaattttgttataatgaatacattgtgtatgtattcattgccgtattggtggtgactatagaaaatggataatttactattcataattaaatctactaaacgtttttcagatttcataaagggtaacataatataaaggactaacaggaaggaaaatgtcacaatcccacctaagaaatgatcttttggtctatttcataagacatttgctaatttaaggtagtctgcatagtatttcaaccaaattagtagaattaatagagttgttagactgaacattttagtgttgacctttatcaaaattgcgtctgaccctacagattttcatttcaatactaattttgtgaaaatgtataagaaatcaattgaatttaagctttcaaattaaataagccttatttaatttagtccatgtcagatttttaaaagggagtattctagacataaaatttataacttcattaaagcattaacttattttgccttctgaacaatttatttacaggagaactaaaggaaaggttttcaaaattaagtgaccaccaggccactggaaacatttgtcaatatgaaggattattctgatttccaaatcacagttccaatatttctcatttatgaaggttcacctataaagaagatctaaaagaggtcaagtaatgaaacttgtatatgattgtgagacagcttccgttcttctatagtattgacatatgttggagtgtgctaagtgaatcgaaggatgctcacactttcctaggactataagtcatctttatgtattttttcatttttttaaaccacataccatgaataagaaatctttttgatttttataattttatgatgtcaaagggaatccccactatccaattagaaaaaagaactttttataaacaaaacaaaattgaaaggacatttgtacagaaaatacttaagtgcaaacaaaagtgcagccaatatcaatgtagtataaggagtgcataatttgaggtacaaaatatagatgtgagggctgacaaattatatcaatactctgagacttcaatattctttctttttttatgtaaaatggagatactacaaaaaaagatcagccccagcctatcttctccttttaaaattcctcacacaagtaaaattctggtgtctaaatcatgactggacgaatccaaagaaatcagaaaattatcaagacaccagctaatttcttcacaaggtagcacaagtatgaagctaataaaaagtcatgtaacaattattgatacagatatagccatctaaccttcaaatagacctataaaaagttaacttttatacaatgaataacacatctacttaatactcaaaatattgcccctacctttccatcccttctaattttgagtcatttatttggtttagtatcttacatctctctaaaaacagcttagaaaacaaaaacttccataagacaaggaagtaagatatagtaagtgattattaaatacttacttaatatttaataagtaagtgcttgcatatagaaaatcatgaaaaaggcccaaagtaatagtttctggtgccaaagagaaggaaatagattaaccccagatacagggtacaatctcagaaagacaagctctagtggtacattaaaaaatgcatggaacctttatggtttggaggttattttaaatgactttatactttttgaattaaaataagtatatttggggcacctgttataacaaaacacaatgtcaggtgcaaggaactgaaagacatattcagtattatgtctgcctgcatgtatgattactgatgccataattgtcattaattcaaaattccaaaagcaagaaacagaagtgtaggatgttgaatgcttctgcttagaagtggtattgaaaccattgaaaaaccacgacagaaattaaaagaatttcatgtgcacagcagacctgctcctgttttatgataatgcaaattagatgacttctgattcctgtgtgtgcaaatgaattttcgtttgtggcgtattagttatctttgtagcaacaaagcatagctgtaagaatggtaaccattctcttctaaaaatatgaactgaaaatatgccaatgagtaaaatttagaacttgggaatactgtttcaaatattatgagcatttgtaaaggcttttaaataaaattagaatcaattgtaatcagtaatctcattttgtctttaaagcagccctctccgtgagctaagttatgtttgctttataatgaagagtcagagaagcttgttaaagattgcagagccagtcagtggtctaaaggggattcagcacttgtcaggaagcctatgagatgatttttaccacagtattttctagactattataatgattgaagtgactcatttttttcaggggatatctgttggattaggaagcctctccaatgcccagtcctgaccagcatagctctggtcacttatcttgtcttgaataagagctcctggtgggtccagccaggctctgcagattctgtggattcagcttgccctctaaatttgtggtgccacattgtaacaatcgtatatcccttccagtgctcctgagcattggatacacacacatacacatgtatgaaatatttggaaaatgcaattcctacatttttggtttaaaataaaacaaataggaaataggaatgtaaactctaatattttctgcccacaacccaacgatatgtttgttattcatacattatgttttagagaaccctgctctgtccagcgagcttgctcatagttaagctcacctggctcaattgctttggtttatcctagagacttttgtaatatttcctcaaagccagtaatgctataataataggtagttcactttttgtttacatttatgattgtaaatgtctctcatttatgaagtattgatttgctggctgatatcaaaataaaatttatttatagaaaattttgcattcatttctttttaattaatacaattagcatttgtgcaaggaaaacatgcctcagtgaagtgactttcaaatgtctaatgtctttgttcgttttatgccgctattataattctttagcatagtgtgtcttctggacctagacaaagccttttctgtattgatctttggtaaaattcttttctgagattatttaagatgtgactaaggacacatttatctgcttgcagcttctaggtaataactttctggaattagtttatattttaaaaaatagatgtacatttttttttcactagaagagattgtgaccttagtattaaagccaaccaaagttttgacttctgaactaattgcttaggttccttgcccaggcccagtcaaagaatctttatgctgctcttgccatttgacctgccctctacttctgacagtttctgatatgtgtcttactgctctcctcccctgacttcttctccacctgagctttgctggttgcttgttgattggtttatctactgatatggtttggctgtgtcctcacccaaatctcatcttgaattgtagctcccataattcctatgcattgtgggagggacctagagggagataattaaatcatgggggcagtttccctcatacctctctcatggtaatgaataagtctcatgagatctgatggttttataagggttttcctctttctcttggccctcattctctcattctccccatggccatctaagacatgtcttttgcctccactgtgattgtgaggtctccttagccatgtggaactgtgagtccattaaacctttttttctttgtaaattacccagtcttgagtatgtctttatcagcagtgtgaaaatggactaatgtatctactctttggctttacactccagctctggcctgccccctgaagggtaattggttgtttctcggcagcccaccctcatctctgttgaagtttcaggaactgccctggctcttatggtgccaactgctgccacttcgacttctggcttcttagtacacatgggtctagcttgctgccatagctgacatccaccttaggctttctaccgcccgcagagctcttggttcctagtcctttttgtgaatccaaaactactagcccaacacaaaatttccattatccagatgaccctttcttcagatagttccactacgagatttgggttcttctgacgacagacccagttttcaaaatgaccttcttttcctgctttgattttgaactgatctaattaggaaaatttcgtcctaaaaatgcagtcctttaaaacaaattacattctctttctctccgaataacaaattgtatcagcattttccaagatgtatcctgaaaatcactactcccataaggtaagcagtaattccaaaaaaaaaatggttctgggctgaaatacattttgtaaattctatatcctcttttatgttcttaatttctcacatgcatattaacatagtaaagactcttaagagtcctgtaggaaagggagttgtttaactctttttagttgatgattttctaacttatttttcatggagtgctttttaacatggatgcagctggaaaccatcattctcagcaaactaacacaggaacaggaaaccaaacaccgcatattctcactcataagtgggatttaaacaatgagaacacatggacacagggagggggacatcacacacaggggcctgtcgaggggtggggtcaaggagagggatagcattaggacaaatacctaacacatgtggggcttaaaacctagatgacgggttgataggtgcagcgaactaccctggcacatgtatccctatgttacaaacctgcacattctgcacatgtatcccagaacttaaagtaaaataaaaaataaaaataaaaataactaccctaatatcctataggaaccgctttggaatatcatgtaataattaaattgtatttctatagcactttgttgttttcaaagggcttttctattttttttactgtatctttctaataatatgtgtacatatgtatacacatgtataatgtgtacatattatttgtataaattaccctgtctcaaaacatgaaaaatacaatttgctgacattacatgacttaatcctgcaaatggcagaacttgacccaaaaatccagtttctcccttttctgttgagttccattttttcatggctgcctgtggctgacatcacatagaatgtggtttaaccttaacagcctttttttgcatcaacatgattttttcagtacagcacaatatatacaacatatgtgtatccgcaaacttggttttccagttcactgcgtgcctctgttcctacttcatataacaaacaatttcatcaattttttgttcatatctgtgtaaaccaagcatttgaaattatctaaatgaatccaaagcattgttatcaatttcatcttcagaatggtgcacataagctaaagttaacccagatatacctgaggaatagtcgacccctgtcatgaataaaatgagtcatatgcatggaccactctaagcaaggaaagtaacaagtgaacacttttactttctgagaaacagttcctcaaagaagtttacaacagtacacaaatacttatttgtcactcaagttgtaaaaattttgtcccgtttcttaaactgcatttaactttctttaaaactgttttctcttgcttaaaatgacagaggatcatcgctactacttgtctttatgttaactttagtttgtccttctgcagatattcacatgctttggttttgcctcctctgtgttcatttctatgttcatttctctatgttaataagtaaatttctgtctgctggttccaatgaaaggttctgacatacattaaactttaatgtagaatacatattaggatattcaccgttttaaaatgggacaccaaacataagcagtagacattttgtaggctttcccacgtgttgagtaataggaactctgctatgaaagcatcattattttttgcgttacagattttcctcatttaacaagccatactataggctctttgaataacaagatttctgtatccaatatattttctcctctcatgctttgtgtcctctaaataaaaaaaatttaaaggaagcaggggtgtgcctgtttacttttactcagtagaataggttcaattaaaaaaatagtgtcaggccaggagcagtggctcatgcctgtaatccgaacactttgagaggccgaggcaggcagatcacctgaagtcaggagttcaagaccagcctggccaatgtggtgaaaccccatgtctactaaaaatacaaaaattaaccaggcatggtggcgggcacctgtaatctcaactactcggggggctgaggcaggagaatcacttgaacccagaaggcagaggttgcagtgagccgagatcaagccactgcactgaagcctgggcgacaaataagactccgtctcaaaaaaaaaaaaatttccatttgcactattttttaatgctattgaaaatgataagaaggtttttgtacaaggttacccatcataagaaaaaaaagcaaagtgatatttatagccattattaattacattattaatttctatttttatgataccttgtcctatagttttaaaataaaatatggaacaaaatttgatagcagttacattcagggttgtattatcattatggcattgggtgtatatgattactattgctattctatatgcaacataattagcaaaaccaaatgtggttaagagggtttaaggtaaatgagtggaacaactattatttgagttaaactctgagtcacttttcaccccattcttaacatcctaccacctattaaaggttcaatctttgtttatttcatgaaaaagcactgtagggttttaatccccaaagctgtaggatttgatggccctttgttaaataccacaggacccatctgttctgttaggcatatgccttacgatgtgggaaaatctgtaatacacggtaatgaatccaaagtcctttagactgcaacactaaattttatatatatctatatatatatataggtagagatatacacaaatataagtatataagtatatacatataagtatatatgtaagtatatgtatatgtgtgtgtgcatatatatgtgtgtatatacatatatacatatatagtatatacatatatatactatatatgtatatatatatgcacacacacacattttctacaagctgtcttaaagctctgtaatgagaaatagggaaaattctaaaaataaagcagctttaaagatctcagtgggaaaaagcacaccaccagctgcctgtatcttcttacatgttggtgtcaaagtcattttctcaaagcatggtttggagacctcctgcatcagaatcagctggtggcatgggctggctgaaaacggagattcttaaattttatccccagagattctgatgttattaggtctgtgttgggcatagaaatgtgcatttttggacaaatatatttgggttcttgtgcaaggtgatgttcaagaaaaaaggaattggatatttattatttgaaacatgttcgtttaaaggcaacctcttggtttgttttgtgttttttttttttattttgagacattgttttgctctgtctcccaggctggagtgtagtggcacaatcctgcctcactgcaaaccccacttcccggactcaagcgatcctcctacctcagactcccaggtagctggggccacaggcacacaccaccaaggttggctaatttttgtatttttgtagagatagggttttgccatgttgcccaggctggtctcgaactcttgagctcaagcgatccatcggccttggcctcccaaagtgttgggattacaggcgtgagccgctgtgcctggcctgaagtcccattctaatgggacttacttagatatactgacttttgaagattacttaagcattaatctaattgcaatttaagattaaagtatcaggacactccaaattaaagaaattctgtggtaccagtatccaaaggataaaaattccagcttatattgatcttttattaaatgaataaatccaacaacaaatctttaatttctcttatctctgtaggaaataaagtgtattaaacatccatatatagaatcaaatctaaaatttatgagaaagaagatctgttttcgtatctgtaatttaagtgttctctggctagaatatatatatatataattatatatctatatataccctttatatatataattaaattatgaaatttaaatcaatttttttattttgccctttgatatatgtaacacaataacagatattctgaacaatgaccatgaggtattaccaatttctgaagtaccatttgaagagagaaaatatgatcagtgaagatggaatattaagtttactgttgctgtctgttaaagaggccttgggtaaagtaagtgcatgatgcacgttaatatggtgttgaatactattttcaagagttatcaatctatgtgcaatttgtaggattttgaattcactgatacatttcataggagacagtatctgaagtggttagagtgttaaactctataacaggaccttctgggttcaaaccccttctctgccactagttgcatgacaatgggcaaatccatctgttactatctcaatattcttatttgctaaataggaataatagtacctattttatagggttgtgtaaataaattagcatttataaagtgcttaaaggataactgatatgaaaatgttagctattattttattgattagaatgactaagttccctgtaaaactgtatatagcatttgctttaagactaccagataaaaatacagttaaacttagttaaatttaaatttattataaatggtgaatattttattttattttattttattattattatactttaagttttagggtacatgtgcacaatgtgcaggtttgtgcttactaaatattacatgggatgtacttatacttttaaaaaatgtagtttatctgaaattcaaagttgatagacatttcttgttttattttgccaaattcagcaatcctattttcacttcatctcatttgctttcatttccctggtacatttaattgatctaagttatgatgctgatataatgatgattttcggtcaatagataatgattttagcagactgctcatctgtaattgttttgcattgtgcctctattcctggtgaatagatactgaaaagtctaatagtttattaactttcaagcaaatatgcttaaattgacttccacatcaaaagttttaatctctatttcgttctggtggtaaagatgctattttgtattctggctctcctgtgtttagtggattgctgggaatcagatgaatcctttggatccacagataaattcaggtgatcaactcagtagcctttattatataggaactcagcataatattttctatttggggaatgggttaaagttaccaggaatgcccctgaatgactctaaatgacatttgggatcttttgtctacagtttgtagaaattgtcactggatggcatttaaaatcctcaaagctgtttttagctcaatggattcatataattaaaaaaaaaaaacacagtctttaggatttgaactcaaatcttaatccccatagctactacctatgtgaaattgggaatagcattttacccctgggcaacaatttcttcatctgagaaatatagtaaatgcccattccagagggctgttgaaaggctgaatggtatcaggcctataaaatatgctgcatgtgcctggaaggatgttaagtgccatgtgagttattttccctgcctctttcttagcattaacatagaaactagagattagtagtactggagccaagttttatccaaaatcatgtggctctgttattttaaatcaaaagacaaataagaaaacaggacactttgtgtccctagctttgaatctgattattttgtatattccaaaaaacacctagacccctggatttttccacagcagctctacttaactatcagtgaaaaacgctgggacatcccaccaccaacaacagcaccccttatgagattatccattgttttaaaagcccagctttccttcttttgaaaggtactcccttgggggagctatcctggtctaacaaggtatttgtaatggatgcaaatacatagtcaggcatctgctggccacagctgagctcttcagtgaagagtccagaagttccatgtaaaaaggatttaagaagtacatcttgtcggaattgtcttggagaaggtagaggcagaggtaggacatattcctttaagctgtgtttgtagagcaagcacaccataatttatgacaaaatgatcatttagagaggctttgtgggaaatagaagtagggaccaagaactcccagctccctattacttggagtctacatttggaacacaggtgggaaattgggagataggctgggtgcagactggccctgacctaccgcgtaaggagagccactcaggagcatgaaatggagaagagaattccatagcctggcatgctggcacacacctgtgatcccagctgtgtaggaggctgaagcacgagaattgcttgaacccgggaggcagagtttgcagtgagctgagatcatgccactgcactccagcctgagtgacctgagtgacagagtgagaccctgtctcaaaaaaaaaaaaaaaaaaaaaaacaagaaagaaagaaaagaaaagagaatcccagcaccttttgctgtttctaagctcactgctcacattaatggacaacttttaatccatctgtcagatcatacaaatcaacaagaggcagagaatgacaaataattttttttaattcatggtgaaagactttgttttagaaaagtctatccactatttggtgattgttttgtttgttcagccatggaagtttacagaaacataaccatggaattacagtgttcttcccgttattcaactcttaggggaaaaaatgcaacaggaaaatacagcatttaacagtgtttgcttataaataacgtcattaattaaaatgctaataagatttaaatatggaaagtataaaatctctttaggaagttttattctttgtttttttaaaaaatatactgaaatctgtttatatatcacataaatatattaactttccaggtggtttttaaaaatgggtcgaataaatgcaaaacatattagagaaatctattttattttgtagtattttctttatgatttgaaaacagtttacctacttttttatgtctccaaaataaagtagaagcaattttctaaccaaagatgagtaaatcaaacttactattttttctgctggtaaacaaaatgtgcatagaactacaaagaaaatggggagatcagcaatagcattaaagttaccaattaatgctttttaggacacagctttatttaggaactttcaggtccaatcatagtagctgagtagggagaaagaagggaatatcccagcccaagataatgagtgagtgtgggtcacttcatacccatagggtgcatttgtgcaaaagtgctctttcctctggtgtatcagtgatgctggggcataccttgatgagtgcagcccaggatgcttttcagtcagtctcatcctctcagctgggtacccttatgcaaacagaacccatacagccttgcagcgcagccctgaagttacctcttgtgaggccctggcagttgggaagtggagcacagtaaatgcctcctgcttcacatttagcttgatctgtttttgaatgagatggagctcactcagaggagctgaggaaaacaaaatcttcttggccaaccctgtcaccttctctgtccaaaacattgatcttttacttgacaagcagaaagtaaacataggaaagagaaaaatgcagtttaatacgaatacagtgactattaaaactcagcagctctaaatgagaacagttctctcacagagctaaggttttacaattttgcaattgtattgtgctagaatccctcaagtccctagtgacttgttgaatcacctctatatcaatgctcaatgcgggacttcttaaaattcccacctgcttgaggtttgttggcagaggcgacaaggtactactgggcttcaacaaaatgtcttaaaatatgctgtttagaaaggtttgactttgctgtttagaaaggttcaactttgtcactaacttattgtaagccctcgggcaaaagatctgtcttttctggagcacaattttcttattttcaaagtgaaaaggatgtcacacaaatggaaacaaatatgactgtctttcttattgatacttgccaggaatccagagaaggagagtatggtgtctacagttgtgcattaagaccttaaatcttattaagatctaatctagatacagtgcagaataatccttcatagtgagaagcactgaatctgcccatacctgccccaagaaccggacatgccatgttccctgttgccatccctagaagagacaggtctcctggatgttcagcatcattacacatcatcattcaggttactcaggagggaatggcacaaatagtggtcattggttctgatttcaatgattttgttacactatcctatgagatttttaaccaaacttgcacgtttgcaatataactcagtatcacttaccactcatgcaacagatgtttatcacatgaattctaggactagattctggtgtccagaaatgaagacagaagaatagtttcctgcccttaaaaagtttatagccaataaacacagagctataaacaagaaataaaattaaaatgtgtatactggtaaattagaagacttacttagaacataaaccagagatctggtctgagaattcagaaagatatactgagaaaggatatttgagcagaaacctaaaatatgatcaggacttagttgtgtctacaagtaggaataggaagattgagttaaaaaataagttccagaaagaacttatgtgaagtccaagaagtaaaagaaagtataatatgtttgagaaactgaaagaagtttagtttcttacaatttgataggaacttttgttacattaacccacatactccgcataccattttaaataaagtgattgcataatagtaaaatgaaatgtagaatattaatacaatagttataccaatgagtgaccccatttcaagaaatattcacataactatttacaatggattaaatgaatctaattttaagggatcaccattatttttaaaactgtaactggttttattgcttaatccactagctaaaaaagtttaaaatacattatttaatattaaaactgaaaagtttgtgcaataagaattggaaagaagggaaatgaaattatgatcctaccatgagaaaactgaattaatcagcaggatctttgctaagatttagtcattataatgacataaggatgaactttgctccctggtaccgctaaagttgcatcaagtctagaataaaaagctttattcatatatatatatactccaatgaattatttttactaggactaatactagtgagaattctgatgtggaattcagtttaatcattcccaaagtcgtattagcttgaaaaacattctaagtttttaatctcaattttaaaaaaacatcagtatggtcttacagtctatgacaaaaaatgtcccagaaaaatttatttaagataaatcatcataaaatttgtcttctaaaagtccaaatactagaagaaatgtactcacttaggcctacaggatttataccgtgagactcgatatcagtgacatggccagcctggcttagactagagaaaacgtatctcccaggggtgaggaggtaaaataccaaactagatccaaattactgcaattcaaatttctagctctgcattttactatccttattagctggatctatgaattcaccatcccaggactcctcatcttaaaaaatggagccaacattacctcaagggattattgtagaactgaaataagatggcatctatgaaaggtgtaaccatactgctaggctcataaccaatgaatgaacaccctcccttgtctttttccccacttggatatggtaggtaaaattatagcaagggccattctaagatgggtcgaagacagatttgttttttgcagtgtctactatgtagagttgactgtgatatagtgattattttcatgactacactgaaggaagcctagcctactgttgcataaagtttccattattctagaataacctcatcactaattcccacctaaaatgtggacaaaataaaaaaaaatcacacacagcatatccttcagtctttgagaaaaatcaaagcttagtttaattttttaaataaaaactgtggaatgagaaaggagtggcattcttttctcaatgaaatgattgcatctaattttgttgtgtgcatctgtgtttgtgtttaatggcaagtgtaattatgcacctgcaatgtgtggctcttctaattttagtaaaattgatgcaactatttaggaaatacatgacaaattactcttttaaaatgagtaaatttgaatgccaaagcctttttatctaccaaaattttggtcttctaattacatgcagtagctacacacagatattatgtccaccagttcaatctggagtttttcctgtgagctcagaatcttgccctgctttgtcctggattgatcacagccactggccagctagtgccccctattccctccctgaagagtttcctatctttgttgtctaactgtcatattaaagtgtaacgtcacatacaactcagagtccagatcactaacttaatatatcccacagagtgtaactatcaggtgatagctggcagctcacagagaagtgtgccagaactccagaaacacaccagattctttgaatttcttttccaaatcttttcttttttccattttttttttttttttttttttagagacaatgtctggctctgtcgcccaggttggagtacaatggcaggatcttggctcactgcaacctccgcctcctgggtccagaccatcctcccacctcaacctcacaagtagctgggactacaggcgtgtgccaccacacccagctaattttattgttcttttaggtagagacggggttttgtcatgctggtcttgaactcctgagctcaagcaatctgcctgccttggcctcccaaaatgctgggattacaggcatgagccactatgcctggcctagtattttaatatctttgaattctatgtgtcttgtagattgtctagaacaattttgaagttacgttagaaaaaaaatttaagtatggcaaagatgaagaaaataaattactaatcctcagtggtcaagtgatttgatttctcatgtgtaaagttattttcttgatcaggaaataatcaagttgaaattaatgaccaaactagcaagaggcagagccatgcaacatggaagtagtagagaaagcataggagttaggagttgtcatctccagagaagcatcctacactggaatagtggatcagagaagcaaattatgtaaagcagagagtctgaaggacaacttggaaattccttgatgggtatacctgttgggctgacagccagaagacttgaaaatacggcctttgaaaccaacagaggggccattcaaacgtgaggaccctgaagctctaccatgccttggtgagcatgcccaaggccaaacttcttggaagtccctgagcactgttggatgttacatttgcacatcttctcaaccactctctggtcatatagagcatatttcaaaatattttatttttgatgggagaaacataacagcatattggcaaatattgccaaatattggtagcaaatgatatcatgtataattctgaaagtgtaaggcatactttaaaaagtcccattagtaatcaccatatcacaaagtagcagtggccaaaggtcatgttaatattattttttctgtttcttcagattttcctggatgtttcagaacagtgcttgaaaatgaaagcttttcttccaaactattattggcattaacaaaattttgctatgtctacataagctgtgtgactcataaattaaggcaaatatttaaaaaccctgacaggaaacttagtttatttaaaaaaaaagaatgtgatgattcaaattcatcttatatttgctctgtatgccagttcactaatttaagatctaattttcctatttcacctattggaacctatttttcatgcagaactctcaagtaactcagaaataccagttgtcaaataagatttaatagttctattttatgaatagttttaattttaaaatgagcactaacattaaacttagtatgtggttttatgatttagctgtttggatttttaaggaaatgccacatatgttttaaagaccaagcaagttttaaaggttatgccagtggattacaagaattgccattctaattatgttcaatatggaagagaatgttaattgatcttactggagtgatcctcttaaaggttttgggtttaattaaacagagttgtgtttaattcatttcagataaaactttatttttaattaaatggggaatggcatttagctatcttacctgaattcttttctgagaaactcttccataagaaaatgaaaacactgattttgtcctgtctcgagaacaagtatgcttttcaaatactacttttgtgcttctcttcattatggctcatggagccttcaacgagattctgtggtaacatatccagcatattggaaattacactgaaatccctctgtattatttcaagttattaaaaaagcttttgtgtcatttttagttagagcttgtctggtgtctttgtcagtttgggctgctataacaaaaatactacagactgggtgacttaaaaaaaggaaatttacttttcactcttctagatcctggaaaacctgagatcagagtgccagcatggtagggttctggtgaggacactcttcgtggttcctagatgaccatcttcttgatgtgtcctcacatggtagacagcagagaaagaggaacctctcgtgtctcttcttgcatggataccagttccattcatgaagactccacattcatgaccgaattaccttccaaagaaaactaagcatttagtccttaacatctggtgataagtgttgcatgggtagatttaccaactaagtcacagccacaaaaatgtatccaaaatttgtctgaaaatacaattttctaaagtaaaaaattattatccatctttttgaatttagcaaaatttcttaatgccaaaacatccagtcaaagcttgaaaaatatgtcaaacaattacttatttcatattttaaaaaatcagcttagtgtattactatttgttactgttatgggctgaattgtgtcgccccaaaatttatatatttaagtcctaaccccaactatctcagaatgtgattatatttggagatagcatctttaaataggtaattggggtaaaatgatgtcataaggttaagcccaagtctaatatgaccagtgtccttaaaagaagaggagattaggacacagacacccacacaggaaagaccatgtgaagacatggagagaagatggccattcacaagccagtaacaggcctgaaaagaaaccaaccttggcaacaccttgatcttggactaccagcctccatccagcactgtgagaaaaaaaaatgttgtttttttaagccaaggagttggtggcactttgttatggcagccctagcacactagtacaatgactgactctagtcaagcatacagaagtgtactgaagccagaagacgtgggagaatctgaaaacggtcaaggttgtgtgagaagttgagaggaaggcagtcaggaggtgtaggctaacaccactcactaggctgtgattgcttcccagcccttaggtcccctgtgagtctgctattatagaattcagaattgatactaggataccaattctgaaaatgtatagcattgcagcataatctgtcagttactttaagatacacatttaaattagtatgtttgaaattcttctatattatgacagtataaatacagccctaggaataaacagaaattcagtatacatgttcttgtgcgattttttcatatcccaactgtatcttggaaaattgctttgcttagtagacaagacatttttagaataactcctgatgcatttactccttaaggaacaccatttaacctcatgtttaacgtttgtgaagtaaaggttacaaggttgaacatgaaaaaaatgtagatcaatgctttgatctttctgagaaacgtaattaatttttaaagaacttatgttttagatacacaaagatatgtgtaattataaagtgtgctacataggagatttaaaaaccacttctgaactaaaagtgcacaaataaacacaaaagaaaaacaaaagtatctttgtaccataactagtgttgcactgcatttatctttttgtctgaaaattacatcattgttttagaaagggacttttaggtcattcaaatccgagtaagtcctgatgtttggagtcatttaagcatgacctttagagatatatgatcatcgagcctgtacccagataatttcaatcagataactccattcattgctggattattctaattattagatttatcttccttaaacaaagtttttctgagtttcttgccactttcttgtacttgcatttgaaatagaatatggtatcattagcaaacttatttatctttccctgggtgcaattttttaaatagatcttttaaagtgttgtctccagaattgtatacaatgctccataaatgttctaatcattttgagtagagtgccctgtgaggatgtccctgcctctgacttgtagatacagactttaattaatgcagcctgccataatagaagtttttcttgctgttatttcagtattatccgcttaatcttaacccttttgagggttaaatttctcaaagtgaacgtataacttagccttatgaaagtttaatactccctttgataaaagcattgagggaattttcatttttatgcttttatttctattatttttcatgaaaggtaaatatgtatatatctacacttaggacttcaatatggatggattgtattagttctttttcacactgctgataaagacatactcaagactgagcaatttacaaaataaagaggtttaatggacttagagttccacatggctggggaggcctcacaatcgttgcggaaggcaaggaggagcaagtcatgttttacatggatggcagcaggcaaagagagagaacttgtgcagaggaactcctctttatttgttttgttttgttttgttttgtttgtgagatggagtatccctctgtcccccaggctggagtgcagtggcgcaattggctcactgcaaactccacctcccaggttcatgccattctcttgcttcagcctccagagtagctgggactacaggcacctgccaccacacctggctaattttttgtatttttagtagagatggggtttcaccatgttagccaggatggtctcgatctcctgacctcgtgatccacctgcctcagcctcccaaagtgctgggattacaggcatgagccaccacatccagctggaactcctcttcttgtgagatttattcactgtcatgagaacaacacgggaaagacttgcccccatgattcaattacctcccaccaggtccctcccacaacacgtgggaattcaagatgaaatttgggtggggacacagccaaaccatatcatgaatcttattcaagtttgagattgtacaaagcaatattatatatactagtatatctatgtatatatatatatttaagactccgtgtttacatgaatatatacatgtgtgtgactgtatattttacacacatatacatacatatatgtgtttgtatgtttagattatcagaaaactttggactttttttgaagtttaaacattttctaataaagtatccattgattatgtcacgtgtgtgtgtgtctgtgtgtatgtgtgtataatttcacttaattttcagaatagtcttagataaagtaaattttttgaaactgagggtcagataaagagcttgctcaaggccatatgactaacgtatggtagaatcaagacttaagtttacatgtctgattctaaatcatattgccttttcaataataactcactacgtttcctgaaagcaagatttaggaaccattggaagattttaagtcaaagggtgacatggttagatttgcaatccagaatgattaatctggctactatgtgaagaatggacttggaggatggagacactagacaggaagaccagttaggaaaatactataaaggcagacgggaaataataagcccctgagtaaagcaaggaaagtaggaataggcaggaaaaaaatgggggagggaattacatgataaaattgatagtcctgcatggatagtagtgtatgaggccgattattacatttcacaatgcagtcaccaaaaaaagaaatcttaatttaggaaaaaacgtggaggattattcttgggacactggagttcatataaaatatggtagtagaaatgcccaggagtcagtcttaagtgaattcagtgttgtccacagttcaggaaagagtagacaaatactttgaggaaaggttaaattcctcagagacaacatacagcatggaaacaagaggcccaagggtcaggggcaccaatattacaaagtgtcttcaggatccaccctttttatttcacttcagattttcttttttgagttcagactcatattgcctctgcaatatcatttatactaattacactatcagttttttaccacttccctctctcatcccactccctgctgtctatcctgtataataagcacttcgctaccagatcaattctcactgatcagcatgctcagattccccttcaaagtgtccctattttcccaaatttacatttcaaggctatctcataagaattttacacttaataaaataaaataaaataaaataaaataaaaatggatggtgtcccataaaaagcactagacatttccatctccatctttgaactatgctataccttccagaagggatgccaactagtacatgaaaactatctagaaacacagataggaccaagcttcccttctctgaattcttacagcatatgtttgaagactgctgtgtttgtaatctctctctgcaactcaaatgttttgaacacttgtgatgcaccacagattcttacagggggataaacatgaatgagatatagattacccttttggggcttatacttcagtagtattttaacttgtagacactcttatagtaagcgacacatgctgttctccatggtaatgtctttatattgtatataacatagctaatgtaatctagcttgagctcaaaggacaccagagctaaagcaagatatgtccctttatatttacttatttctttgtttattgagacagggtctcagcccaccacccaggctggagtgcagtggcaccaccacaacttactgtagattctgcctcttgggctcaggtgatcctcccacctcagcctcccaagcagctcagagtacaggcgcatgtcaccatacctggctaattttttgtattttttatttttttaagtagagacgggttttgccatgttgccaggctggtctcaaactcctgggctcaagtgatcagcctgccttggtttcccaaagtgctggacaagatacattcttacatgagacattttgagcctaatgaagataaggcgtggtttttctgtttaagaacttagtagatgatgtatcaaaatagttgcagctatttaaatgatttgaagcagattttatttagttcacggtgaaaattacagttggaaataatcaagtgaaaataagattggctttgactaaatccagagatagcaaaattttgtactgactgaatattaaaagaataatcaaatattttgaaaaaagttagacctaataaatttaatccaagaaaattgaacttggtagaaatgcccacaagaaaaatgcagaggcagaaggttaaatagtaaaactccatgaaaaaaaatgatgactgaactgaatctctgttgtaaaattgaaacatggaataaataattttatgaagataaaaaagaaagatggaaacaaatattctctgaaaaggaaattgattaaataattaaattggctcagtgctatttgcttcagaaaatgctcttttcataaagcatcaatgttagcataattctaatgaaatagtgagatttaaaatatctgtgggatcaaaacagaaatcttatattctccaacagtggtgtcctacaaaagtcagtgtgcatatgaattacctggacatcttgttaaaatgcagattctgagtcagtacatcctttagtgagatcatcttggatattcctggagtgagaaagaaatccatatattctgcatttctaaccagtccccaggtcatgccaatgctgcccatccagagaccacacgttgagtagcaaggtaacagaattttttttatgaaaccaaatttatgtcatattttttcaggcaagaaacccaaacccaatgagccattgttcagtcccaattaattcctttaagaaaatatgatttgcccatttttagtgatgtggcaaaggctgcaaggaacacactttaaactcactgtggcaaaggcccactcttgtgtgtacatggttttagagtatccctaaaataatatcctatcacatataatcatattacatacaatcatgatgccaaatatttgcctaatacattatgctggcataattgctttcatataatttatctttgattctgttggcaagtgcatgacttcagtagcatgggtgcatagaggtagtactagaagcagagcagtggaccccaacctttttggtaccagggaccaatttagtggaagacaatttttccacagactgggttgggaatagtttcaggatgattcaagtgcattacatttattttgcactatatttttattattattacattgtaatatataatgaaataattatacaactcaccataatatagagtcagtgggagccctgagcttgttttcctgccactagacagttttatctgggggtgatgggagatagtgacagtctgatgatctgctgatctgacaggaggtggagctcaggcggtaatgggagtgatgtggagtggctataaatacagatgaagcttcgctcccttgcctgacattcacatcctgctgttgcaacccaagtcctaacaggccactgaccagtactggttcatggcccaggggttggggacccctggactagaggaaaatgctgtagagaaagaagctgatgtttagagagattgagttgcttagccgaggtcactgcagcaagtcaagtccttcaaggtaaactcatttcaagggatacatttaagggtggggacataatccatttcttgccaacaggacacaaaaatgtctactggagggcttctgggaaaggtttccttgctaaaagtaggagttccaaaagaaaaaaagggagagagagagagatagctcttctttaggtaaatgtcattttgttgaatactaaaggttgagcgttgtcatgttggctcttaatgccccaaattttgtcagtcatcttggaatattgaaggaagctacttagagagataaaagtcaatactcaaaaggtaatagagtgaaaaaaaaaaatagaaagaacttgtgttcttaagggtgctaatgggcccctgaattaagcaaccctagagctaccgtattttgatatttcatgttgtgtgaaatactaattttcactaaatatttgaactattatggactgaggttttcttctacttggaccccaagtcagagattcatgatagaaactcctggattctgattccttgtcagtgccctttctccctactccagcttttaccacgctgcctgccttataccatgtcacccttactgtggggtcaatgacaacaggactaggttttgcacttacacatttataccctgaaacaaacctggggcagggccctatatataatgggtgctcagcaaatagtaattaaatgaattaataaatgattgaaaacttgatgtattactagacagaaggaaagagcaaatgaggcacttgatgctaaaggaagcttattaaaacatttttcttggttgttctaaatgatgtttgattttaagataggctattaacagtaatgtcaaagtaccaggttgtatttaaaaagtgattgaaatttaatgaacaaagaatattttccagaaaataaatacaataacttggagagcgattttctatgaatggtctgcttagtcatagcatgctgcatcaggccaattaagaatgaagtatacttacaaattttgcattgcctctgataaggtttgcctggtataaataccaaagctaatctgtgctgaaataatctctaaatcctagaaattgagttacagtccatcgttaatggctcagagtaagtaaaattttaatgcactacatataaatgaaaacattaaaattaattattcaaatttaatctgcttttcagctttacagaaaggtttgagtttaaattgtgcagtgctattgtgtcatttgaactgtaatcttgcaagtgatttaaatatggaaataattttatgggttttttcattaataatgagataatttgtcattttaccccatgtcagttagtaaatgggtccacagtatacagtgcagaggaaaagtctaataagactaatgggaaccttgatacccagttgtttcttgaaaagaacaaatctcttcagcttcaaatttcaatgcaatctgagtagccaaatgcatttttttcatttacactaagcatgctcttacagggtgggagggacaatacacaagcaaatagcctatacttaaacttttgttcagttttgaaattgttaaattagtagaaacatatatgctaaaatattactcagtagctatactcttgcaaaagacaagttgctataatacattatagggtttcgactaaatttgtgctgtccaatatctatttgttcctcgaaatatataaagttaaattaatttaaagatgtgtcaaaggtaatttgtgtactactctgtacattgtttatgatgtatacatcataagtaattcttacaattaagtagatcttcaaatgcaaagaatgcatttgtcagtcatctcttttttgtttgctttttgtttatattttaaaatatttaattgagaagtaaaaattgtatctattcaagatataccacacgataattccatatatacatgtattttgtaatcattatcataatccagtttagtaacacatccatcatcatcactcgtgttgtacgttagctccccagaacttgtgtcagacacttctttagactcatttttaaataagttattatttttgtctttagttgttttcatttattgatacatagtattttacatatttatggtgtacttgtatttgttacaagcatagaatgaataataatgaagtcatagttttgagttgtccattactttgagtgtttatcatttctatgtgttggtaacaattcaagttctctcttctagctattttgaaatatatagtacattgttgctaactatagtcactgctattgaactttagtatttatttcttctatataactgtatgtactcatttcccaacctctcttcatttctttctcctagcctcacaccttcccaacctctagtatctattattctattactatagtatgttgatgagataaagtattttagatgccatatatgagtgagaacatgtggcaatttatctgtctgtctgtctgtgcctggcttatttcacttgacatcatgacctccagttctatccatgttgctgcaaatgacatgatttcatttgtattatgatcaaatagtattccattagtattccattatgtatactgaaattgtttatcagttctaataattttttggtagagtcttttagttttcctaaatattaaatttgtgtagctgtggcttaatcatatatgacctttactatttcaaggtatggtcttttaatgcctagtttcttgagagtttttattatgaaaggatatgaaattttatcaaatactttctctgcatctattgagattatcatatggtttttgtccatctttctgtttatgtgatgtatcatgttgattgattcacacatcctcattataaatctttgcatccctggtataaatctcacttggttatggtgtattgtatttttgttgtgttattgaatatgttttggtagtattttcttgaggatttttgcatctatattcatcatgaatttgggcctatagttttctttttttattgtgcccttgtttggttttggtatcaggataatactggcctcatagaatgcctcatagaattagttaggaagaatttcctcgtcttcaattatttggaataacttggggaggattggtattagttcttctttatacatttggtagaattaggcaatgatttcatctaatcctgggctttttgttgttgggagactttttattactggttcaatctcactattcattattggtctgtgcaggttttctatttcttctaaattcaatcttggtaggttgtatgtttttaggaatgtatccattttctttaggccttcgagtttgttagcatgtagttgttactagtagtctctggtgatcttttgtatttctgtttagctgacttaggccaaatggacctaacaaacctttacagaacattttagccaacaactgccaaatatacaacgttctcatcagcgcatagaacattcttgatagaccatatgttagcccacaaaacaagtctcaacaaatttttaaaagttgaaattatatcaagtatcttctcaaactacaatggaatgaaactagaaatcaataccaagaggaactttggaaactatatatacatggaaactaaacagtatgctcctgaacaatcattaggtcaatgaagaaattaagatggaaatcaaaacatttcttgaaatagtgaaaatggaaacgtgtgagatacggcaaaagcaatactaagaaagaagtatatatcagtaaatgtttaccttaaaaagtagaaaggttttaaataaacaatctaatgttgtaccacaaataactagaaaatcaagaaataacaagccccaaattagcagaaagaaagacatgatgaagataaaagcagaactaaacaaaatggaaattgaaaaaaaaggatcacaaaatgaagaatttttttgaaaagataacagaattggtaaatcactaaccagactaaccaagaaaagaagaaagaagatccaaataaacaacatcagaaataaaaaaggagacattacaactgtctttagttttaatgtatttcttttcgattggacattttctttctctgactgactttgaattctttttaaaagtatgtgtaattttttcttgaatctaactaaaagtagaaactctctctctgacttacttttacttcttttgaaagatgcatataactttttttctttattctacctaagagtaggaactgttggtatatgtatgtgtatgtgagattctttagtaagttacttttgtagccttttcagttaggtaaggaaatgtaaaggagaattaaaaagcataactatgctaactatgctctgaagaggaaaatgattgatgtatatatttataacttttccattatgtatactgttctttttgggaggaacagcttgctatgtagatagataaatcactaaaatagatctcaataccaaagtgtgtatgtgtgtgtgtgtcggcgggaggggtggctatacctagggtcaaagttactttaaaaagaggtgaccactttaatctagtaaaaattattcccctgaaagttaaagagatgcgaagaagaattgattattaagtagtcaataaaggtgttcccttgattagaaatctgaatgtaaccctctctggactcatctcaacagctgccatttagattgctagattgtaataagaaatgagtttgacctgacattttcatccttaattcagacaactatctctggagaaaaggcccataagaaagcaatcttcttaatccatatttcctttgggtgaatataaatttgagcccttcccaattcatccaagcctcctaaattattaaagtaattagtagatgaattctaagactcagatgaagggagaatttatttaaagcatctaagaaatgttttcgatatgtatcccagtactttataaagcatgcctttagaatgctggaggatttgcataagattagaaaaggaaagtgttttgtttgttgcgttttttttttttttttttttgtacaaaagataatctacgtcttaatgcactgatattcattattaatctttaggaaaggaccattaattgcaacgttccgctaactgatttggtaggtgttgaagctgtttggtgccctatcactttcctaggaccattgcactgtggggcgacagtccaggacctctcaggacagttttactgggaagatagaactaaattagaatgcaagttccagcaactcaggagctaaaccaaagattcagctagaaccagcgagattagctcatttggggctttttcaaatttacctaattagaaaacaggtcttgcctatcaactcttcacaagcaaattatatcaaagcccaaggacaatatgttaaataacctgtgtcatttccctcttttacatttttaagagaggaatgaagatctttgcaatgtgtattatgagcagcctcaggctgaaaggttgatctttggggctttttgttttctttgtttggtttgggtttctgtggttgttatttttattttatttttttatttttattatactttaagttttagggtacatgtgcagaacgtgcaggtttgttacatatgtatacatgtgccatgttggtgtgctgcacccattaacttgtcatttagcattagatatatctcctaatgctatccctccccactccccccaccccacaacagtcctgagtgtgatgttccccttcctgtgtccatgtgttctcattgttcaattcccacctatgagtgagaacatgtggtgtttggttttttgtccttgtgatagtttgctgagaatgatggtttccagcttcatccatgtccctacaaaggatatgaactcatcattttttatggctgcatagtattccatggtgtatatgtgccacattttcttaatccagtctatcattgttggacatttgggttggttccaagtctttgctgttctgaatagtgccgcaataaacatatgtgtgcatgtgtctttatagcagcatgatttataatcctttgggcatatacccagtaatgggatggctgggtcaaatggtatttctagttctagatccctaaggaattgccacaccgacttccacagtggttgaactagtttacagtcccaccaacagtgtaaaagtgttcctatttctccacatcctctccagcacctgttgtttcctgactttttaatgatcgccattctaactggtgtgagatggtatcttattgtggttttgatttgcatttctctgatggccagtgatgatgagcattttttcatatgttttttggctgcattctgtggttgttattgttgccctttggggatttggtgtttcgtaattccaaagttaattacttgctaacaggagtagagaaaggcaggcctcataagatcttatcagttacttgaaaagggaaatatatgagctttcctaattgattgctccaactgaagacagggaccatcacaaggaggtagaggagccaggtgccgatggcactttttgactcttgatagtagaataaggttgagtgtgagggcaaatgtgagagcgaggacagctatggagagatttattaaacaatttcttcctgtccctctggtctatcagtgtgttaaactgaagaaattagaggaatcaaaacaccttccctgtcgtgaaaggagtgaatctgttcagggaagcaagagttaaattatcaggaaggtttcttaaccgtcagttcttcattaatttcctcaaggatttgtatgttggcccaattaggtggttactatgctgagacaaaagttgcagagaagtatcagatgtaagagaatcacacctagatgtagtcagaatttatatttagaaagatgcaaagcaaggtaagttaatatatgcttttgatcaactatgtactttagacaaccatgccacaagagttcccggaacaagaagatggttacagatttgtgtagccagacttcagagctgaggagggatttagctggatgtggaagtgcagagccaatatctgcacatcttttcatacgatggcgaaagaaaggtcatgtccatgatgactcactgtggagtaaaacaagctttcattgggagagtgttatttgttcctctggatttattagggaacctttcctggaagtgacacaatttatgatcaatattaacagaagacagaataagtaatcattgaaaagaaaacaacagaatgaattcactttgtaattagagaaactttcctggaagtgacacaatttatgatcagtattaacagatgacagaataagtaatcattgaaaaagaaaacaacagaatgaattcactttgtaatatttgtaattcatgtcatattgcccaatgggtgcgcatgctgtaatttttccaaagtcatgtttcattatacatttcctgtccaatcagtgcagatcccacagttattatacatttatttttaaaatgtagcttttaaaaactgataatgtgcactggtgtgccaaatttgtgtttctattcttacagttacagtaagtcataaacttttcagtgactttggtcctcacatagtttcaccagaataattatatttgctcatgaaagatacttttaaattcataaacaaagttcaggttattgtgatcctagtgaagtcacagagtgttggttacatgtttcacaagtgaaactgtctttaaaatgaataaaaataataatcattgacattgtggaacctctctgtgtaccaaactgaataaaaggaaaagctcgccagtagcaaagccctgcatagcagcctggcacattgccggatagaataacactaccctatgtttctacagcaatttagattttacaaaaagatgtgtaaatcttgacaatagaactaggttgaatgtggggggaaatatgagagtgagaacatcaacagaaagatctattaagcactttctgcattgatcttcattaaaaacgttataaaacttgtaggacagatatcttcctcacttattcttgccactttgtacacgaggaaactgagactcatgatggcaaaaaggactagctctaaggttacagagctaccaagtagcacaggaaaaatttaagtgtctagtctcaggcttccagccctagcaatcagtgcacttcagatgtcatcccacagggcctgccatctgtgatctcttgtgtctctttatacaaagactttacactcaattaagccaggcagagtaagtatcccttatccaaaacacttggaaccaggagtgtttcatatttttatatttttctggattttggaatgtttacatatatatgtattgaaatcccttgagaatgaggcccaggagtaaccagggatgcatttgttttatatacagttatgaacatagcatgaagatgatttatacaatattttttaatagttttgtgcattacacaaagttttgactgcattttaactgtgacccatcatgtgagatcaggtgtggaattttccacatcatatcagcactcaaaaagttgttattttggagcattttggatttgggattatcagattagggatgcacaacctgtattgtgttgaaaactagatgaattacagcatatacaaaacacaatagggaatatgaatttagaacattaatttttgcaacactgggatcaaaatgacgctttagaggaagaaaagaaagaagtgagatgagtgttaccagagctaggcagtgttttgatatgcatgacgataaactagatttacgcaactttactttaaacattcccttttggcgagaaaccacatcacacggcattcagaggaaatttgctctaagaactgtaacacacaatataataaaacagatttacaacatgacaaaggtatagaagaaatgtagttccctagaaaaccaagtaccacatgttctcatttataaatggaagctaaatgatgagaactcatgaacacaaagaaggaaacagcagacacttgggtctacttgagggtgggtggtgggaggagggagaggagcagaaaagatagctgttaggtactaggctggagaccggggtgatgagaggatctgtactacagacccccatgccagtaagttgacctgtgtaacaaaccttcacatgcacccctgaacctgaaataaaagtttttaaaataaagaaaagaaaagctttaattctaagtgaaaactctaagggatattgccataattttaacatttacttctcaagagagtttctgctatttaacttcttaaaggcttctcagcatggtttattttcagagagaagttccatgagttttagagctgatgaaaaccattatttttctcactctgtttaaataacggacagagttatttaaacacactcttatatatataacacactcttgttatatctcttaatgtaaattgatagtatacatttttatctttcatccctgctaagtgattttcttaatataatactgagagttttgttgaggaaatatgcacttttgtacaaaactatctttcttttaatttctgttttaggaatcaaatatttttatttaattgatactaagcttttatttgcaatctttgaaaaatgataaagcaatgtctagcaaataaacttacaaataaattgcagaatgaaattatgagtctgggcctaaaatatttgcctgagaaccagagcagcatttcatttctaactctgccacctactgtgcaataacctttctcattcttcctttgaactagatgacttttatcatttaatcagttctaaggtaccattgtgttattgtgatatagctgctcttttcttaacttagatactgtccttcagagcccacattgcatcacagtgttttccacttcccagacagctatgtttacagagcagtcactagctataccctgttatgtcccaagtggaccacatacttaaattactcctcaacccatctaagtgtcctggagtatttgtgggtttattcatcatagaataagagcagtttattttatcatcaacaggagaagcaagcctacaaaattgatctatagtagagagatcactgtgcactctgtccaaccttcttttgtttctatgtgctaatatgattatagccaaaatgcagttcgtatcaattcatgctatggttcagtattccagagttctgtatctgctcttcagttagccaggacccactgccaactaccctttaagatacaaagaattaattttcttagtcagttagctagtttttcttttattttctttttatactgggttatttgttaaagtggtattttcatgtttcatttcattttatatcacattagagtctttaatttttagttacaaatatgatcaaagactttttgtttgtttgtttgtttgtttgtttgagacggagtctcgctctgtctccaggctggagtgcagtggcatgatctcggctgactgcaacctctgcctcttgggttcaagcgattcttctgcctcagcctcccaagtagctggatctacaggcgcgtgtcatcatgcctggctaatttttgtatttttagtagacacggggtttcaccacattggcctggctggtctcaaactcctgagtttgtaatccgcctgccttggcctcccaaagtgctgggattacaggcctgagccaccgcgcccagcagatcaaagactttttaaaagtggcttaacagtcctatacaactgatacaacacttccatgctaccagaagttgagtagcttacaagtgtttgaagttaatgacaatgatataaatttctgtgactatcagttcatttctcaagctaaccaaacagccagaatcagcggtatgtgactattttcatatttatacaatgccagctccaaaatataatgtattgaaaaatcctgttaagcataggagagtcaagatttatttaaactgaataaaacattaatatcatcctacataggagtaagtttatagaactggtccaattgttagggtaccagatttgaagcttggaaagtcaaacatgatataagtagctgatgaccaaatctaaggtgcaccatgtcccattaaaaataaaacaaaaaaactagctttcaatttatctacaattcaatctatatgatataatataattggatgaccaacttttcaaccaaattaatttaaatgactccatattttggtactttgttaatttagctttagcttaagggttatcccctggaagacaggtttgatatgcaaaatgttttgtgttctgagaggtatatttgtatatcatacaccattcaatgtgagctcgacatgttctttagacttgaataggaacatctacttatgcataccaccatcttctttcttcattgctatatcccattctttagagccatggtgaacacatagctgtcactcaataaatatgtagcaaataaacaatagaatgaatgaatacatgaatgatgtgcatatctcatattctccgaaatgacttcatttaatatattaacaaacatcactcacaaaggaggaatctgtgtgtttggcagcagaatattcctgaagccttttgataaatatcaaatagtttcagtcttcataataagataattatttacaaaaactaaattctaaatctttctagctataaatcactcttgctctaaactacaaatgacatttattacatagaccaagttagcctaataaaatagcacttttgtaaggaacaatgtttcttattgtttttagattgaagaatttaaaattaatttttgagttgccttaatgtgtcctatacatacatatatatgtacaggatacgttatatcatatatatatacacacatatgtatatgattatttaaaaatgggagatgcattcttttagcctctgttcctagaaataaaataagtgtaataggtgtaaaatccttgtttgaaagcttagaaagtttttattatttaaaaattatatgtctgaaacaaaacattttaaattatttgaatctgccagcgatatgtttatttaattaggaggaaattctagtaagattggaagtgcacattttatctgaacacaataaaattttcatataaatgataatatacctaatagattttatatattcagttagagtcttctaaagtgaaagctatttgtagagtaataagtttggcttcttgagtcaggaaaaaaagactaaatcatttctggagggatttggaatttctttgattcctttatcatctctttcaatagtttagtatagattataattaataaatgtcttaacctatggagaatagtaaattgagaacgtgtgtttacagttaaaaatggaatgtttttaattcaatgagaaagtgctccactatgctcaaactttactgagtaatttactaaaatacaaagtttaacaaagcttagatagagtaatattaagcaggcatttttccaaatgctactggaccctttttctaatgtgaacatcaacatttcctgaaatgaaaagagtttgttttattaaattgatatttgtcatttgaactcaaactgaggttaatttcctcaccctaggactgtgtcctgaatgatgatagccctgaaggaattgatcagttgcagtgacatgcataatgccaatatttccatatgaattatttttgtcattacaaaagctttgaaaaataggtattatcattcctatttataaatcaaacaaacaaaccaaaaacagatttagagaggtaagcaacttttcaaaaatcaaatggttaaatagttaagggcaaacttactgtttcagccagtctaagttgaactctgtctaactctgtatcacgtcttcttttcaccatctatcatgctattaggacacctccctgttatgctgtcctccttcaaaatgttcctgtaaaggtggatgtaaatagtaatagtttattcaacaaacatttattgagcacattccatgtaacaagaatcattctagtcactggaattagagaagacagaaacagaccaaattcctgcctttgtggaatttataatctagtggagaaggtgccagtcaacaaaccaatgaaattaatgataatatcaagtagtgaaaagtgccataaagtaaatgcaaaataaggcaaaatcgatagagagagagtatgtaaatgggattgctgttttagatagagtagtcagaggggccacctctctaaagacttgttgaatattgaataaagtgagaaagcaagccacacaatgtaagttttggggagaaaggcaaaagtcaagaccctaaagaaggaataagcttagtgtattagagaaaaagaagaccactgtgaccagagcagtgcgagaaagtcagagatgctgtagatgacattggagaggtatgcaggacccagaccattcttagccacctttgatttgtgtgtgataaaaagatatttgagactttgagcaaggaagaagtaacctgaacttgtttgtagttttaaaaggtaatgttggcatatatgaagagaattgactgtaggaaagcaagagtagaaacggcaagatcagttagggtcatctaagaaaatattgcaatactcaggtgaaaaataagaaaggattttgaacttgggtgatagtaatggagataagaagaaatgcacagtcagtataaattttaaagatggacttacatgatttggcagaatgaatgtaggctttgagggccaggagaaatcaagtatgatttcaagttttttggccgattgctaagatacagaagattagagaaagagcaggtctaggatcctgtgggtttgcagtggacagtgatgtagctactaaaaatgtgtaaagacacagataatgtgaaatgtcattaacagagaaggatatggaaacagaaggcgatgttatataaagcaatagataacacagtatgctatagtcagaggtttagctttaaaagttctcactggagcatagatggtaccttacacgctgagatgtgacatggagccatttttataaggacttgtttcatcccattttacatacaatccctgactttgttcaggatgctcttgatatatactacctgatcattggggtgaatttactttgtactgggtgaagtctaggtctgttttccagaagcactcttcagctgtcctaggcttcatgcctatctgaaattctctcctgtaggggagaatgtgattgaacatacgtgtgaactgcctggttgacattcatttacaaaacagccagtgctagcagatcccagatttatttaattcacaaagaacatgatagaatttgtaattcaattagggtaattgtgtatatgaaaaaggataattagttgagataatacctaggctttgtaaaatgggaagcacaaaacagtatacagtattatgcacattaaataacacctgtaaaactggacagaaacataatagaaactgtaccttacatttgtaaaaactacaactaaatattaaaaaattggaggaaatagaacctgtactggaaagataatttggaaaaataataattttggaagagaatagaacagagtgaaataaatagaacaaaactggagaaaattagcagccttgcacagtatgatagggaagtacacaagcaaaatgttataaagaatcagattttttaaaaagaatgagataaaatgagtaaaatggatcatggttataaagttctcaaattatagagtaaaaattttatgtgaggtaattgtaagaaaaggttacttgatataaacaatgctcagaaagataagctctaggaataagaaagatgaagaaacgagagatgtcaatgtgaaacattaaactccaaacacaaccccaaacacaagcctgaaatgtaagtactaatgagttcctaggaggtggtactttactgttgtaggcacgaatgttggcatctgccacactgtgctttgagtccgctagctgtgtgacttgcataagttgcctgacttcactttgctcagtttcagcctttatgaagtgaggaagttacacctgctctatcgagtcattaccaatgaaacataaagaacttttgcaggcaacttgccttaattggtggtagtggtctcccatctgggacagggacagggatgtagggtggagggaaagaagaattgtgcgtagtatatgatgaccatctgcctggtctgtggaaagttctttcttcccacaaccagcaatatttcaaatgtcaggttttgaccatggtttccagtcatgcttagagaccttctggtctcgagtcatccatttctccattataaaggctcagtgtgatgtttgtgtagcagcgactcatgacagggctcttcactcttgacagctctcgatatcattaatgtcacaagatcttaattcaaatgttagctcattaaattaaacattaatctacctggaattttgtttaattgcctgacaataatgttagcacgtgtaggttttttttctatagttaattatatcatagatagatggtgactttaatatgttaaacatatttgttattcaaaacaaaggcttactaagtcccagggagtgaaaataccattttgtcatattgcaggctggattttccaagtttggaaagaatgtcaggagatcccaccggctccatctgttcttggccctatagcaaaatggtcatgaggttaatgatgatcacttccacaatttcgcagttttgatgtttgcataacatgctacaaacttaaacagaaataaacctcattaagcaggattttataaagaaagtggctgtttttatttttttttattttgggaaaatactttaaaatgaaacaaaacaacttgggcaggcccaccaagtttagatttctgtatttaaaaattcctgaagtggccatgtgcggtggctcacgcctgtaatcccagcactttgggaggctgaggcaggcagatcactggaaaccaggagtttaagaccagctgggcaacatagtgagactcccatctttactaaaaatacaaaattagccagatgtggtggtgcatacctgtaatcccagctactcgggaggctgaggcaggagaattgcttgagcctgggaggcggaggttgcagtgagctgagatcccatcactgcattctagcctgggtgacagagcgagaccctgtttccccccacaaacaaaacaaaacaaagcaaaacaaaaatccttaagatattccctctctcgttcattagcagtcaactgattattatcctcacttatttttaaccttcctcccacctcctactcacttttttatcccatcatttctgtgaaactgcttttagcaaggtcacatcagcaataaagattttacattattaaaacattacttcttctttaataatatatcatttttctcctaaccctctggctaatcctttctggtatgtttttagtgctgtttttcctctgcccatcaaaggagggtgttacccaatattccatcttatttttccattcaaattgaatgctctccctgggtgatgtaatccactctgtttcccatctaatatttttttcatttttgtgggtacatagtaggtgtgtatatgagatatatgtgaggtattttgatacaggcatacaatgtttaataatcacctaagagtaaatggggtatccttcacctcaagcatttatcctttcttggtattatgaacattccaatgataatcttttagttatttttaaatgtacaataaattattgttgactgtagtcaccctgttgtgctatcaaatactagatcttatttcttctttcgaaccatatgtttgtacccattaaccatcctcactttactcctgcaacccctactaccctttccagcctctggtaaccctcattctattctctgtctccaggagtccaattgttttagtttttagctcccacaaatgagtgaaaatatgtgaagtttgtctttctgtgcctagcttctttcatttgacgtgatgtcctccagttttatccatgctaatgcaaatgacagggtatccattttttatggctgaatggtactccattgtggatatataccacattttctttatccatttatctgctgatggacacttaggttgattccaaatcttggctcttgtgaataatactgcaataaacctgggagtaggaatatctttttgatatactgagattctttatttttggtatgtatacaaaagcagtaggattgctggatcatatggtagttctattttagttttttgaagaatctccatactgttctccaaagtggctgtactaatttacattcccaccaatagtgtatgagggttcccttttctccacaaccttgccagcatttgctactgctggtcttttagataaaagccattttaactggaatgacatgatatctaactgtagtttttatttgcatttctgtaatgatcaattaatgatattgagaacctttttatatacctgtttgccatttgtatgtcttcttttgagaaatgtcattcagatttctgcccattttctgatcagattattaggtttttttcctactgagttgtttgaactccttatgtattctggttattaatcccttgtcagatggatagtttgctatttttttccccattctgtgggttgtctcttcacttcgttgattgcttcctttgctgtacagaagctttttaactcaatgggatccaatttgtccacttttgctttggttacatgtacttgtggggtatcactcaagaaatctttgcccagatcaatgctttcccaatatttgcttttagtagtttcatagtttcagatcttagatttaaatcttgtatctttggattttatttttgtagatggcaagagatggtggtctagtcttattcttctgcatatggatatccagttttccaagcatcatttattaaaaacactcttttctccaatgtaggttcttggtgccttgtcaaaaatgagtttactgtagatgtatggatttatttcttagttctctattctattctattggtctatatgtctgttttttgccagtaccatgatgttgtggttactgtggttctgtagtataattctttttttatataagtttctttgctttaaataagcttaaaaaagacaggagaacaattatatatttaaaattttataatgttaaacgttttatttcccatgtgtgcttcactttgtggattcaagtaattaactggaaacattttccttttaacttttattttaggttcaggtgttacctgtttaggtttgttccatagataaattgtgtgtcacaggggttggtgtacagattatttcatcatccaggtaatgagcatagtacctgttaagtacttttttaaatccttgccttccttccaacctctgctctcaagtaggccctggtatctattgttgccttttttgtgtccatgtgtactcaatgtttagcttgcacttacaagtgggaacatacagtatttggtttgttacacagtatgttcctgtgttagtttgcatagcataatggcctccagccccaaccatattgctgcaagggacatgattctgttatgttttgttttgttttgttttgttttgttttgttttgttttgttttgttttatggctgcatagtgttctaattctgtgaagaatgtcatggaagtttcataggaatagcattgaatctttcagttactttgtagagtacggtcattttaacaatatttattcttcctattcttgagcatggaatgttttttcattggtttgtgacaatgtctgacttccttcaatagtgttttgtaattttcagtgtagtgatctttcacctcccttattcctagatattttactattattattattattattattattattattaatgctattgtgagtggaattatattcttgatctgactttcagcttggacattactggtgtgtagaaatgctactgatatttgtacattgattttgtgtcctgaaacattgctaaagttgtttatcacatctaggagctagtaagcagagactctgggagtattctagatataaaatcatatcatctgcgaggagagatagtttaacttcctgtcttcttatttggatgctttttttctttctcttgcctgattgctctggctaggacttccaataatatgttgaattcaataggtgagagtgggcatccttgtctcattccagttctcaagggtaatgcttccagcttttgcccattcagtatgatattggatatgggtttgtcatttatcgttcttattatttgaggtatgtcgctttgatgcctaatttgttgtgggttttaacaagaagggatgctgaattttatcaaacccttttctgcatctattgaggtgatcatgtggttttcacttttagttctgtgtatgtgatgaaacacatttattgatatgtgtatgttgaaccaaccttgtatcccaggaataagacctacttgattgtgaaggattcgcttttaaatgtgctgctagagtcaatttgctagtattttgttgaggattttcacatctatgttcgtcagggatattgacctgaagttttctttttttgttgtgtctctgccaggttttgatatcagaatgatactgtcctcatagaattagataggagtccctccttcttgattttttggaataatatcagtgggattggcagtggcttttctttataagtctggaagaaatcagctgttaatccatctgatcttgggctttttgttttgtaggtattttattactgattcaatttcaaaactcattattgatctgttcagggtttcaatttcttccaggtttaatcttgggagattgaatgtatttatccattccttctaggttttctagtttgtgtgtatagaagtgttcataatagtatatgagggttcttagtatttctgcggaatcaattgtaatggcatcgttgtcatttctgattgtgtttatttggatcttatctcattttttttccttattagtctagctagcactttatcaatcttatttattattttaagcaacaaacttttgaatttattagtcttttgtatggtttctctcatctctacttaattcagttgagcactgattttggttatctcttttcttctgctagctttggggttggtttgctcttgttgttctagttcctctagatgtgatgttaggttgttaatttgagaacattctcactttttgatgtgggcattactgctctaaactttcatcttaacactaccttagctgtgtcccagagattctggtatgatttttattgttttcattagtttcaaataattacttgatttctgtctttattttattgtttacccaaatgtcattcagcagccaattgtttaatttccatgtaattttatggttttaagagatattcttcatattgatttattgtacttcatattgattttattacactttgatctgagagtatgtttggtataattttggatttttttttaatttattaagaattgctttatggccgagtgtgtggttattttagactatgtgccatgtggagatgagaagaatgtatgttctattctctttgggtggcatgttctacagttgtctgttaggtccatttggtcaagtttcaagtttaggccccaagtatctttgatagtattctatgtcaataatctaatatcatcagtgggttgttgaaattctcacactattattttgtggttatttaagtctcttcgtaagtctctaagaacttgttttactaattaagatactccagtgttatgtgcctgtatatttaggatagttatgtcttcttgttgaattgaaccatttatcattatatagtgtacttctttgtcctttttgattgttgttggtttaatgtctgttttgtctgaaataagaatagcaacccctcttcttttttttttttctttttgcttgatagatctttctccattcttttaccttgagtttatggtatctctcattgcatgtgagatggatctcttgaagacagcgtacatttgggtcctcgcctttatccaacttgccattctgtgcctttgacatgggacatttaacctgtttaaatttatgggtaatactgatatatgcaggttcaatcttgtcatcatgttgttagctgattgttaggtagactcgatcatgtagttgctttatagtgtcaatggtctatgtacctaagtatattttgtagtggccaatagcagttttttgttatcatatttagcactcccttaagtacttcttgtaatagaggtctggtggtaatgattttccttagcatttgcaaaggggagtaaaatctgaaaaggattttatttctccatcacatgtgaagcttagtttggctagatatggaattcttgcttagaatttgttttctttaaggatttgcagcttctctatatttcctcgcatttgcagccatgcactctctcagtgctctgagagtgtgagcttccctctcacttgagttttggccatagaccttagcttggcaccctgggctatatgctgccaccttggggatagctcaggctttttgttccctcctcactttgtggcagcagggacagggcccttggcagtggcaatggcagaggcctgccacttccctcttgaagttacaccccatggaaatacagaaccactgccaatcaaaatcatcagccaggtgtggagtggctacactacaggcctaagctaggaccctgcctgttgaagagcggggacctgggggattcacagtgaaaacagtctggcctcctttctatagtgtggctgcggtgtcctggaggtgcaaataaaacatttgggctttttgtttcttcccaagcctggtggcagccaagatgggtagcactacaacagcagtggcagaggggctgtcagttgcctccaggaactccaccccagagagacacaaagcctctgtcagtggaaatgttcagccactggtagagtgactgtgctgtgggcccaaaccaggggccctgcctagagaagagcaggggttgaagggttcacagggaagagaaactggccttctctccatagagagtacctttggcctactagaggtgcaaataaccaatcagggtctttctctggttcactgaccaaaggcagcaatggcaagtacctctgcagttgcaatgtcagagagcctgttggttatctctgggaattccatccaggattttattttctttgtagctatcataaatgtgattactttcttgatttctttttcaggtatttcactgttggcatatagaaatgcaactgatttttgtttgttgattttgcatcctgcaactttactgaatttgtttataagttctaatagctttttggtggagtctttagggttttccaaaaataacatatcatttgcaaacaaggataatttgacttcttccttcccatttggatgctgtgtatttctttgttttggctagcttctctagctaggactgctagtactgtgttgaataacagtgataaaagtgggcatccttatcttctcccagatcttagagaaaatactttcagttttttttcccatttagtgtgatactagttgtgagtgtgtcacgtatggcttttattattatatgttgaggtatgttccttctatccccagttatttgaggggttttatcatgaagggatgttaaattttataaaatacctttttagcattaattgaactaatcatatggtttttgtccttcaatctgttgatatgatgcatcacattgtttgatttgtgtatgttaaaccatccttgcattcttgggaaaaatcccacttggtcattatgaatgatctttttaaggtgttttaattcattttgctaatattttttgaagatttttgtatcagttcaccagagatattggcttatagttttctttctttctttttctttctttatatttatttatttttttgatgtgtctttggttttggtgtctgggtaatacaggcctcatagaatgagtttagaagtattccttcctcctctatttttcagaatgatttgagtaggattagtattagctcttctttaaatgtttggtagaatccagcagtgaagccattaagtcccctttgatgggagatttttttattatggcttcaatctattcaggttttggatttcttcatggttcaattttaagcattactatgtttaattcattcctttctaggttttccaatttgctggcatatagttgatattaatggtctctagtaatcctttgaatttctgcagtggcagttgtaatgtcttcttttccatttctgactttatttatttgggtcttgtctctttttttttggcagtgggggagtaaggctaaaagtttgtagattttatcttttgaaacaccagctttttgtttcattgatttttttttaagtttggtttatttctactgtgatctttatcttcttctactaattttatgtttggtttgctcttggttttctagttttttagaaagcatttttaggttgtttatttgaagttttggccaggtgcggtggctcacagccacccagcattttgtgagtcccagcgttttgtgagtccaaggcaggcagatcacctgaggtctgaagtttgagaccagctgggcctacatggtgaaacctcatctttactaaaaatacaaaaaaattagccaggtgtggtggcaggcacctgtaatcccagctacttaggaggctgaggcaggagaattgcttgaacctgggaggcagaggttgcagtgagctgagatggtgccactgcactccagcctgggcaacagagattctgtctcaaaaataaataaataaaaataaaaatgtggtttttctgcttttttgatgtaagtgcttattgctataaactttcctcttagtaccacttctgctgtatcccctgtgttttggtatgttgtgtttccattttcttttgtttcaaaaaatttttaaattttatttttaaataaataaaatttatttatttatttattactggtcattgaggagcatattgtttaatttccatgtgttagtataatttccaaagtacatcttattattaatttctagttttattccattgtgcttagtgaagatgtctgaaatgatttcaatttgttcagttttttaagacttgttttgtggattaacatatggtctattctggaatactgtcaccttggatttttctggttattttgtggatttatcttttttcctttctttcttcctcttttacattttgtgagtgattttctttttgttggtggtatgtttttatttcttgctctttttttttgtaggtgttttgatttgagattaccaagcagcttgcaagtaacatcttacaacctattatttttcaacagatgacaatttaactttgattgcaaaagcgaacaatctaacaaacaagtaaagagaaaactaataaaaactctacattttaactttatcccccgctttttcactttttgttgtttcgattcatattttattatgctgtctaaatctttaaaagtggtcataggtattatttttgagaggtttattttttagttttcctactcaagatataagtagtttatacactacaattacagtgttataatattctgtagttgcctgtgtacttactattaccagtgagttttgtaccttcagatgatttcttgttgctcattaatatcatttttttctggttgaagaactacttttaacatttattgcaggagaggtctggtattgataaaatccctcactttttgtttgcctgggaaagtctttatttctccttcatgtttgaaggatattcttgctgaatataatattctagaataaaagttttttttttttcctttagcacttgaaatatgtcatgctactctcttctggcctgtaaagtttccactgaaaagtctgctgccagatgttttggagctccactgtgtgttgtttcttttcacttgctgctttcaggatcctttctttatcattgacctttggaattttgattattaaatgtcttgagatagttttctttggtttcaatctgtttggtgttctataaccttcatatacttggttattgatatcattctctaggtttggaaagttctctgctattatccctttgaataaactttctactcctatctcctttactttctctttaaggccatcaacccttagattggccactttgaggctattttctagatcttttaagtatatttcattatttttattctattttcttttgtctcccctgactgtgtatcttcataaagcctgtcttcaagttcactaattttttcttctgcttgatcaattctgctgctaaaaaactctgatgcattccattgaattttgtagcttcagaatttccgcttgatatttaagaattatttcattctgtttattaactttatgtgataagattctgaattccttcttcatgttatcttgaatttcattgagcttccccaaaatagctattttgaattttctgtctgaaagtttgattatctctgtcactccaggtttggtcactggtgccttatttatttcagttgatgaggtcatgtttgtctagatagccttaatgatggtggatgttcatcgatttctgggcattgaagacttacgtagttattctaaactttgcaatctgggcttgtttgtatctatccttcttaggaaggttttccaattattcaaagaacattaagtgttgtgatctacatctttggtcattgcagccacatgtgcattagggggcatctcaagcctagtaaccctgtgactcttgcagacttgtagaggtaccaccttgatggtcctggatgagatccaggagaattctatggattaccagcaatctcttattctcttcccttactgtctcccaaacaaatggagtcactgtctgtgctgagctgcccagaactggggaaaagattatgcaagcactcccataaccaccactgggacagtgctgggtcacacctgaagctggcacagtactcagtgccaggtcttgccgaaggcctgtagcaactattgcctggtaccactgaggtttattcaaggaccaagggctctttagtcagcagatggtgaatcctgccaaatgtgtgtctttcccttcatggcagcaggttgccttcttgccccagggctggtttagaaatgccatttgggaactagggcctggaattagagaaattgggagtctctgatgctttattttacagtgcctgagcaggtatccacattgcaagacaaagtgcttttcactcttctctctccttccctcaagcaggagtctctccctatagccaccacaactgggaatgtgctggatcacaccaaaagccatcatggtactaggtatcacccaatgcccatggcaactactgcctgtctcctgctgatatttattctagacctaagggttctttagtcagcaggtgataaatcctgccagaactgcttctttcccttcaacgtagcgagttcccttctgttccaggttgagtcttgagatatctgggtgctagggcctgaaatgagagcatcaggactctgctccatgatttattttactatgtccaagttgcaagaccaagtcctctttactttcctggagctttgagctgcactgcctggagttggaggaggggtgacacaagcagtcccttggctgccctagctagtgtctcactgggccgtgtgtgccccatatccacgggctcccagcctagcacagcatctagacttttccataaattaaagtccttgtggcctagactgcttttcaagtttttttaggatcccagagtactttagcttgcagtgttgggtctaacaggaactcaggttcctactgctggatgggcgatttccctctggctagggctggtctaaatgcttcctccatgggcgcaggctgagttctgcctggtgttgcattccactgtgacagggcagtactgagttccaatgcacagtcccacaatcacttcattctccctcccccagttactctgatcactcacctgatttttggttcttatgaaggtgctttcttgtatggatagttgttcaatttggtgttcctgcgggaggatgatcaatacaggcttctatttggccatctttctccacctctgactataatccactcttaagtctttgttaacaactcagtgtggacgactttcgtatttatagctctagacttatgtagtaaacggttactagatattaccatttggacattctacagatatttcaaactcaacgtgttccacatggcttaccttttctatctaaattccatctttattctcagggattggtcacaccaactactttcatgcctaaaccagaaatctggaggtatcctgaatttctcttttcactgccaaaccctcttaaccctctttactcaattgctcaccaagtcttctcaaatttttaatgttactatttcttcaatttgtgcatttctttccatcctcattgccactatctagtttagttcatcattttcatttctttaactactgcatgttcttcctgctatcagatctccatttagcagttaatcttactaaaatacaaaattggttctattaatcattaccttgtagaaagtccaactgcttaatatagcattatctgattatcaacttaatattatccaactactgcacatttcccctacctcatttccagccacctttcccattaaaccctgttcttctgccataccaaccagtatatgcctgcatttctcagtacaggacaagtttttttctccctctatcccctagccagtattgttccctctgcctagaaggctgtcttcctgcctgttcacttggctatgtaccagttatcttccagaacagtgcttctcaaacttaaatgtatgtatgaattacctagagatctggttaaaatacacatttattccagtaggcctaggctgggcataatattctgtatttatatcagttgctcctagacaatgctaatgcttttggtcagtacagtaggatggttctagaatttatgtcacatatcaccttttctaggaagacgtgtctgacctcccaaggttgaatagctgcttttattgcatcctgtggaatattcccccacatcatagcactcattaccttgcattgttacttcctgtttattgggatgttacctctgactaatggactgatgatatcatcacacaaaatggtacccagaacctagcaaaagcccagtaactcatgctggttcctctccagtatgtgctataccaacattcctccatactgtcactgttgctatgtctgcttcttgctcaaagaacaaataaatcttcacctggcaatggtggctcttaatttgagaatacagggtgagtgcattttttggcaccatcaatgtctcctgctgcattggcagccttgttccttctgctgctcagtattcttccacatattgggataaagagaggggtactttaacatccttttagtaagaacagattctttctgtttgaataccaaagtggaaaacataactataattatccagaaatataggcaccatgaaaattctactcaacactgtaatgagtctttactatttaattgctttgtgtccaatattattataaaggtttgcatttgttcaatggcacttacataatgtattgactgccatgcttataggaacaaccacagttaatcagaaacaccgtgctctccttttcacctagattattcatctcaaaatgtcttccgatttaccagggatcattaaatttgactactgaaatgaaagaagcttaagattactcataaacaggtcaggaaaaaatatgaagatagtggctatactttatgcttcctaattgatcaattacagaagccaaggtaaatttagagtgcacattgtcttagctcattatagataaaaaatatgtctgtcaagaatgtaatcagattcagagccttgcttactggataggaggaggattcagccttcatgaaagttaaagcatttcttttctcagttggaaattttaagcaggagaggaataggcagatgaataaaacatggtaatggaatgtaataaagcagaaattgagatatatccactaagtaagatcacagatagcatacaaattcactgaccattaaaatgacttgtcaggagagattatgatatttttaatccctaaagtaattatgtgatatgtctgaccgagtttgaattttattaaaaattttaagagtatatgaaaatggattaaagtttcagcttcctagattcaatattcatttttagtatgcaacgactcagcagttttaatgattattgctggataattctactctatagactgatacagagatcacttcttcaatagttcatcagttgaatgcccagtaccatgtggggacattacagaagtgaccctcgtggaataaatgccttcgcttagttcttcagccttctcctccaaaatgtgtgtttatgtacaaatgtgatgaatctccgctagggtcctgcaaaccccctggtgttaggggagctgagaagagggctggatggtctgtagggtatcatagatttctaacataatgaagtgttgtctctagaataaaatgtgtgtgtgtgtgtgtgtgtgtgtgtgtgtatgtgtgtgtgcgtgtgtatactgctttcgggaattaaataaaaatgttttttcaagtgtcactgaattcttaaaaccttaatttgtcattaagtcttttacaaaaaacagataagtaaaactgctgctataaaggaagggaaaatacacaaaatttatacacactacacacatatgtatttaatcataattgctcttacaatggaaaagagcatttttcacatactgtttgtctattgaaatatatatgaggaagaaagaaataaaaaggagataagctaagaagttagaatttgcagaataaaaaccctggcacataatgatattttctaatttatcttaattttgatcaagcaattccaatgggaaacaagtttccttaaaaaacaaactgaagaatgtttttctgtgcacataatttaggtggaaatacacctagtatatccatgttttctctccaggcaagaagtaatttggaaagaactaagcaatgtggtgttggtaaacagtgtttctctctgataaaatgccagccaaaaagagaatctgtaacaattaccaaactatacatcttacatcttttattcagatctttctcttgttcagccattataggaaaaacagcttattaaatgagtgattttaatgcaacttatttttgttgcctgagtttagagaaaaaatagatttttgaaaaagcaattttttttttgctaaataaaaacctttacatagtagcctaaattggtagaataattgaaatgaaaaaaaaaaagccttgtgaaattgttcccattggatttctgtaagtttggttttaaatcctcttccaaaaagtaacttgataaagtaatcaaaatctcttctatttaacttagtctactgaggatagaggaataacatatagtaattattgaaacagagtatagttatctgaaagtaccttataaattaagtttcataaccctagctttatgggaggatcttagaactgtttgcatcataaaggaagcgtaaaatgcctatgtacacaaaaacaatggagaaatataaacaattgcaaggttttcaatgaccgtttaacataaccatgttggagcatactactaagacattccccttaagagcactgcacatagttgtggaaagcattagggaccacagtggccaaaaaatgaagcaggataagaaggtgggtgtaatataagcaacagtagaattggtaacatattttaaattggttgtttcccagttatatttctcagaggcttaggattgccttggaagacctgggtatacagagtgggtgctagggagggcagagaggaagactcaacaaatgaatttggaacacactcactcccttatcagtcagtctgagtggtcagctctcactattttacacatttaaattccttggaagatgatctgtgtttacaaaaacaggccataactaaagcattctcaaataccaccggtttagaatttaagaagggtatcttgtggtagggagaccaagagattcagtagctattctctaaaattctattcaatctttccttgatgtgattaaaggctgtcatttatagagcaaaggtaaggatgcagatagggaatatggtgcaccccaagggcttcttattttaatggagaatggaagaaaatatgtgtggtttataaataaaatatcactttgtcaaatactttgattttttaagtcatgagatttatttacatttctaaataatatgaagggtgtacaatctctatattcaacaaagggagcatgccttttataaagtcaagaaatattgccttggccaggcacagtggcttttgtctgtaatcccagctactcaggaggctgaggtaggatgatcaactgagccgaggaggtcgagggtgcagtgagctgtgtttgggcaactgtacactatcctggatgacagagcaagaccctgtctcaataaataaataaaataaagaaatattgccttacaataattaaggttttgtttaaagtgcagtttattactaattaggctcttttattccttccttgctggaattatttattctaatgtttcgtattgactattttaagattttctcttatttaggtaagttgaatcttcctcaatagcaacttgtacttccacaggtacttcagcagtatcttggataggcactaaatctgaaccaaaaatttaaaacattgtagcttcatattacttatccagaagataaaactaaagtctttaattaataaaaagatttaaaaatatttttaatatttttaaatagagtatataaaaataactctatggccataactctcagactataatacattataataatatactagtttacaatgatatttctataacattaaaattaatagatttacataaaatgtctttcattacttcgtgctgtgattagtttgaaatagtgaaatattgaaatatatgcagatatctcattgtaaatatctcagtgttttcactgatacggtaacttaaagctggaattgactatgaacacaattttaataatatgataataagcataatttaaaccattggtgcttgtaaagattttgtttccaactgtttatttgcttgccttcttctcttcctcgctgctttgttaattagtatctatacagcaatattttgaaccattcattgacgtaattgtagtaggccatgtattatatagctgcttttgaaaattaagggagtatttagttttagttacaaagatccatgaagtatattgtctaaatcaacctgataattgctggatcagtattttctttattgttgtctgtggattgaacatagatttttaatctaaagagttcatgaaatagacttttgaacacaattgttatactctttcaattcttcaccattatgaactacaatagagttacactgtctacctttaagtggttttatagtccattgtgggaattccacctggaaatgtagcacagtgacaatagctcttaatatccattattgttcttgcatgattgaatcactggaagatgatgtatgtttacaaaaatgggccataactaaggcattcttgaataccactggtttagaatttaagaagaatatctaaccacatcagtatgtgcagcacatactgaggtttgaaacctccagtggccaactgattgattccagggcataacattgaaattatctgaatccacaaatctaccaaacgtagacggcaaataggttcatcaagacagaggatctgagtatattcacattctgccaggggagctttagggagataggtgcctctcaccaaggtagcaggaggaaaaacggtaggaaggaaattccgcggtcggcctgtgataagggtggcatgtagtccatggatatgtcaacatcctgccaaaacctaaaagatgctctttctaatggtgagtgattacatacaaccacaatgtttcccctggctccccaatgccatcagtaccaagtcgccacgatacttactatgttctctatgctgcttaaattatggccaagactaatttgcaatgaatggcctagcgagtaagattgtgggtacagtgttgaggaaatgaatgtgttaactttcaaaaagttcatgtggaattgaataaaagtgagaaagtaagaggtgtgatcatagaaagaaaacatgttgttggatgaagtttggaagtagatggtgaatcgatgaggcagaatcagtaagatagagtgattggttaccagaaagtacatctagcttattctaattaaaaaagatttaactatttcattatatgcttcctctttataaaagaggacttttacaatgtcagatcttactatttatgttgttggaaaaaaagagtttcttgcagttcaaccaggtaaggaaaagatgtgggaacgggccagttgatgtagggattctaaacaaagctgtgaaaatgaaacatgcagtacagggataaacagttaagaagcaaagaatatacatgtttaataggaagaaaagtttcaggatctaaaaagtacagcataacttgaaattactttgtaccctaaagatattgctgtacagcagtgtgcttcacctttcattgacaaatacagtcctttacattttgtaaataatgcaaaaactcttacactatccattcctcatgttgccctgtgctctgcacttaactcttttattttatttatttatttatttatttatttatttatttatttattgagacagagtctttctctgttgcccaggctggagtgcagtggtgcaatctcatctcactgcaacctccacctctcgggttcaagcaattctcctgtttcagcctcctgagtagctgagattacaggtgcccgctaccatgcccagctaattttcgtattttcagtagagatgggtttcaccatgttgggcaggctggtctcgaactcctgacctcaattaatccacccacctcagcctcccaaaatgctgggattacaggcgtgagccaccgtgcccggccaacccattttctttacctctctgttactgataatcatttcaccaagtcttctttctgacttccacttgtaatctggtttgttaggtttcttttctttctttttttttttttttgtgatggagtctcactcggtcggcagactggagtgcagtggcccaatctcggctcactgcaacctccacctcccaggttcaagtgattcttctgcctcagcctcccaagtagctgggattacaggcgcatgccaccacgcccagctaatttttatattttcagtagagacgggatttcaccaggttggccaaaatggtctcaatcttttgactttgtgatctgcctgccttggcctcccaaagtgctgggattatggtcatgagccactgtgcctggccggtttgttagttttctaatgctgcataacaaattattacaaattaaaagaatacctatgtatcacagtttctgtgactcaggagtccagacctggctttattgggttctctgctcagggcctcagaaggttgcaattaagttgttgactgggctgtattctcatctggaagattgcacagggaaaaatctgcttccaagcacattcaagtgttggcaaaatttatttatttgtttctgtgtgagagcagcccagcccttttgctagttgccagctggatgctacccctcaagacctagaggtcactcacagttctttgccatgtagcttctcaacatggtcactgactgtatcaagccagctaggagaaactctagctccagtctgctcagatggaggcttaataacatgatcaagggaatgacatctctaatctttgctattccctgttggttagaagcaaatcacaggtctcacctgcattcaggaaaggcgaatatacaagtacgagaataccaggcaagtggagatcatgggagccacctcaatctctgtccaccacacctaaagtccatactttagtcaaatatctcttacaatatttacttatccctttagccatcctgtattctcctcagtctttgtcccctttcattcaaatgatgcattctacaaagacccaaaggaaccatcagggatactccatattcacttcccaggagataaggagcaatgcatattttgagacagaaccagcaaagcgaaaatcacaacattctcctggacaaactatctctgctatctgggagccttctctgttgtgtagcactgatagcaaagcctcacatttggacattgggaagagaagtagccttagctcatgggggtgggggcaggggacaataagacatcagggagattccagacctttatctaatgggatgaatcttttcttttacatggaagagcagatagggaggagtggctatttctctttgttcagcatttattaaaatgaagcaggaattatattttgccataggcttagttcccagagtttacatttctgaggaaccatgattccacttctagggatttattcaattatcctgaactacatgaaagctaaagtaaacaatcagaaatttactttataactttgccaacaaaaaacttaatatttgattttgtttttccttaaaaatcatctttcaatggtgtaaaaatactacttttcagagtgttaaagaactgaaaggttgagcaattctacaagtagtggtacttgttcttggtctgggattgagaaatgttatccttattggccattatataacggcttattactctttattgcatttttgtattgagatttgtaatggtatcattttatttccaggagacttggcttatgttgctctttaggaacaaacatgttttgactagatataaaggaaaattaatttaaaatatattttagtgtagcatttcacctgtacagaagtattttcataccgctctcatttgacactgcaagcagttgtataaggaggtcaggggcagttgttatgaaggctactttacagtagaagaaacagctcagagagggcacaggattttccaggaatacccaggcaataaatgactaagaaaccattgaatctacctgtgccagctctacagagagagctcttccactccattcctggctagaacagatgagctttgtgcaaaatgggacaaacaccaaatatagagaaaagcatgaaaggaggactgttttcctctagcacttatggaagcaaaattttaattatttttaaaatttcaaatgaaaatgtatttacatttaataaatataaaactgacttgcatttgtctttcaaaaagaagttgcctgaatcacaaaagtatgattagttttcttttatgtgtcagtagattttgtaattatgcattattgtattgagcagtctgataagcacataaatcacttgaaatgtcagcacacagatgtgttgattttggctgccttaatgctgtcaagttacttttcacgttatgttatgagaaagaacttacaaagctacctttatgatcaattttagtgtggatttgaaatggaaggttatttgcaatgggaaaaggcaagtacagacaagtacatcctgtgtagtcagaaaacgattccatatctaagagacattaactgtactcccgttggatgcctcagctcaggttccattttgctttctagtagacattgattgatataataactaatgttgagacttctaaaaataaactattaagctatatatatatatatatatatatatatatacatacacacacacacacacacaccctatcagctgcaaaatgattttctaacccaaagaaatgtgaaaaagaatttttacattatctttctcagtctctgttgaatatgtaactatacctcctcagagactatagcaaagatacagaggtttggacacaaatgatgagtctgcatataatggacatatatatggataatgaggcaaagttgcagtgaccatttaaaagattaagctgtaagcagcaaatgctgtttgaaatataagccgcagatacacaaggatctgcacttttcagaaatggaaaattgatttttagcagctgcattttctagcacacctaaaaggtgatgtaggagatttctcctgctggtgaaaaattggctacatattttgacaaatagtaaacattaaaaagtcagcatactaatgtcaccagaaattaaagatagaacactatttggtagtctggctaaatcaaaatatttaaatttacattataccatatgaaggcatgccactttttaaaaagttataaaatgttaccagaatgcattctttcagactcacaaattatgtattggtaatagacttttatgttatttgaggttgaaacaaggagaaaccaagctatttgcaaatggagtagcctgcacagcaatttataaccagaaactgcagttttagagataaacataagaagactgaaaaacagaagcatggtgctagagggaaggcctgggaaagtctaatgatcacattttacagagaacctaaagtccagagaggttaaaggatttgctcaagtggagtacatggtgaaaacctaattacctttatttttaatatggcacatttaagttaaaatctccattccttagactgtaactttcttagcttcctgatcatggctcgttactaagaaagtcccttcccaaattcactcaaaccttccattccagcctcctgctcccatggttattctcttgtgtgctccagccacatggaaattctccttttccaaaccataaagccccttcaagatatttcacatttgcaagtgcacttctcctggtctagaatgccctttcctcttttctccactgtctaactcctactaatccttcaatgttcaggttcacctggactctgctggctgtcccttctacaggtattttgttcttacgcctgcaggggacccacctctgtgctacaatatatatatacacaagtctgcttgtcccactatactcagaccccacaagggaattttagtaacccgagtgcctagcacagagtagacactcaataaatattggattgatgcttggataaatacagtataaaaacggagtaaacagagatagttgctaccaattaacatgcagcataatgaagtgccaagattttcaaatggaaaagagcctcaaaactcttctaagtaatgcctctcattttagaactgaagttcaggaaagttagttaatttaaggtcaccaagctaatgcataacaaattcaagtttatatctatatctgctagttttagttctacaccataaagcatatgatggaagacacttggtaatataaactacatcttggttatttggaattttatcaatatgcaagagtttaagaaattttgcaagtattggggattgcttgatgactgcgctcttttaaactagctattgctttaacttttattgttgaagtggtttgttaattatatcctttttatttattagattaaaaaaagtggtgctgaacactttgtatacatgcttatttctaaatcaagatatttaaccactccttcacttttcccagtaagaattaaccttgtttttcaggttttatttttgtgttctacattgcagccctgtacttcgtaataggaaattttatgtttcactgtaaacctttaaagtaaaaaatgcatgaattccaacatcagaatgacccaaagcaagttggaacttgatatatgaaataacaatacaaacctattcacacaactatgaaaagcagatttaaaattgtgtaaataaaaatagtgaatttaaaaatatttttacctattattttatattttacctattaaaattatatataggtaattatatattttacctattaaaaataattttacctagtatagctggtgctaggcaaaatgaataaaacaatcaacaagagagttcagacagacataaaatcaaggccaatttacttattttacaaaggtaagttgtgaatttttcttctttgtacccaaatttgatttcaggaacagagataagcaagaaattttagaacagagggtgtttggccctatttgttactctagtatacaaacagcacccatttcccacagctttccaagcactgcaccaacatacagacaccacaattcaattcaattaaattctgtcaccaaaaaatattaagtgtaaacacttcatatttataagcaagagcaaagaaaagaattagagtctttaaaaaaatttgtccaaacaaaatttgatacaaaaatatacattttttttccagcagttatgcctcaccaagacttgctaaactagagaaatcattatgctagaacagaaatctagtgcaatgcctcatattgatcatgagcagttttaattatacttatttgtgatttttttcctctggtgtaatcaatttgcaaggaaatatagcatacgattagcatgaaaaagaatctagaggcaccaagcagaaaaagtcttctccattctcctacatttttccttttatttaggctggaatgggaaaaagaaggaatccagggagtgtttgaaaagagaatcgaggaaatttaaaaattgtagaaatcatatcatgcttgttcagcgtgcatgtttatggggtgtgtgtgtgtgtgtgtgtgtgtggtgtatgtttgcatacgtgtgtgtgcatgcatgtagcatacctggcttaatgctataatgtattatacatgaaagtaagctctgcattccccctctccttcaacaaaacacctaagctgtcctaggcagagctgagtgtgaatggattgtattttatgccaggaacagtggtgaagcagacgacatcccgtgcaccctgtctttcgggaccctcagatcttggttcacatagatagaattcaacataatgatctgcctggcttcctgctctgcaaacttccagctccaatgctgagggtacttcatgcatactttcaggttcacctcccagagtcctagacagtggacatttaaagccctgccatataaactctgagccaagcattattagaactgctgtttctctttgtcaccgtatgtagcttttaattgctgcactattgatttgtttctttggaccacaatcctacttggttttccagttgattccccggatgatattccaccatttcccaaatttaacctcaccagtgtttgctgagaaaagaatccaactactggcaagacatactcttatgcccaggtctctgctctatgatatagagagtctgtgtacttagagctttacctgttgttttttgccagatatttccagaaccccttatattccctatcccacaacctcactttcacacacactgtattctattttacacatactccatatagtatgccttgctcgacttgtctcatttctgcaactttccgtagcatctcttctgacttttttcactcttgggtccctgaaatttaatcagacattcttaacttcctgtttcccaagacgctctgaaccaactgccctgacttagcctccctttcttaccctgtgtccattgttcctctggcctggcctcttaagtcaatgctgagttcagatttgcatagactacctttccagccctagcaagagaatctaatctataccccttcttagtctcctgattctgacgcttacttggcaaattggcatcagactttatattctactagtttcctctacttgcccctagatccttatctatccatttcttacctggctgtgttaacccattcctattcctgtatgctgccattggctgtcacttccatgctctttatcttgatttaaactcagattgaatgaacagtgaaaaaaaaaaaaaaaaagaaagtccctgtcctcccacctgtcagattgtccctgagtttttggttctcattactactctttgaatctggggacctttcccccattgtgcattactgaaaaggcattaaagtcattctcattaagttttatcttttcctgacaaagtttgtattgcacaatgctgccaaattcacagtgccatggagtataacatgaagttcttaatactccaccttaaaactttggtctcaggagatctttttcttcactcaaacatttctttggctatttacacgtaatttttccttgctgtttatgaagaaaaattgatcttgctatattttaaaaacaaacttcaacttctgttcctgatccaatctctttcatttcatccgtcgacctatctaattaataagcatgttcctcaatacctaatatacacagactttgcagtaagttttaaaaatgcaaagattacagaaacatgattggagcactcaaggagcacgaaatctagcagcggacaagcatttgtaaacagattactgcaaacccaatgcgatacgtactatagtggaaggatatactaaagagactataaactgatcgttgggagcaaaggttctagaacctgactaaaacccatactagttcatatggttccttcaaagcaattataaaaaggcttttcactcgagcaaataagttacaaaaaagtacctccactgggggagacccatgagaaaaatgaatctctttcctccgggctgctgttgcagccactcaagagtgtacaatttgggaaacagaatacagactgaggcttggcttccacttgtgccccatctaccaggagcccttttgtagggtccaacctgaacaattcagcacagtggccaaacatgcatcagatagattgagtggaaaatctttattctgtcacctacaagcccttgaaaaagtcacatagcttctttgaggctccctgaattgtaacactgtacagtaatagaaactaactcagaggatgagtagataaatcatgtgaatacttatttcacttcctagtgatgaataagcactcaataaaattattattatacacgaaattactattaatcttattctagagatataaaaagaagtcaactctactacaaagagaatgccagggaaggagttacaaaaatatgtgatcctcatgctatgcccttaaatatgagttagaaatctcagaaaaaggaggaaatatttacagacaacagccaaaattctcaacaaagacaggagtattcaggaaagcctgggaggagaaattggagagatttgccatggaataattgaggaaatagaaagaggctatttaatgaaatgcttagagcccttacatttgagtttcaaattaatatgaaatatagatctattaattttaagttattaattgatatattaattttggcctcattcagtaatggaaaaataagagcaaaataaaatttgttgaagatctagctctgacctaggcattatgccatataagaaaagctgggagggagtggaagaacatattgggaagccaataaatattttttaattagtttcatcaaattttgatactgttattcatagttttaagaaatctttaaatcacatgtgttagattttttttggtaaaacttaagaacatgatagcattgatgggagataacttaattatatatagtttctataccggagcaggtctatctgccattttggaaaacctaattttgttatataaattatgaaatattgtagcttaaattgttatttcatgtttttttgccatatttattttgtgccagatgcagcagaaatgtagaaatttgaaaacaagtaatacaaaatgaattcggctagcagatggcaaagtcttctttaaaatgaatgacttaatgttagttatatggctgtagtaataataaaaaatgataataaaaagaggtcatgtgaaatacaaaaagtaaaaataaagatatttgattttaaacagtcctgttattagtttctgcttgacctaaagttacaatactctggggtagcagaattgtttaaaaatattcagaagttggctaatcatcggttactttgcattcacggatttagtgtttttgagtcatacacaaaaactaaatatatagtgtcagtgttaactggaaaaatttaggctgacaccttaaaatactctatccttcctcacccctactgaatatttaagaagcaaaaacaaatacaaagattatttcattccatccctggagttcacaatatactgttttattaaattacaaaaatattgtaatcatacacagagaatgatataatactcaaatttaacaaaagttaacattatcccatttttagttcaaatacatacttatttccaagtatgtatacacatgtacatacatatgtacatacacatatatttatatttaaatgccagtaccacagtgtgttgatttttctagcttcctagtgagttttgaaattaaaaagtaggaatcctcaaactttgtggagttttcttgagattgttttggctatttggggcctcttgaatttccatatgaatttcaggatcagtttgtcagcttctgcaaagaagccagttgagattttgttagggatatgttgaacctgtagatcaatttggagagtattgccatttaacaatactaagtcttccgatccataaccatgagatatcttttcatttatttgtcttccttaatttctttcaacaatgttttgtagtttttactgtatgagtcttgcatttcctttgttgaatttatcctcacatattttattctttttagtggtactgtaagtagaattgttttcttaatttcatttttagatcgttcatcactaggatatagaaaaccagttgacttttatatagtgatcttgtttcctacaaactcattgaatttgtttattagttctaatatttcttagtggattctttgggattttcttttttattaatttttatttatgtatttattatatataaatatatatatatatatatatttcaatctttcaccaggcttcagtgcagtggcgcaatctcagctcactttaacctccgcctcccaggttcaagcaattgttctgcctcagactcccgagtagctgggactgcaagtgtgcgccaccaggcccagctaatttttgtatttttagagacagagtttcaccatgttggccaggatggtcttgatctcttggccttgtgatctgctcatctcagcctcccaaagtactgggattacagggattttctatatacaagatcatgccatctgaataaagatagatttacttttttccaatccagataccttttatttaattttcttacctaattgccttagcttctgttgccgttttatagtaaataataaacaatactctataaatggttgtttcagccaaagggcccataaaaaacaaaaacaaaaaaaaaacacacacctcaagttaagctgacacttttagatggtacaatctcaggacagcaagaacgcagaactaaagaaaggaaaataggtaaaatgtttgtaagtaattgaactaactacagtttcaccagaaaacataggtgctgagttgctcagagtctccagagggtctcaagagtttcattgtgcattgatgttattggttacagtgagaggtgggaagggagcagaatgttatctattaggttttttccaatttcttttctcagtgatcagagtctgccctacaagacattgatgtcatcaaatttctgagctgtgttacccggcccattagggctactgcataggaacctatggttcatgtattcattagaatcataaatggtaagagaattcttgacctccgaagagtcaaattgaggcaatagagcccctatatgtccaatctagacctcaccctagccttcattccaggaggtcctgggacagttggtggctgtgtcagaagaaaaaggtaatgatggcaatgtctatgcagctaccatgggtacctttctatgctaccttaaagttaaaaaatataaacgttcatattcatctgcaatgtattatctcatttatattaatgttttcatatttgttcaataatatatttttgagatttttccaagttgatacatataattctattgtattcccattttaatcccatttagttatcaattctgttcatagactttataacttttcataattatttgctaaaacagtaatgctacagataagtttattatatatgtctccttgtgataatttatctcagaaatatgtctaggagtgcaattcctgaatcaatggctgtgtacattttcaatgtcactaaatattattaatttgtcctacgaagttgttaagccaatttggattttcatcagcagtgcctgggagttattcttgctctatctactcgccaacacctaacacttagtattgttgaacttttaagtttgggatgtgaaatagaatctaagtgctgttgtaatttgtatttccgtgattactaatgaaacttctcatcttttcatttatgtctcatcctacaaagagtttcagactctctgagttacctatgtctctcttgtctgtaatttttctatgggtttgtttgcctttgtaacaatttatcatagttcttaggacttttgtaagaatatcttctctcagactctatgttttcttttgattttgtttactatgttttagttgtatggaaattttcattttaatatagtaaaatgtgtcatttttatgttttgcttaaaaattactttctacttcatgtcacaaatgctagctttcatattttctcctgaaatacttgaagtttcactttttacatttaagagatttagcctatggggatttaatttgggatactgtgaaaagaaggactcattttctgtataaacagccaatttctgtagcatcttttattgagtccaacttccgttgggttgttctcatttccaatccataccaagctttcagatgaccctgtttctgtctttgttttgttatgattttctgcttgtctatccttataacagtatcactgtttaattgtatagctttacttattttaagggttaatcttaggcggcaatagtacctcaccctattaccaccactagccatgcagcaaattatctaggtttttcctggtccctcattttttcacatagattttcaaatcagtttagcacatttctccaaaattctgaaggaattttgtttttaaatgtgctgacttttagagtaaattgatatcttttttacattgaggcttctcatttatgacatatgttatatcttttcatttatttaggtattctgttgagttattcaaaggtgttaaaattgttttttattaaggacttcaatctctgtgtagatgcccattctgtaataccataaaaacatttgtcgttgtagtgaatgggtttctaaaatttacattttctatttggatgagcctagtggatagaaatgttacagatttccaataacaatcttgtatcaactaaccttgctaaactatcttattcattgtaaagtgtgtttgtagtcttttccttttctattatatcatatgcttacagcagcaattttgtatctcctatttcattttatatgcttatttcttttctcttgttattgttttatataaagtcttcagtatagcgtttaagacaagaggttgttggaacatgatacctgctatctgatttgaaggagattcttccagaatttcaccctgcatttaattttgctgtaaaagtgaataggaaatctgttattcattaaaagaaatcgccttttatttctaggtttagaaggtggttctttgaagaaaactaatgaaatggttaaaatgttgacaaaattatccaagagaataaagaaagaaaaaatattcactatgaaaaagtaggctgaaatatggactaagtagaaaaaatttaatataaacatctttatgccaatgcatttaaaatgtagtaaaaattgttatagtaaaagaaacattaccaaaacttactcagagaagttgaaaacccatatatatgttcaagagaaaaagcaagggaaaaagaaaaggaatcttgaatagacttataattaaagatattgaattagactttatagctttcagaaaacatatattctctgtgttacacaaactactccacagaagacagagagtgaagcttcgcaaattcttttgttaaaccatgacttcctggcaccaaaagtggataaagagagtacaagaaaaaaaattgattgagaatcttccttgtgaacaatgatgtagaagtctttaatagaatattagcaaatagaatacatcaacatttaaatatgttttctagtaaaggaaaatttatttcagaaatgcataaaatgttttcacttgaaaaaaatcttctaatggtaatcaccaagttaggaaattaaagctgaaggatgtagatatcttgatggtggtagcacaaattggcaaaaccatatttgaaaattgttcttatcttgtaaagttaaacattcgtatactcatcaaccaaaaacatcttactcctagatatattttcaagtaaaaattttgagtatctttaccaagcgataagtataagaacgttcctcacactgattttaaaagccaaaaactggaaacaatcaaatactaatgacaggagaagagataaatatattgtcatttatgcatatatggaatgttatggtgcagtaaaaataaagtaactttataaacaaacatttagttgaaccttagtaatataatattgagttttagaaacaagttccagaagattcctgtatgaaattctttataaattttatgacaagactaaatattattatttaggagtacattcataattataaaattatattttaaaaagcaagggcacaataaacaatttaggattgagtatacttggtggggagaagtaaaggacaggctaaacagggttaacataggtattgtcgatgtcacagttctcgggttggttgggtgatggttttgtattaattaattaaaaaagaaacctgcatgattatcttaatatgaaaagagatataatttcatagaatctgatagagtcattcatgatttaaaattttcattgcaaataaatagattagggaaagttcttgatttaataaaatgtgtctgctaaaaagtctatggcaaaaagcattctcagtgtacaaatgtttgacacattcattaatgcctgggctgtattaatgaattgttattattatttccctcttgaaaatacagcacattagttgtttgacatgaaagctttccagaaaaaaagtgttatttcagaattagtcttgacagtttacctttcaatctcccaaacaacaaggatatttctcgttcctgaagcatattgtcaacatgacaacttatgtcattgtctgttactttttaaagaaaatgctactctacaaaagagttggaagcaatgcatcccaacacaaggccatgtttttcaaaatacagagtattaatctggcagtataaatatatatgtgtgtgacctctgttcttagtgtcttaggaagactttcaggagtcatttgtgttgggcctatagtgattctgtttaacataaattttatgtcatagcttatattctaattcctaaggtaatagatattttagcatttcttgaaatgtaacagatttattcataattggaaaggcatgtcaaaataacctcttttaatacaataagccagaagcttgagacgtatctggtgagttgtttatgaggatagtttttttatttgtttttgttctgatgcctccatgttgattgtttccactgtaagttaattttctgatattatacttttagtgtcattctaataatttttacaagattcctcttttgtttaaaacagtgtttcaacttcattaaaaatatctttggaattcaggatccttaaacacttataatatataaaaaaggaattatacatctatttcctgttgatgtcacatctgatttttttcaaattatgtttaaaatgtcagcagctttgagcctgaagccttccatcaaatatcaaagacagttatgtaaaaaatgttcaacagatggaggtgtcttataaaattctttatttaaatctacaaatgagtcctcagttaagtgaactataacttgagaagtttttaaaatcttgaatacatatgcaaaaaaataagtttaatataatgagtttgtttcaagtgatttattaattctatacctaatttaagattgtggtttatgagctattttatagtaatagaaagtacagtgcatgaatagttttagagcttaagactgtgatttttaaaatataaggttatttggtgctgagtgcagaaagaaattagcccttgtgtaatttctgagagaggcatatatatgagtcccttaaatgtaggccatttctcaaaagaagtaaagtctaagcatcttattgctcacatgcagtcaagaacaaaatattttatgaaagttatataccttacattcaagccagaactttataactatagccatatatgttttttgggcttcatcatagaaatactcaggccacatcgtactgtaggacttaattaaaatatactcattaaatcatattcagattttatcagcattcaacatctggttctatactttaccatttattaagctcaaaagaccttggtaactatattaaggaaatagatattaggacctaaaggaaaagattgatgagattggagttttaagaatacaacagctgctccttatttctacagagaacaaagcaaatggaaattagcatcaataacagaagaagaatatacataagatatatatacacaataaataaattaatataaatatgagtagataaaacatgttgattttatgggtattcagtgagaaagtctataatcatgacttttaatgaggctctctaagactacaagtataatttatggtgactgaaatgctgaggaactagatagccctgccagatctgctggaggctctttgcccttgttatacaaatataatgctcacagtgttacggaccatgcatttgaatggaaataattcgtatcccttttattcctactatatgtatactctgatctttgaacaaaaaaattttttttttaattgtcatcctttggggcagtccactttctgtgtcagtggctcttaaccccagaatccgcaggcaattctgttcctgctgagtcatctccctcttctctcccctccaatcttttccaaactctctgctgacctgggctgtttttcgactgctaacgttgatggcacattttcccaaagcgatttgaagcatttaccttctgcttgatttctaagaggccatgccccttccacttcctttgataaggtcaaagggaaaaaagttacatctgggtttctttggattgttgtttttgttttagcctaaaaagcaatcaccataaaacatgcacatatccaactaagactaaaaaaatctagaattcaggctcacatggtctgatgaaacaaaatgatgtaaaggactctgtggacgatttacaaattgtaagaatggttaaattttatatcaacataaaatgcatagctcctccagcaagcacaaagcacaaaaatacattgtgtgttctgtcagttttccaaactttcaaggacctcctaatacttagttatgcaatgtgatttgctattacaatatactttactctgcggatgttttattaagttggtccaaaagtaattgtggtttttccaattacttttaatggtcaaaaccacaattacttttgcaccaacctatattttcagttcttatggtatttgccacagaataagatgcatgtagttctacatattgacacacaaatttgtatatagatgttttgtgtttggaaacaccagtctttatataatggctttacataatacaacactttgcataaaattatattcagtaaagtaattgtcaaagatatattcagatagtttttacacgtgtaaacaatcaactaaattgtagctacttgaagtacctgcaagtctgatcaccagctcactgagtctttagctatccaaaagatcctgacacaatgctgacctatacaacgttcacactgtgctatcaaaaaatactaaataacaaactctttcaggtcctacttaaaagtatgtaattgttttctaaatcacatgcaaattatttactgataattgtctgtgttttctactttatttgtgcagtcactgctgtaattaaagtacctgaaaaatctttattggatatcattatgctctttgatcaaaaacttgtattaaatctccattaatcaattaataatgaccctatcaattatagactaattcaattaaccaccaccctgaattttttattcatgtaataagtcaaagtccccagactaatcaaaatcaggcttgaaaggcaaataaggaagatatgttaattctgctcacccagggtgattttatttttgatgaactcagcagaaagtcactttcagtaatccagtaagaaaagggtgattctttttcctaaaactttccaatgttttatatttttcttcaaatatgctttaatctctctgacacaggtcttgaagaaattggataattagcctaacttgatgtcaattttagttacttataactaaaattatttgagaattattttttcagaacaatttcaaaataaaatgcatacaggatattataaagatctgctcattttaaaagacagaaattcaagttttaaaaaatatgtcatgacttaatacaagaacattatatttaatctttataatatcattttattaactccaaatgtgcttgttaataaggtttataattttggctgtttttatcttttaaactcacttgaaatttaatgagatcttgatggatggactttcattcgtatacatggagtcttagtgaagcctggttgagttttttcaaacactgctgacaactatatttggaaagtttccctggagctgataaagtatacctgatttttagtgttcctgtattatggttatgagtaaatcacatacattattttactcattccacttatgagtcatgactgctgcaggctttcattcccttcccatcatcctgttgatgatgggcacaaatttatgtgcattgggatgcctgttggtaactttgcagtctctgggcagtgtcttcctgtcactacagtgtgtgaactgtgacatctgaatcagggcagcagtggccaagactcagagcctgcacagcaggctagaggctcagtggtcatgttgccacaaccagaaacatcttgctgtagtcagtacttgacttcctaacaccccaccattcccatttgcagacagagtaaaccttcagtaatacaaatgtgacaaagatgaatagaatacacattggatgcattagcttacttaatcctaaaatatgaaactgttcattcagtagatatttcatgaaacatataggccaggcacatgccaaataacatagaccaagttgtctgcccctgtgattttacattttgacaagagaagattgacaacattgtgataatacataaattatataatagagaaataaacaatggatgttcagttatctcagcaaaatctccattgaataaaaaataacagaaagctttggattttggattattaagaaaataaataacttttctatattcagaggaaaacagcaagaggaggagagtcttgtgctttagaccagataaactgtactgcctaaatgtctgctgggcattggtagaaagtctaagaaattcttgcaactgcttgatagatggtaagggacaaagaggagcttatatgactggcatgtgacaaacaccaggactcttctctgtcatttcaagttaagtaaaggaagggaaaacaagataatataggtcctattttttaaatgtgcagaacaagaaaagaatagggatttttctaaatgtatgaaaaaaaaattttaagtgggaaatattctacggataaaaaaaacaaccaaatttcaagagcatatataaaaatatttttggaggctaagggtggaggattgcttgaggtcaggagttcaacaccaacctggacaaaatagcaaggcactttctgcaaaaaataaaaggttaaccaggcatggaggtgcatgcccctagctactcaggaggctgagacaagaggatggcttgagcctaggagtttgaggctgcaatgacctatgatcatgcacttcactctaacttgggtgacagagcaaggccctgtctctttaaaaaaaaaaaaaagaaaaaaggatatttttttctttatgacataatagaggagtaatagagaaggtaagattaatgctgagaaaataagagaggtgctatatttttccaatttccctgaaatatatttcaaaatatagattaaaatatatgttaaaattgcattaccaaaaataaatctataatattaaggacagaatggagaaactctctgagaatgcagaggaaaataataaataaatgaaaaggatgagtgagaaaatattacaaaaaaaaacctcagaaataaaaactcagcttttggacaactggccttctagaatgagacaccaaaaagaagcagaagcaatattttaaaatataactcaagaaaaccttttgagcatgtcttctcctagaaaacagtctgcagcttgaatgcaccaactttgttctgtccaaagcaatacaagaaacctttatcaagatatatactggtggatgatgatgattaatactattaatttctagaagaaagtgcaaaccttgtaagaatcactcaggtagggggatagaacaaagaagaaatagattataaaacaaatagtgttgaaaaaattatgttcttaaatatatatatatatatatatatatatatatatactgtgatcctatgtcacattatgtatacacataaaaccaagatggttcagtaagggcaagaaagaataaaataaaacttgaaaggaaaactcagagaaaattgtagatttaactgatctaatcaagtaaattatctttttagccatacaaaaatatgcaatcatgaaaacagtaattgatacatttgagtatagtaaaattgaaaacttgtgctaaaaataaaattaagtgacatagcaaattagaaaaaaaatgcaacaaatataacagaaaccacatatgatactatataaataattcttaaaaatcagcaggaaaatttctaatccaataggtaatagacaaagaacatgaaagagactatatatatatatatatatatatatatatatatataattagtgacactgaacaattaagaaaatataaattaaatgccacttagtgacatttatgtagattaaaggtaaaaatgccacttttcaattgtcaaaaatatacagaaagttaagcacacgtgttctcacttgtgtagaagctaaaaaaagttgatctcatagaagtaaaaagtagaacagaggatactacagactgggaagttagagggcatgggaagttaggtagagatttgataaaggaaataagattacagctagataggagaaataatttctagttttctataccactgtcagatgactatagttgactgtaatatattatatggtttcaaatagttacaaggaggattctgaacaaaaagaaataataaatgtttgaaatgatagacatgataattaccctgatctgatcattagacattgcagtatggaaacatcactagatacctcataaatatgtacaattattatgtatcaattttttaaaaaataaaatgtatttaaatgtaaaattttatttaaaaatgggattggtgtgtaaagagttattttatatagcagatggaagagtgtaattttcctgaagataaatgaaacaatgtgtatcacatttcaaatgccaggttcttagtgtctataaggaaacagttgcaccagtgggcaaataaatacacatgagagttgagtctgtttttcttctgatagtaaaagaattggaaacaaattaaatgaacatcaacaagggattggttaaaaattttcatattcattcatgcacgcacaatacggaatgttatatagtcattaggaattactattatttgtatgtttcttttatgtttaaaaggccttttttgtttatttttaaaatcatttcctttgaccaagtagccttaattatttgaatttgtgctgtaggaatgaagagatatgtggcccaggatgaaaggattatgattgtgtgggaatgttaattttaatagaaaaattgaggatagagggagtaaatgtttaatagtaagttaatgattgtaataactccttaaaatgacatactaggtataaataagtacatatatattgaaaatagacaatataaaaatattttaataacataattactattgaaatattaagaaataaagagtaaactaattgcctgcaaatatggatgaaaagtgtaaccaacgtctggtaaccaataatattttttaaaatgccaagaacaacaaatttgtctgaaaacatgtttgaattgggaaggaaagcattgattatatctcatggtaacagacttgtttttaaagttttctaataataaatttttctacagatcatatatcttattcataatgaaaaagataattaaaatttaaaatgttaaatataaaatattcataattatcatgttacctcccattctcagtgaaaaacgtgcagttgaactacttgcatgattctaaataaattcttttaaaaattaatagttataagctgacaacaatcataagttgtagttcagattgacatatggcactgttcatgttgtaattgcaggtaattgttaagtacaaaattatctcaattttgtattcaggcagatgatgcctgtatatttggaatgtctacaatatgccaggtgtcctacaaaactcacagctgaatgatcacttgagcttagaacatttgtttattgcaccatacatgtgtcgtacatggttttacatgtgaaaaaaataccataacacaccaatacaacagaaaacttcatcctttgacagattatttcatggtatgagtttttggttttagttattgtatttttaatatattacatgaaaaaagcaattgctatgttaagtgtcttaaaatgttgttgaaaattaaaatttttttagtaaaggggaaaatgcaataatgagtgctagaatgcttatgttatctggccttaatcatattttaaggattccaaactttagatcagaactagatcaaatcagatacaggagctgaatatttcagattattaatcacattaactagttgccctgcaaatatggactacaagtgtagccaacatctaataactagcaatattgtccaaataccaagtaccattaattatgtgccttaaatataactgggactagctacaattgttttgtgtaatgttaagataaaacattctgtatcgaaaccaaatgttattaaatacgttgcctataagtcagttttcaaatactgtgctagttaaccatattagcttcaaagtcatttccgtttaatgagttaattttacaaactctatgaagtcataaaatacacaattcagaataaatgatatgaaggcacaaacaagagcattttagatgtagctgagtggcacaattctgtgatgaaactggcctgtgttcacatttcttgcacacttatttatctgtatcacttttcattgtcctcaccccttcaagaatgtcttcacgaaaatcaacttaattttccagtctgccccatcttcttccagggagctgtgatcagggtgctgtgcagatgtctgaaatgaagtttatctttaacttcctcaaacaaatgctcacagaattctatgccatttgtctaagttagacacactctaaaaatatttatgctttgccaaaacattacaggatgttttacaacaaaaaagtttatattcccacagaactctcatgccatacttttttgtttactgttgaatcatttaatcctctctccttaagtatcctccctcttgttttcattcttagagtgaaataagtaactcaataagatttggaatctattttctcttttaatattactttaaagctatatctccattgcatcacaatcagtattaaaatagagatgcataatatataaaatttgttgttttatttattttatttattttgagatgatgtctggctctgttgcccaggctggagtacagtggcacagtctcagcttgctgaaacctccacctcccaggctcaagccctcctgccacctcaacctcccaagtagctgggactacaggtgtatgccaccacacccagctagtttttgtaatttttgtagaggtggggttttaccaggtagcccaggctggtcttgaactcctaagctcaaaccatctgcctctcggcctcccaaagtgctgggattacaagcgtgagccaccatacccagaacgttacattgtttttagttaaccatttcactcataaatgggaatttcaggtttttcaaaatttgtctactttaagtaaaggtaaaataactatttttgtatatatcctgagatggtgagcgaaatattttatgatccagaacttgttgctagaacaagctagtcacccatttctctgtatccatttccttctaacaagatattctgaaacatatattaaatttttccctcagatttcttaatttcatgatgttaccaaagtcttccatagtacttactatatagtgtttatatattgctatacctacttctgtacacacgataaatattacctcatcttattctcataaagtcctatgagaattgttatcctcatttctcagatcaggaagttgggaggtagagaggtaaagtagcatgtccaagatccttgaaccaacttggtaccccaaaccacccagttccgttagagtaggctgactcttagcatcaaattccttaagattggagaggattttttgctacttgccttcttcagtataaattgatggataccacattgacactgtgtttccttgacactgtgtcaaggaaaaatcctcatagaaaaactagagaaaggtagctagaattttctgctctgatacatagtgacattcatagccatgaactggttcttgtccatggaacatacttaagaaggagtcccaactcaattcagcaaaacgtttgttgagcacctgttatatataagacacatttaaggcagatccagacatgaagtgcatgcagtgcatgaagccaaatgtctacccatgagccagctcagtgccctaaatagtctgccctattttagccaaactttggggaggtgaggatctgaaagaccagaaggtattttgtccagcatatttgcagctcaactttcaccctgaagatcttcaagagggcagagcggtcctagaccagggtcaagaattaggtcctaaggaatgggcttttctagaatcattctacatggcgaattctggagttatgtggtctgagtgcctctcagggtgagttctatacatgccctctgtcagcaacctcatgttcagtgtgagttgctgattatttttgtactgaaagaaggtttgcttaggcctcgtactctaagtttaatgtcgcaaattttaggacaaaatccagctttaaacagattgctgactatttaagtggagaaggtggcttaactggaacaaaaaagaaaaacatttctagatagaaaaaaaaaatgttgcagaaggggagccgttagagtgggagaaaaacgtatctgttggaaagtgccaagacacacaacttggggagaaaacatctccacccagcaggaaacccagctgacttttaaaagtaccgcagaaaaggggatgttagaaaactcctcaatgcatcatcttagctaaggacttatagaagtttaggacctgaggaaattcagcctggaggttttcatattcttggtgacactgtttgagttcctgtatgttgactgcctgtgatagcaaaacaccaactccgttctttaagacttttttttccatgtattgagtgccagcaacattaagaacactttgaagaagagcagctttgccctgctgtctctgctcagttaggtttggatttaggacaacaaaagcaatctatattttaaagcccagacagctgaagaacagagaagaaattcatgataaaacacagggctttactaatactatgaatccaggattgtttttgtttgacttaaattgctgtcagtttgacgagtgtggtgatgctttagaaatttctgaaggagtcacagagagtggaaagaaatcattgagagaaaatataaatgatcaatggtaatcacttactgcaaaaatcaatgactgatctgttatgctaagaatctctatggtgcacctttgatttgaatctgtgatatttctctattcactgtttatttttggatcacacaccatattatgttacatctcttgatattaaattattcatctgtaaagtggaattaatatcctaccttggttggttattgggaggattaaatgaggacccacaagaaaacatttgcacaatgtgagacagcaaccatttccttcccaggatatcatagttttgccatcctgcattactgctggacacacaagacattttagataatataatacatgtttagaaaaatagccaaaaaatttgatttttgaaaatgtttaaatagagcattaaaggtggtcttttgtcctaatccatcacgcaacttgagtctaaaggctttaacacatgctccaaaaagttaacaaaaagctcatgtgaattcaaaaatattgaatattcacaggctgtgacacattggaaactgtttcacacctttgctgatgggcatctgtgtcactaaatatggtcttattctatgcattctctctagctctctcttctcattcatggcctgtatctgacccatgactatctatttgtggctaccttacatctcacaggatagaggacctgaaatagaaacaaaaggacatagtggttgaaagcaccaagatcacacatgggatcatgacagttaaagatgataagatcaaggatgtagcaaggcacttagtcataggaaataggtggaagtaagtggctattgcaggaagagagaggaagccgtagatcaaggaacataaacataaaaggcaaagatcttacaagagttgtctgcataaaaaacaaagtattctagatttttaaaaaattaacattatataagatgtgaaaaaatgcaggaatgaattaaagaaaaaaagggaaaataccgaactattctatattacgtattcttgatgaaaatgtttcctatcttttgcatgtcaattacattttgatgattttaaatcttactaaattttcatgggtctcatgctctttaaagtatgtgttttgcagaaaagaacacattatgagcatagactctacaagtcaggaatgcatatatttaatccttcttcatttttgaagaatatttgccttcctcctcaaccattttagaattgtaattttctaaaagggggttttcactggacaatgattactattactcaattatatattattgaattgattaaaatttatggaaacaggattgactaatgttccattgtgaaaatctaatactatttttgtccctgatgtggacacagctacagtgctatttttattttcattgaaatgaccaataaaatcagaaaattgaactataagtaaagttctggcaggtagtgatcaatctcaagaaggtcaccccaaccacatctgttctatctcagttacaaaaaaaaaaaaaaaacctgcacaaatagatgaatccacctaatataaaattaattggtggactgaaatcaccatgatttgacttcaaaatggtaaaaatggttgttcaaggagtcttgcactacattaacccagtggcaatatcaaaattataagccaataatagactcagtcattggtttcaaaatacaaataactagacagatttttgattttaggatatatatagttttattctcttgacatcaaaagacttggaagtttacaacttggttgtcgcatttaaagcctgtatttttcttttttttaaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggtaagtcagccaaatcggtttataaagttcagaagtggaggatcaaattacacccaagtttgattgaattaactgcttatacatctgtactgaaaatagtatccatatatactgaaaatatatgttaaataaaaagctttaaagaatagtactgtaaaggggttgcagtctggtatgcaatggtgcaacctagaggaaaaaaattgctttactgataatatttttcatactattaattgcctaagatctgactatctaagattcacctaatagtttataaaggtgatagaatcttgaatagtttctcataatacatatgtaaatagttattgctagaatatatgccactgtcattttcattattaaaataaattcctgatgttagataaaatgttctttggagaaaaatatttcaaagattaatgaaattatttttaaacatttatattttcttaattattgtaacaagtaggaattttagaaatagaacaattttgattacacagctcaacaacaaaaaactcagatgtttttctgctctgtttccttcattgtattttaattcataggtttgttttatttttcttttaaatttatgatctactttgaattttatatatacatacctctatacacacacactgtacaaatcaatgccatacaatttttatcttttttaatgtttagcattttgagcatcttttcatagtatctattggtttcagtatctgtgagaccctggagaatgaaagtgctcaaggccttatcaatgactaattgggatcagatgtttaaatatggcctcagttggattagtgaaatcaagttaattcgttgcttagagtcactatgcaaggaatgctagctttctgaagacatcaacaaaaactctcagatgaaggatttggaggagaatataacactgctttatacatgttaaatatttgagttaataattatttttatgttatgtaatccttttacttccttatggttattgcattattaactgacagaggggttgaaactatctttctttcttcaaatattcaaggcagagaatttataaatttccccagaaacactagggctgtaatggctgtttaagtgattcaacagtctacatttagttcacacaaaatttattttagaagagatgtgtttttagctttagatttgaaaagccacatctagtcacatgttaacatctcagaacacacccatgtaacatctcaggacacatgcacatttcacatgttaacatcttagaaattggtgtatcttacatcacaatttaattgagagcacttattctttcgtagatgaacataaaataatggcatgatttataatcaatgacgtcttaaactgaataaatattagatattttgtaaaattattttcaaacttattttgtgagctatagacaagtgtttgccatgatttattgcaaataactatttcacttcctgtcttttaccttttacagtaagcattctgattcagtgtatgtttcataagatgaatttttttaaacttcataagttatacaggcttgaaattaattttaagacagatgagtatttacttatccatgtgtaagattcagtaaacagcacgtctattatagtgaaatctttatatagattagtttagggaagaagcataaagaaaattatggttaaaccgttaaactgttgagatacttttttgtctccatttatgtaaaaaagtgatttcatatgtgagtaatttaatttttcttatagactagacattttcttgttaatgtgttttatttcattatctcaatctgaaacttacataaaatttttgtgtcgtttgatagagttactcaggttttctatatctttgctgattttctgtctacttgtactatctgttactgagaaaggaatgtggaaattttcaactgtcattatggatttgtctcttcttgccattatatcagtgtttgcttgatgtattttgaagctctgttgatatgtacataaacagatttttaatgtccttttgatcaaatcaaccctttttcattagaaaatgaacttctgtacccctggtactattttttgctctgaaatctattttgtgtgatattaatagatatcgattaactccagctttctttttatgaatgctaccttagcatatgattttttagtattttttcatccttttacttttaacctatttgtactcaatatttgaaaagtattccttctatgcagcatataatttgatcttcttttgtccagtctatctctgcttttcaagtggagcatttaaacaatttatatttgatgggagtattaatgtaattggatttaaatttatcatcttactatttagttcctatttgtcacatctatttttgttattcctatttttgcactcttttagtattaatcaaattttcagtgattccattttaatcgtgtttattgaatcatcagccataacgttttgctatttttgtgattgcttcaggatttgtgatacatattttaaacttttgaaatccaccttcaaatgaatgttaaggcccagaaacttacctccataaacacaagcaaaatagattatagctacatatttaggaactataattattataacatacaatttggacatgaccaaaataaatcttttttaaattgatgtattatacttgtgcatatttggggtgctacatatgatattttaatacatgcatacagtgtgtaatgatcacatcagcgttattgggatatccatcacctcaaacatcgaaccaaaataaatattattgttaagaaaaaatagactctactaggcaagttggaaaattgtgaaagtagattgatgcatactatttactaaaaataatgtgagctggaattctcctgtgagaccataaagcacactattattcgtataatgtaaaattttttaatgaaaccatttttatgttataaatgtatgataattggctaaacttagccaatttaactggtagttttaagaagaaatctaaccagtttgcttttaatattgtaactaattaggcataatgaagaaaagcctaagataaaagcctaagtttattatttactattgaagaagacaactgacaccaataaactgtagataaaaattcagtaattagtattatcataaggaaatcttttatggggaagaaggaattacagagcattaggtctctccatttttacatagaaaagaattttataaaacaaatgagaaaatgtattgcctaagttatttaaacacttgaaaatgtagtcattttatatgtaaatatacatatatatcaatgaaatatgtttttgataggtatcaaaataactcttttgctttattattactagttctactagatattttatgtatcatttcatacatcctttatagatgtcctcttctgtttaaaagggctcaatactacttagcaattaattttttctaacattgagtaagccatctcctattgattcttaacattatttttgtcttgttttccatgattactctccataagaggaaaaaaaagtcttcaatatttacaagtgccaattcaaccacaagctttcatccagacaaatataatagatgaattgaatgtttcagggcaaaacatgtgtctgtgagatgttttatagatgcacttttcaaacagaaatatgtataaacaaaagcttctaagtcttcttttgtgctgtttgtttttattgactgcttgctttaatagatttttggagggtgggtgtggaagtctaatgtagatccagacacaagattacttcagaaaagtaatctgaaaataaatgcagttttctaggtttacagtaagtggtataaaactcgaaaaatgtatcaatggcctttttgttttttattaatcagagtgactaagcctcagaaaagcaatgccgtatatatatatacgtatatatattatatgtatataatgtatatatatatatacacacccacacacacacaggagtatttaaatatatgtaataaatatacatgtgtacacacacatgccaaaagtcaactgaagaaaaataatactctgttctccttattgagatgtcagtttttgaataccctcctatagcattcacaagaattgcagtttactttagtattgttttttagctaatttccacattaaatctcttgtaattgagcctgtgatgacactctcattacagtccatacatttttattttccccttactagtctacagcattttctaacatttaactaacttttatatttctctacagcattaattcaggtacatttttatttgaaagtcaaatgttcctttgctcttatgaaagtgacatttgttttatacacttggagctgttttttactgcatttagcaggaaaactgcaaaacttgacaaacactttcagtatttaatttttcaggttataagccaaagtaaagcaataataaatttcaggaagagtacttatatggaaaaattagaaataaaaatgggttttctcatccagtatattagtcataacatcgtagtgtttaaataagtctgaattcacagcataggagctttcttttttcaggaataaagaagctggtaatactctatttcatctccctccctaaaattatccagggttttgtaaaagcataagttgaaaagttgaaactttacctggattttccaaaacagaaaacaaaatcccctgtttccaataatactttcttggtccttaaagaggaatcacacgtatattcatcaagaaataaactgcaatatcttggtgaactctctaattcagtagttaccataattgtctgattatggcactcatgaggagagcttgtttaaaaatacatatttctgggccctgcttcagactctctggagatgagctggaaatctaaatgtttacagaggccccagctaataataagcaagtgtgtgaaaaatggctaattgatgccaaaaacaaaattaaatttttgaaactaagtgtagttttctgtttttctagtgagaatggaatttattattattctttaggactttggcctctaattggtcagaggaagtcaatatgaatcaatgtttctaaaaataagattaaattttaataagtttgccaattcccttatgaaaatcacaaagtaaacactagctttaaacaaattttaaattgaaataatatatttaagtagcttaggatgcagattagatggggggatcatctagaaggaggtgaaatttatattcatccaactgtgtattcagttggcagattccatgtgagaaaaaaatctgaatatgacacagtctcccagtctaatgagaagctcagtaaaggtggaaaaattttgatttaatccgtttatttgggaaagtcaaaatataacctactaggtatattatttgataaaacaactctagggaagaagtagcacatagattatgtcagtttcataaaagtccatcactctccaatagaagaaaagagtccctggtccttttcaacctccttccctttctcaacatgggtgtgaaaaatagaagcagcaatatcatcagtccccattaataaagctgccagccatggtctgcattgaaggatatattcaaattcaacagtaattacagatgtcacagagcatcctgtcatttctgctgaagtgagtagttttggagagctgaaattaaatttgaatgtttaataccttgaaagtccaactcatgggtaaggcagaggtcagatgagtagtcaataatactcatgctgttcttttgaaatttgatctgggtgagaaacttagaacctgaagaatcccttagggagtaaataaaatggaattgtcagtggcaatcacagaggaagatgatagcagggggaaaagcaaagggagtgaattgtctttcaagagggagcagctgcatgtttctgagcagcaggatcaaggacggtttcactccatattgcatggagaccattagtttcatccattcagagtcctgttactcttttcaaataaggcagagaaggaaggaacggaggctgctttccaaaaagcaatttccaaaaaatacatgactttatacaaaacactaggattcagtaatagcaagtgaagtgtgcccctacatgatagaaattcatgtagtcactttattttacttattcagtggctgagtgacttaattgaaactaaagttaagaagaccattatattatttcaaatcgtctaaaaataagaacattgttatttatttatttattttaatttgcatatttttaacttgtgtgtgtacatagacaggtatgtatatttatggggtacatgagatgttttaatacaggcatgcaatgtgtaataagcacatcatggatattgttatttaaataaataccatttggtatcaactgttattcagaagtttctctgcttttctacttgtaatttaatattatgagacctgactaggatatgtgctggtatgcccaaaatagaatgggatgcttgtaaattttgctaaggcctctgaccaagaatgaaatgtatcaggaaatatctaagtacagaataattgacttagcaaagtgaaagtggtttgcaggcctagatctgcctgctgagttgggaaaggacaatctagttaaataaactgaattcagaaagcagcatattgtcatcaatgagtagtgtgatagcagttgtaaggacacagagaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaagtatgcagtaaccattgactagtggtgttagtccattttgtgttacgattaaagaaagccttaagactgggtaatttataaagaaaggagggttattaggctcatggttctacaggctgtgcaagaatggcaacagaatctgcttggcttctggtgaggcatcaggaagctttttttactcatgatggaagtcaaggagggagaaggctcatcacgtggcaagagagggagcaagagagagaggataaggtgacacattattttttaacaaccagctcttctgtgaactaatagagcaagaactcattcaatacaatagggagggcaccaagccatacaagagggatctgcccccatgacccagcacctccccctaggctacagctccaacattgaggatcgcattttgacatgagatttggaggggacaaatatccaaactatatcaattagaatatagcaaaaatttcaacccattttatttctaaataatcaccaaacaactaatattttgattgtttattatatgataaaaaaaaatgctcaaggactttagttctacatgatacatattgccatttttactatccaccatcacatcatcagctgcaatatgttaagcaattaaaagtctcccccttaacagtttcacaatgtcttaattaatgtggcagtatttttctactttttcacagtttaaatctgaaaaagaacaaatgatacctgtcatatatccatgtttatgggaaactataaaaagatttctgaatctgccactccctataaagttaatcatttggcaatgatttttacgtagttcctttggttgaatctcaaagagaaagtgtgttaatatgaatagagcactcttgggacaaatacacctgtaataagccgtgtggggacacttattacagaggcaacacatttctcatcatcaaaaaacttctggcataatttgagacacaaaactgcttaaaaaataactttaaccaaagatggattcagttattatacctgtgtgaagaggcagtcctctcggtttttctgaagctgtgagcagaggaccaaactcagaaaactgaacacaagaactaatttcctcatttccagtaaagttagaaacaacatcaattttgaacagataaatgaaatgtctgatatttaataataattaaaggaagacattcctcatatatgagtgaaaataatataacttttacataacaaaattgcacttttatttcttttcttctttttggtaataccccaatagccataagtaatagcaaagtttacttttctcttctgagatcaagcatattttaataataatatgccctcaactcattaagaaaagaaaaaagacccaaaatttagcttatcccaaagaagagttagtgactgctcagcttaggtctagcattcctcatgttcttcatatagtgttgccagatttggcaaataaaaatactgacacctagttaaacttaaattcagataaatgatacattctttagtataagtatattcaaaatatttgatcttgcaaccttgtttccagttaagatcttctatgtcttgtagctggaccagatggtctactgaggatactcaggagagaggataaaggagaatgactactttctgtgcctaggcaatacatgcttacgctcacacctaggcaccctgcttcagctgtacgattccactttgccacccctgcatccatctccaggattgtctcctctccctaatactcttttcccctcatcatgagtctggcttagaagtcacatggctgagtgcttaaatcacttctgtgttcatacatagagctcgatattaagtcatttctgacaaggatagggtgaaactcttcaatgagacttgaagtgaggaaaagtctcctaatgcgggaagaattaccaaatacaccaatttctctactgccacatcatttatatatctaccatgaagggtagagtcaggggtagagtctcaaattgttctgatgagatggaaaatacatagtgtgatttcagatgagagtttgagagatgagttttgagcttcaatagagaggcaagttgctctgtacttttatagaaaagaggaaaggcatttctacatttctcatgttctactaaaaagaaaaaagtagatgcccttactttccaactattcctggtaatatctcctggagatgtctttgaaaagcagatggtttcccaattctactttttctgtgggaatatttcttatggcagtcaaaatctgagtagtggaaggcagatagtttaaatatatagccacagtttagaatggcatattttatgtttcataaatctttataggcaatcatcctatgtgatatatttcctaagatattgtcattacttaaggagactttcatcataaaagaagttaaatatggtggtgtatcctacctactggcttttagactctacattctaaatgacagcaagcttggggaaaggaaggtaacagtcaaggaggatggactcttttgctttgatttttcactacgtctttttcccaaggtcaagacctaataacaaaaggtaacatgaacttcttagtgaggctcttggggctctttctaaagagctaccagctctccagctacttaaagccaaagttatgcaagaaaacagtccgtagaatgaatggagatggccactctgccccagtccctttggtctctcatcgggctgactgggatgttggcaattcctagctcaacttgtcactctcacagtggactagggaatcacaagtattgcctatgccagcttgccagtaatagacaagttgatactactgggcagaataggattccctaatcccatatctttttaggagcagttgaactcttctacgaaaagccagaagttaaatgttctaaaaaaaatactatcaaaaatgtgctatttcctcctcttttccaatactctcaaattccagaggatctaagaaataatgaattttagaaagctatcacacagttctctttcccaatgaagaaatatgttcccaaaccagctttcatgtcaactacatggaaaccaaagagaatctggcaatttgagaagcaatgaagggccggaaatgtggacttttattgccagggtagggaaaaaaacacctttgcctatgttttggccaattattattggaatctttcatttgtgcattttcagaaaaaaaaaatctaacagaaggagcagtagagtgcaaatcatgctacaagaattgtaagtgaacatcaaatttgtggtgtagtaaagaatttcttgggctataatcagagatttatatacatgaggaacatgaagcaaagccagattcattcagtaaagtatagtatttcttgaagccaaaaatctacttttttacatagttacaatagaaagcaannnnnnnnnnnnnnnnnnnnnnacaatgggaatggaaataatttttttagagaacccatatattcattttaatggtttaaatggatcatgcccgtgtgaaagagagactatggaacctgccccatgttttgtttttcacttctcccatcaagcaaaaatgttctataattagatttttgaagttaaataagcagtttgaaagcctcaggtagtttcatggagaaatcttgggaagcaaagaagtctctgaagcaaacagggtctagatttttcaaagggtttatggaacaaaacatcattttaaaaagaacatagataaaattaatatccaatatgaattatggtgcagaattattatatatatgaccatgcacgatagctttaagaaaatctgactgcagtttcttaagggatttcaaaagaaacccaagtagatggacaaagtagtatttctcaaaggacctataagcttttatggaaatgatattaaagaaatacaggagaataaagaagttggattttttgttactgaaatatgcaagaggacaagtaacactggttgtttgatatgcttattaggtttatgcccatgagaataaatatcatccagaaattgaaaataagaacagcaagtaaaatagagagagtagaacctaacagtagaaagtttagaaagtatacttatgggccaaaataaacaaatttcaatggattgtcctttgaggatttattcaaagaatcagaatagaaagtaagttcacaatcaactttaaagcctgaatgtctgtcacacgctggcgcatgatgttggggaagttgtagatacaaccctttcagacaattgaggttccttttccaactgtcaatgtttcagacaacaaaacttagatgaaacctgtagcccttcaataccaattactcatcacaaattcaggattccctaaacccaccctcacttttgacatcaattgcacattcacagttccccaagatcattctcaggtttgataattcaatagaaaaactcacaaacacaactaaaattatcatacagttatcgtttatcacgatgaaaggatatggatacagatcatctaagggaagagacatatggggcagagtccaggagagtccaggaatgagctttcagttgtcttggagacttctggagagtagtaagttctctcagcaatgttacgtgacagtaagcccagagtattgccaactaggaagctcaccttagcgttggtattcagagtttttgtggaagctcctacatttagacatggttgaccatctgtatggctaaccttagtttcctccttttcagtggtcaagctgacctgaagaccccactgtaaaccacaatgttagcataggctatctggtgtggcccagagccccctgggaaacaaaaatactcttctcagacaggccattccaagggcttagagattaccttcaagttgctgagggtgaaaaacagactcctccttgggtaaggttaacatctactgcacactcgtattacacacggttttgtagactgtacactgatcactggaatgacatgtgtctgtaaacgctatgcttacactagatttgacacatcctaaactctgcagaagaactgttcaatagaaaaaagatatgatggtcagcaatttacttcaagatagtacacacaagcaaactcaagattaagatgtgtctagatatgtttcttgcaaagaagacaagatgatcaactccttttggatacagaaaaataaagtgattgtctaatatgttacaattagtggttgatatgaaaacaagtcctcttcgcatttgatctcttatctgtagattacacacattatattttcacaaactgggacatgtaactttatcattgtctttggctctactttaaggtcttatgtatacattttggttgaattttttttcatttgactttcacctgctgataaattgtttcggttagttatgaccttatttcagctttggagggtaatggttccactcaggatgctatgggatggaagacactgtggtagctctctgttcctttctgtcaatgacaatttgtgctgtagtgttgttgggctgccctgtagtgaaggctgatcccccagctcattctgcagactgatgatcaatatagacacttattaacaaagtctactggctccaacagaaacccctacttttttggtgaccctcttagaatataattctcaatatcactattttccaaagaaacatttcttagaatattgaaatttatctggaaatgaatttcttgtttccttattacatccggaagaatgtactcatattgaggctaattttgttacagagtttcattggtttagtggaattgattgcagagaaaaacatcaagaataatatactagccattcaatcatgaaatggtttcaggatgctggtaaattttcctagaaaattgaattcacagaatgatagctgcagtctattttggctaaaagaattaaactttggtttcagactttttatagccaatcacttatagaagtttcatacatgcaaagcttccaataagatttgtttaatatgatatagatgtataccactaactaaaatgtttaaaaataattttctatatattttgatatttttttcctttttaataaaaaaaatttgatttttggaatgcttgcatatagggcaaagtagaacataaattttagattatcctaaaatattactgaaaatctagccctagaattagaaacaaagaaagctctttcccaaactgttcaaatggaaaaatgttatgtttgacgtgattcatgcatactaattccgtgaaaattttcataagactttacatcacttaaagcgttgattcaagttgtaactctgaaatttttgacagtcaaaaaaattgaagtaatgttgacactaagtatataaaaataaattttatgatcctgaactataaattaataagcatctgtcccttatgtcagccacaaaaatcagaattatatacttatataatatataaatggttgctttataaaacagatacaagtaaaaaaaattggaaaaccctcactgaggagaaattatgaaaatatccaaaatctatttgaccataaatcaatcaactataacccaaaatgcaatataattattctacattttagactgcattgatagaaatattgcatctacaacaaaggcgcactctatcttttgagttattcacagtatgtctacattctgtgtcccaataaataccacgctttcactgagccatagttaaaacagatgttagtcaatggaatgcaatcaagattataagtctgaaaatcatgcaacatgaggaactttttaaggaactatgaatgtttagcctagagcgctgaagttgagtttttgagaggtttgtgtcaattattgttaagtatgtcaaaagttcttttgatgagctaagtttgttctatattcattgagaattaagcactagattcaatagactgaagtgagagatacacattttagtcttctaaaaagatagactttcaaactgtctaaatacatacctgtcctattgtattgaggcatgccatgaataggctgaaagttccatgttagaaatattagagggaaaagttattgatagcagatctctgagttctcttccagatctcagattctttcattatatgggtagaattagataaaaacagggtttctgaggatcagagctaccaaagactgttcttatttaacttctccattagtgctctggatgaaagctcaaaggattgaaattatgtatgttaaataaagaattctgagctttcagcccagcacctctgcgcacacacacacacacacacacacacacacacacacacacacagacacagacacatacatgctgccctaggaaaatggatctttacctttgtcctctatcccttaagaacagcaggtcagtgtacagatacagtcagtaaggccagtggtatgcttgataccataaacaaagcaaatacaatcaatagaaaaaactttagaaagtctcactcaacctttatatttccacaatatctgaaatcccagatgcggttcgactatagtctccaaatagcagaagaaaaataatgaaatctataagggggcaacaaaaacccagagggatgaagtgatggtcacttgaaatcttaataaaatactggtgtttaatactgatgtaaaatgctgatgtttagccatagggaatctatctaaaaatgcttagaaccactcgctatttgaatgatgtgaacagcaattccaaaaagttagaacaatggtaatctctttaaaacttttaatcagttaagtttaggacaaatgaaaagaagcacatttttacaaactagatgattttctaaagaaatcatatgtgcaagaagtccccaagggattctttgatatttagagtcctattcgatgactgctaaaagaaactgaaatatgccccacctctctgactacatcgtggaggataatgttactttgttccatgatccctggaggcctcctattgatgtctataccggcctgaatagaccgtagtcctaacaaagaatggtagctcgtcttataaaaaatgtattaatgctgctagaaacaagattttattgttttattttatctgatattctctccgtgctgagatttgaatcctctgaagaatctgatttgtattttcaaccagcatcacaagagagttaaccttaggaaaaagaaaatcaagatagctacattgagggagttgtatttttctttctcttatcttctcttaggttgtaattatggaagcttctgcaaagtaccttgagtgttttttgatcaaggccccatatgttagaaaaagcctgagagacctctaagcaatatcatgtttgaatatatcagcaaatttgtgatcagctaattagcctccttcctgaactggaacttgtgcatagtttttctaaaaaattctaaattgaactgtgtctttctcatgtaaaatattttcactcctatatagagatttaatgttctctatcagtcttttcagacttcagttttagttcagatgcttatgtctctaaaatgtgcctgtgaaagcactttctagaaatcttagagattttatgaagttaactaaaaatactgtgtttgcattcctttgcaaggtgaaatatttaggtggcattcttaagcaggggcttcctagtgcttgagataagaaaacagcacatgtgccacatgtttacacaacaagtacaaaatatcatcctggaattagcaagtgggtgctttgtgttctgtacgtgtcattactgagaggcctctgaaaataaaaatatattttcagtactttgaggctgtaaattctgtgattctagtatagatttcggctgtttttctgtgaacgttattgttttattaatcatcctgtttcgtgaaacttcactttttttaagtgaacatgcaaatatccatgactttcacatattaaatcagaaatttcatagttgttttcagttccagagctgatatagtttctctgtatgtattcttcattataaagaaataagtataattaataattcaactaatactttctgggttgatagttcgcatcaaaacctgtgctggagagcagacacttaagagaaaattgtttctttctgtatttccttcccaagaagtggtataaaactatatttcgggctgttataaatcttgcaatgaaagttaatgaatttaaactctattatcccagagatatacattaagttcactagcagggctacaaaattggattttagattccgtattaaattgtaataccacaatctcagtgaaatatttgaatccaacatcatatgtcagagaggatgtcagtaaaccagggcttattttctgctgttgcagtagcaacagtctctcaagatttttggtgagtgtttatgatatgtcctgtacctgtgagttttgctaacagagacattgtaacatagtagtagcacatttcagtccagaatgaattattcctttgtgcaagacagggcattactaagcataaaatgcctgctaaatgaatatgaatttagatatgccagcagaaccagcagagagacttttcagtcttgtctattgctcctattaatcagtgccgtactgcctaatgcttttgaggagaatatgatttttttctttccaggagaacatttgtggccgtataagactgaaccaatctagcctagaaggcttttaaaacattccctttaatttcagaatgctgaaagatgtgggttaagtattactgtcatgtgatgatggagtttggttgttttttgttttctactttaaggattttatcttcaggtgtctctggccacatagttatgttttgatgccaaacaagaaagaaatttgatgtcaaacaagaaagaaaattatcttctaattataagatgcttcataaagcaaaaacagaaagcgttgaagagatttttactctaaaaatttaaactaaatctaaaaatctaaactaaatctaaatttttaaaaatgtagatataaaatagttagaaatcactttaataagaaatgttcagaatctataagaaaaaaaggataaaatcttcagataaagactaaataatataaatacctcagtttaccccaacataatttataatttaatgccattcctatcagggacccagtgttttaaatttgttttgttttctgaagcagacatttgtccaagttattatgaaagtcttttggggaagagcaagtggccatagtaatagtaaagctccaaaaaaaaaaaaaaaaagcatttttacaaaagaagaaagaagaatagacgtgcaatgcaaagggtcaggatattataagtcatattcatcccaatagtattgtatggatccaggaattaatagatgaagccaaaaaagaagagaaaaacagttcaaaaacagcattgattgtgttgtctcatttggagatgggctagttttattctctatgtgagaagaagtgggcaaaaggcactgtgatagaggccgttagtgctcaccagatagccttgtgcttctctccagtgcccagcctcctttgctgttaggctggagtcatataattaggtaaggtgaaacagatatatacagaagtgatataagctgcttccatgcttgttctcttaaacactctgcacagtctgctaactctccctccccttgccccttgtgaatgtggaggccacctgctccagatgatagctgtactttgcaagcagcttggatctctgagtcaccccgtggaagagagcatcttcagcaagctacatgactaacgtcagcctgtgacataagcaaaaaatgaatacctgttgtattttttttaattgagagaaacaagtagaggaaaatgatagacctatgaatgtctgcattaaacaataaaggtttaactctttaaacattaattgaccatttaatttaaaataattattattaaaaagaagctgcaatatattttgaagaaaagaaaatgaatagttatcaaatatcatgtttggggaaaatgttccaaacaggaacataaaaataatttcaaagaaagaaggctgtgtgactgacatttttctgctcttctttattaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagttcggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggattcttttgaagcagttgtaattaaacacatttataagaatacacaaattgtctgaatgtgaatgcccactactcttgaccacatacttggttcatttttgccttgcacaggacagttgaacggatacagaaaaaatagaaattacaacaacctctaaatatatattgatattagctaaactggtcttttgaagattattaaaatgtatgcattcttcctgctccttttagatgcagaagttttactagaatattcttaatccaaagtcatttttggcctcatgtataaagcattgtgcaccaggactgatctgcccattgttaatcagatgatattgctatcatttctatagttttttcagttcatgatgctcaggagtatgatgaagaaatccagtcagtagtaagcaataatataacagtaataatgtatttatccatgtaacattagctattgaataatgaaaatcataacgtggattcttcataaatcctgtttctagctctctggaagacactggtgaaatactaaatctgtgtacttgctattgttttgacattttcttaggatgcaaacaatttagggaggaattaagatatgaaaggttactacttatttgagcttcagtgagtttctgatagctcccagaactgactaatcacgtttatgtactcatacacattcccatttaaatgcattttaatatcagcagatcaatgggattccgttgtttgcctaatttttgcacatactcataaacaaacaataaatgtgcttttattaaataagagaaattatacatataaattttcagtagcgctaataaggaatcatgacaacatctatacagggtacaattttattgtgacagcaaaatatttaataattatccaacagaaaattttcaagtataaaacttttaagactactgattctagattcaaaaataataaaagcatttcaaattccaagaagaaaagtctgcataggctgaaatttgtgttttttataaagtattactaataacttcatgaatggaaaatattatctctatataacctgaattttaaaacatctatcagctttgcacacatgactttaagattttgataaagaaacattaatgtttactgtcagaaattcagtgctctctatctcttttcaaaaggctaatttttaaaaaattaacaatcactttagtatgctatttatttgtgaaaaatattgcctctagcctttgagatgcaaaaggatccttttatctgcacaggtaaaatagaagaccaaacaactttgccagttgagaaatgtttcaactaccctgaaattgaatgcactgtcatttgtctttacaaagacaaagaatacctagtggaagtagcaatttttctattgattttgaagggggaaataggtttcttgattctattgcaataaatgcctataattcatattggctgtttcaacattgccaccaaataaagtgttttccacagtaggcaagtgcacttactcaaagagttatttctattaaatgaatttggtagcagaaataggaaaacataaaaggctccacgttcaacaatttttgcataacttcgcagaagctgattgagtcatgtgaaagcactaatactttggaaatatggtgtcgaaccatcagcaaatggccaccgtattacatgattaagcattgcatatggtgactgcttccgattgaattttattttaatgtccttaaaggcatgaaccacgctgctccatatttatgtaaaatccccatagtgcccttcatatatccacacatatgttaacgatgataaattacaatgtaacctcaacctgctgccacctgtaaagggagtggtggcagtgagaccaatgatgcgtctaaacaatatatctctggccaggcacggtggctcatgcctgtaatcccagcactttgggaggccgacgtgagcagataatttgaggtcaggagtttgagatcaacctggccaacatggtgaaacccagtctctactaaaatacaaaaataag

SEQ ID NO: 16002 - DNA, 51773 bp, Human
  misc_feature (1)...(51773): n = A,T,C or G
acctgcaagagtcacaaagaagatgcatccattcaggtcacagagaagtaaatactctagtgtctaccttctaccttcttattgctctctagtctcccattttatctagactgctgacaagcatgcagtggaaggtgagcaccagatctgagaggaaacaggcagtgtctggtggcacactacacaagaactctcacaggcatccactaggcttgcttggtgactcatttaaggagtaaccctattttatgtatcagagtagtctatggtgtgatatagcatattgctgcttttgatgtttggtttcatttgttccctgtaggcacctaatcactgttttttaaattccccaggagattctggtatacccaatcagctgagaaccactgaatagtggctttcaaaattttgagcatccaaatattgtcttcacagaaaatcttaatctctgaagtctactgtaaaaacatagaaaggcaaggctgttctgcttgaagcgtagcttgggagcctagattcctctcaaacccaggccactcctgggaacatggtctggagatttgaatgttcccaaatctagtttatctcattagtcgatatttatgcacatcctctgtgtctctcagtgttctctcatgtgtagacatatgccccattccaaagagtgactgtagtgtaatgtggcattaaaggaaccctggatagacctgtattggaccttacatattagagagctctgcagatagctcacaaatctccaagtcgctagctgtaaattgagtgataattggtgtcaggttattttagcacagtttggggataaaatggtgcattaatctcccagtttgtggcttattaaactttgaaatggaattatttgagacataaaagagatagcaatactttgctggatgttctccattagtcgagattgttacagaggagaaatttttgccactgtttatcaaatattttttcctctagttaatccatatcattccgggagctttgcccaggaaaaggacgaattacttgcgttcctccgatctctttcaagttctactcccgtacctttaaactgtcacacggaatctttggtgacagaggaatagaggtgggcaagcagggcgtttggaaaccatactgaaaacgaattatccataaagcacagattcaccagcctagaaatggctctgtctggatggattccttgagatgtgttttatctccattaaaaacacaacaactttcaaactttcactgtgtctcaaaatgatagagaaaaaaattcagcctttcaagtattcaagaaaagcttgaagaaataaaagaaactcgctgctctctgggccactttaggaggcagagcgttcctggagaacttcaggattcattcgcaagggaacccaaggtgggcattcaaagccgatccaaaggatattcttctttttagaaaacaaaaggagcgcaaggagtaggggactgaaggtgcccaaagctagtgggtcagtgtcactttcttcctccctttcgcccctttcctcccgctcctttctcccctgtggtctctgctcagcacccctttctctccagccccgactgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggccgcaccataaagcgcccggccgctgccgcggagcccagcagccagctccccagcaccgcgcggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccagggtaagtgggttcgggtcgggcctgggagcgccgggcaccgggtgccccatctgctgagtgagtggagggacttgctcggccctgtgctcctgtggccttgctcagcccctctctgtccctcccgggcccaatcaaagcatattgtgattggaggtagtgattagtctagaattttccgaaattcgattatccaatgatgagaacaattgcctaaatagttgggggatgcaaaattgtttcagactatgcaaagatgtggggtggggttgccttcaaaacttgctacacggtcctagacctcttaacatgttaggctctggtgtagggtgaattccgggtcctgcaccctgtgccggttccctccaggcagccttgctccctaaatccttcctcaggcggagcgatgtatgcccagagtctgctcttgacatccctgagaaagacgcagaattactctacttgccctgccacctgcattttctgctctgactttgcttgaacgacaaaaagaaagtttatttcaaggattggcttgatgtcttaatttctgaggtaaataggaagggctgagaaactggtctttttcaatgaaatcagttctttgcagcaagatggatgcagctggaggccattttcctaagtggattaaggcaggaacagaaaagcaaataccatgttctcacaagcgggagctaagcagtggatagatatggacataaagatggaaacagtagacactggggactccaaaagtaggggggaaggttgggaaaactaccaattgggtactacgttcactgggtgatgtgttcactagaagctcaaatcccaccttatgcaatgcacccatgtaacaaacttgcacatgtaccctctgaatctataatttaaaaagaaaaaagaaagaaattgatctttttctatgaaacggtaaaaattcaacaaataatgtgaaaagatacttggacaatcctcaaaccccttggtgaaatggggtgaaatagccattgggtagaaagcagttaaacagaattttttgtaaagaccaaaaggaagacatgatttaagcaaagaaagatcttagggctataactggccctaactggtcaggcgtgagcttcatctgtttgaacttggtgcctgggttgatttattactgactgtggaagtaaaactggaagagacgcacaacttgaagtaaaagttgtttttcctcttgtagccagagcaaagactgcctatgagggcgttctcaacttccctgcctctcgctgctggaatcacccatttaaactgcatttcgccaaataactcattttcattccagaccagacaaccagaactgtggtttcaggggttagagtactgctaacttttagtttgtgttgaagtatttgaaatgctgtagtccgtgccccatacttctaggaaggtaaaaaaggaagcttttaaacacttcaaaagtcttattgtgatgatatttggcaagttcaaatttataggtataatttttttgtgttatatacgttcttgacttttgaacatacagctttatggtgtgccttaggtatgtctcagacatacctgaccattttatggagatttgaactcggcctatacaacctaaattatctgggtaatttagttgctgtagatgatctgattaagttaagtttctgatagattcttttattgcattatctagtctgcaattatcaggcttaacaggataatttgattatctccttcttcccctgagcttcattgttggtcttaaattagtatatattcaatttacataccatggtagctgcgctcattggtagcagtaatttcacctctaacagtagagggttgtgctttgatcctggcacttaaacgtaataacattaatagaaaatggtagtgtctcatttccttttcaaaacactctctatgttcattactaactaatcccatctctgcctcttgagagagatgcaaatgaatcagacgaaccatagattgaaataccgcaagtttagcttgagttacatcatgaacctgatcatagtcaaaggaagaatcaagagtactaagaattttgttttgaatgtagttcccatactttaaatacatatctcttttctgaagatgttttgtcctgaatggaactttaaaacatattgccttatttccctttgccctcattagtggaaatgtaaagtttccaattctcttgaaaattaaaaaatccaatttcccttttgaaatgcagtaggcaacagtgtttatggtttagggatataggcactaagaggagcacagtaaatgttctgctttccaacacatctcatgttaatttcattattgtgtaaggacccctggtacatgtgaaaaatacagtatagatccagtttgaagacaaattgtcttttaaaaggggtaaatattcttgagtaactaggtttttgcctgtttgctttagaacttttattcattcttattacaaaagcaatacctgcccattgtagaaaagattaaagttagataagcaaaaaataaaataaaaagaaaagaggaaatttaaaacttatatttatgcaacccggggatagcttctattaacattaacatgttgttgtattgtctttcatttcaaatatttttctatgcaaaaatatatttcaaatggaattacgttatacatatagttttagaatccttttttcttaatgtatcatgaacatcttttcacatctgtaagtattcagctacattttaaaaataggtagtattctgctttttggaagaatcaaaatgtatttagccagggttgtaatatagaacccttaagttgttttcggttttgatattgtaaatattaatttattgaacaagtgcaggtgtcacaggatggtttgggatgagtttaaccatcccctcaatctcagccaagcccttctctttttttttgctaaggacagttaatgttttcatagcaaaatgctatgccaacagagctcaggtttacctctcttccaattagattttcacctaattctttcctaaatagaaattctagaattaccactagtgtctaatattcttgtacctaaatcatttaccatgttatccattatttccctaggataaattcccataagcagaattgctagatcaaggagcacatatgttttagggcctttgatactgttgtttaaactgtcttcaaaatgtttatactagtttaaatgttacacagtggtacagagagtgcccatttccctgaaccctcacaaacagttgagtactgttgtatttactaattttccaattcgatggtgaaaacaatacgttattgtttaagttagcaactcctgcatcattaggtaaatacatgaacatttatttatatacttaatggtcattgtaattctttttatgtaaattgccttttcatattccttgcccatttttctattaagatgcttatcattttattgatttgtaagaactctttatcaattgtcaatattacccacttaataaccagattattatatccaagagacagctgtaggtgctgaagtttctgcagcctatggaattgttcaaatgatatttgcgtctgctaatagatatactaaataacttccactgagtattacccaaatttggcctttgccttttaaatgactctgggcatactctctcatagctttcataaatattacaaagtttgtgagagaaagtactgcttgcttgatcaaaagcaacttatacaaatacaaatgcagattctgatttttgtagagcaattctatcagtcaagagacagaaaccacatcattttgttttgttttgtttccacattgggatttttttaaacagagaaatgttggagaattgtaaaggcacaaagggaacacttaggtctcacaaaggtggcaaatcactttctaccagcacatctaccaccatagccatgttttctgctgcatttcctgtcatttgtcactgaccaggaaaacacaattggctctggtcctggaggtgcctatgggactccgtgacagaaattcactgcttggggacatcagtaaagcaatggcttggatgctttcaccagtcccccttgtactttaagcctttagtgcttttcctggtgggcattttcagagctacttgttcagccaaacccaattatgtgtttgcaaattcagtcctctctcttgagggctacacccagtgatgaatattgtgctgtatttcttctggctcaaatgtccagccactataaaagtgacagggaagaactggtgagtttggcaatacggaaaagggattacaagattagtttacattactttgtagcttactgtcaaattgcaccccccccaaacaaagaaaccctgttttccccaaaattgaatctttcacttataccccttcttctcccttcttcccagtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaaggtaagcaaatttgctgaaattattttcttaaaaatctcctttttctattccaggattaggggtatactgtctttgagatggtttccttgtacaattatattctcactcactagtcatttcagtttttaatactgaattcttcttactgtacatttacctatattggcggggggtggggggcggttcaggaagaaagtgacattgggagaaaaaaagaattgctgtgaccaagatgctttttgacattgtctcatcctgatgttattctgaatccagttctggaacagagaggacaagggacaattcagccattatcttaggcagctcaggctgctataacaaaataccatagactttgtggcttaaacaatagacatttacatctcacagttctagacagtggtaagtctaagatcatggtgccatctcagtccattttgtgttgctataaaagactaccggagactgggtaatttataaagaaaagagatttatttagctcacagtcctgcaggctggaagttcaagggcatggccctggcttctgacaaggactttcttgtgtcacaacgtggtggagaaggtcaaagagggagcagacacatgggaagaggggaaaacctgaggggcaccgtagctttataataacccactctctcaagaactaattcattcccttgagaactaatccattttcacaagagctgaaactcactgtctcgagaacagcaccaagccattcatgagagatccaatcccataattcatatgcctcccacaaggccctacctcccaacaccgccacattggggaccaaatttcagcacgagttttgacagggacagacataccatatccaaaccataccacccgcagatttggctccttgtaagggcccagttcctggattgtagatggccatctttttattgtgtcctcacatgatgaagacagacagcaagctctcttgtgtctcttcttataaagtcactattcccatcatgagggccacaccctcaggacctcatctaaacctaatcatctcccaaaagccccacctccaaataccatcacactggagattaggagttcagtatatgaatttgatggggcgggaggaaggggacagatacaaacattcagcccatgacagccaccccatactattcttatgttccctttgaagccagtgctcagtagacctagctcctaactccttaagcacctacctggccgtgatggaaagaatatacctcaaccagtagaacaggatgaatagggctcttttctccctgtgcgtgccaatttacacaggcctgtcactggtttgatccctctgctgtcatttgttttgttgccgtagtgagttactataagcactgagaagtgagtcccaaagaaaatggtcactatttttcattgccttctcctccactccttccccgggggacaacacctgttcctgtttattaaggaatgtgacagatgcgtgttcctgctgcttcatgcatttaataaaataggagggctggttcttctggctgggttttatgtttatttcagtttgctttacaaagtggacacttcctagtgcttcaaactctctcttagattatatttgtgattgtacacttaaatctgcaggcattaggaaatgaaagaagtttctaattcttaactttcataggactctaaagttaaaagtataaatgaatgggactttaaccccttcttttctgtcagattccaacatgcttcttgcctgcttccacgctactcccaagtctgctttctctgtatgtgcctcatagcctgtcaggggccttgaggaggtgtcagataataaagtgagtctgaggacatggccagcagatgggtcaaccgttcctgtccccctttccccatcttcagccctaatgaggggggattctgcccatgtctctgccttgaatcaaacagccccattttgcctagcatctgctgaaggaactgctcatcttctgacaacccagctactcagtttgtgatcgtaaaaatcaccgttcttcatctgtggatcagcagcttctcctaacctgtctatttcagaggcattgcaaagatttttctttcggttcatccagcttaatggccagaagttcctctgcagagtaaaaaactgctccaagcttttgccctcactgcctctcaccctctatttctaaattggccagtatgtgtgagcccattgtggaaagtctgttgctgggaaacacaaggaagcaacttcccctgaacggatcctttcagtttgtatagacaagagtaacactggatttaatgggcagtaggtagagggtaaggggatcgttagtatgtttcctctgaagaatcaccagtaatatgagtcagctgtaaataccagttgatcaaatattttaggggctgtaatcccagcactttgggaggctgaggcaggcagatcacctgaggtcaggagttcgagaacagcatggccaacatggagaaaccccatctctactaaaaatacaaaaattagccgggcatggcagtatgtgcctatagtcacagctactcgggaggctgaggcaggagaatcacttgaacccaggaggcagaggttgcagtgagctgagattgtgccgctgcactccacacttcagcctgggtgacagagcgagactctgtctcaaaagaaaaaaaaaattagaggaaaagatgaaagggttgagatgaagaactgaaagatgaacatctccctaccctccaacctattaggaaagataaattgttcttagaaactgtgggggcagaaggagtcctggaagaatctagaaatgagaattctcataaggcaaagagggatttatgctgttattagagcttgaagagttgaagaatgacacagagaagttgtttcactggagcagtcggaaaaaatacgaagatttgccagcactggtgaatataaaagtttcaggaaagagaagtccattctgactggaacaataaaaagaagtcactgggtccatcagatccaaggaaaagacagagcctgtggttgagactccccactgcagtgttcagtggtggccatgctgacttgacataattctccccacaaccctccacaaattatctacctggacatggtaggctccagacagcattcatctggccaaggttcagctgatctcctcttttgctgatttgcgtggaaaacggtgaaacagaagaaatccaagtggatctctactgacttaaaacacctgagtaggaaataaaacacacccttccctccattaaagtccaggactgggagatgaaggagggtgactacacagcatcaaagagcagaatttggtcatctgggcctcatatgacctcctgaaacaaattaaaatgtagctaatgaagactgcaaagaaagagtttgccactgagctctctgcttctactctcaccctctccaagtcagcctaccccaggccacctcattactgttcacaaacataatttggatcaagatacatctgacctctgagacctctagtggccccctttccaaattgaataatgtacccatgtctcagcaaggcattcggggcttccactctgcatggccccaagcagcctttccagtttatccctcattccagcctccatgcagcctgagcttcaccaagataggctattgccattccttggggccgcacatgctgcctctcctccatccttttgttcctgctgtctgctccctcgacacatatcctgcatcacctcttgacacccaaatcctacacattcaagacccatctccagctccttctgatattctttctaatatgactttgtacctcttaaggaagacattcatcttagctcaccttgtacttgaattacttctaggtcttctctccatttggttgggagctctcttgagacagggactatacagcccttatctttgcatctgctgcagcacctagcaaggtgccttgtacatagaagtagttcatggatagattgaaaagaataaatggaggctgagaagagtagacttgtttgtgaaaaatgacatacaccattgtgaaattctgggattccacaatatctgacacatagtaggtaataaaaaaaaaattatttatttatttatgagacagagtcttactctgtcacccaggctggagtgcagtcgctagatatcggctcactgcagcctctgcctcctaggttcgactgactctcctgcctcagcctcccgagtagctggaactacatgtgcgcaccactacgcccagctaatttttctatttttttagtagagatggggttttgccatattggccaggctggtctcgaactcctggcctcaagtgatcctcctgtctcggcctcctaaattgctgggcttacaggtctgagccaccacactcagccaaaaaaagatttttttttttaatgaataaatgttgaagggcttttggaataggatgtaagaggatacaggtagtatttctggtagaagtgatctgccaggttatgagtaatacagcctttaaatcttgatagaaataagcatcctgcagaaaccacctggctggatagaagatatggctgatgctcttctagtatctggcgtaaagacaactttccaatttgtatcctgagtttgagtcacaaactgcatcaccatgaatacatctctgaatctctcttagcccttgttgattgcctataaaatggggataataatagctacctcacaggctggttgcaagaactgaattatataaggtataataactttcttcagactatgaggcttaataaaattttcatactcttaaacagtattagagacagatttccactatttaggcaactgttttctaatgatgatggtttggtgaactcttggcttgccttgatgacaatttcacctttcagaaaaagaaacacaagaactgcttctttagtcttagtatgattgtctcagaacaacttggtgctgtgaagtgaaggaaacccaaagtgtttgctgtaatgaccagagagtgtcagtgaaactccttagcctaaggataggacatgtcaaatagttcagagtagtggttctgtagcttgcaagctaaagagaaatatagattaagagagatggtagagcttaaaaaataaaattatagacacaataataagtggaaaaaatgaggggcctcaaacattaataataatatttatggagtcttttttttttttttttgagacggagttttgctcttgttgcccaggttggagtgcaatggcgcgatcttggctcactgcaacctccgcctcccgggttcaagtgattctcctgcctcagcctcccaattagctgggattataggcatgcgccaccagacccagctaatttttgtatttttagtagagacagggtttctccatgttggtcaggctgatctcaaactcgcgacctcagatgatctgcctgcttcggcctcccaaagtgctgggattacagccgtgagcaaccatgcccggccctatggagtctttttaatgtaccaggactgtgttaaaagctcaaagcctatttccccttttaactttcacaatattcctatgacatgcccttgaattagcttaattttaaagtggtcatgtgcagaagatggaaagaattttaaaatttgacacaaaactataataattaggacaaaaaagctaaaacctaattgagtcaaagttggtgattcacacataagataataaaatggatgtttttagccatgttcagaataagatatggaagatatggaagaaataagcctacctcctggaataggtaatgggagattaacaggtgatagaggtaagtcatagatggctcttttgtttctgtcttacccatcaaggggagtgttcttcaaattgtcaagaacagttaaaagaaaacaaaaatccaagctagatgaggagatagcagaaaaacgcccactctctttagtgagattaactattcaggagcagatgaattacacattgggatatttagtgaagaaagtcatagtggagccactgttagttcatttagaaatcatggagaacagaaaggtcctaaaagacaggacaggcaaatgtttccatttttataaagaagggaagggtggattctgaaaaccacaggctactgaaatttaggacagagctccagagggttatatgattattcatgtattttgggattgcccagaaaagaaatctgggattttttctaagacaaagtggatttactaagaataaatcatgccaaacttttttttttcagtaaagtttcaaagctgatagattaaaaaaacatgctgtgagcataatgtatctgacttcagaaaagaattggatgaagtcgcttattatacctttctaaataatataaaaaagaacgagctaggtaatagtaccgctaggggttgctaagtcactgtatagcaaattatctagtggtttttgacagggctctgtcttgggtattgaactgtccaacatgtcagtgacttgagcaaagacagcattttatcgtgtttgcaattcaaagctagaaaacagttgaacatgttggatactatcattcatatttacaaagtcctaccagataatacaatgggccaaaatcaatcagatgaaatttaacaagaataaatgtaaagctatcaactaggagtgaaaagcaaattgcagaagttcaggatgtgagacatctgtcctaagagttctctaatcaacaacaaatcctaatcagtgttgaggatagtgcctgacacataatggatactcaaaaatatttgccgaatgaatgaatgaacagatactgtgatgcaactgtttataaaaagctccttacattttaggtttcattagtgcatacatatggccaggttaaagaagctaagagtcccactgtactcttaattgtccaggccacatctaatactgtgtctagtcctggacacatttcacaaggacactgtcaagtcaaagattaccttgaaaagagtcaccaaaagagcacctatctggaccccgtttttttgttttgtttggttttgttttttgttttttgttttctgttttttgtttttaccacatttaagtagaaaagttaaaggaactagagaaatgaagaagccagacagaagacatgaaaaatatgaaaattgccttacaatatttgaaaaaagggctagggtgcccgtggctcatgcctgtaatcccagcactttgggagtctgaggcaggagtatcacttgagcccacacattcaagaccagtctgggtaaaaaattaagaattttttttttttttttttgagacagagtctcaccctgttgcccaggctggagtgcaatggcgcgtcctcagctcactgcaacttccacctcccaggttcaagcgattctcctgcctcagcctcctgagtagctggggttacaggcaggcgccaccacacccgcctaattttttttgttgttgtcgttatccttagtagagatggggtttcaccatgttggccaggctggtctcaaactcctgaccacgtgatccacccacctcggcctcccaaagtgctgggattacaggcatgagccaccgcacccagccaaaaatacattttttaaaaaattagcctggctcgctggtacatgcctgtagttccagctactcaggaggctgtggcaggaggatcacttgagcccaggagtctgaggcagcagtgagccgtgatcatgccactgcactccagcctgggcaacagggcaagctcttgtttcaaaaaaataaaaataattaaaaataatttttaaataatatttgaaaaatgtcatttggaatgaagatcagactaaatctctgtctagctctgaagagtaaaattaggatccattggtagaagacagaggaaacagatattggctctgtattaggaaaatcttggagagtgatccaaaagtgaaatggacttctctgcaaagtaatgagttccttgttactggaaatgtgctggtagaggctgcacttttattgaaggaatttgtgaagtgagatattaagctggatgacttataatgctaatattttgtcattgtaccaaggctagagaagtttcataggcacttaagaaactgctttgcacctctttcctgtaacatgaccttgggcttctgtgcacactcactgctttgttgtctactagatagttgcatactatgatgaatctcatactttttcaaaacacaaagtcctctgcagatgtttagcataattgctgtgtttcctttcactagatagatgtgtgtgtgtgtgtgtgtgtgtgtgtgtgtgtgtgttactctgtatactttacatttattcaaattgccataagaaaactttgaaacagactgcatttatcacagctaggagtcacccagagtactttcagaaaaagcaatttgctgatttaccttttgtatgtatttccaaagcactaaagttacaaagacctagtgtatagggcatgaagatgaataagcaaaggcaaacaagaatatccatcacaagagacattaatgtcaaggaggcaatttttaaatgtacaattatttaaaaagaagaggaaagattgacaatgatggcttccatcatatgtttaaaagtgccaaagagcaaagccatttgccaaacaaagcaaagagctccagactacctttgtgagtttgctgcctgcaggccaggccactctggactcctttgcccaagcagacaaaatattatcatttccagttctttaaagctggcaccctgcttcataactttgacattcaacatatcataatatttttgactaccaggtccacttttcaaaaagcatcttttgaaaattctttctgaagatagcaatatttcaaatcttcattgcctgggcttgctttttcatctcctgccagtcactgaaatcgtatttaatcagactgggctatgtggttcctgtgtccggctggtcccaagcatggaaatgtagctcttggacagtgccataaaatcaggcaatcctgagtagctggggttacaggcaggcgccaccacgcccacctaattttttttgttattgttgttatccttagtagagatggggtttcaccatgttggccaggctggtctcaaactcctgaccaaattgtcaattacacaaagatgccaagtttagagggaaaggatttatataaccaacaaagtgttccacattttaaaaaagacataattgtgagtaataaaagtcagagtggacacactctattttatctattttttttcacttcccataagtagttgtagtggtgccctcagatactatgggatgtgggaaaatcagtaagatatagacttggcagcatgaagggacttaaggtggtgggaagattagggccagtcctgggataaggagttgaaacattatttagaatccactagggagttattgaaggatttcatttgcttgcttgctttgaggaggcaataacgatcagaacagtcctataagaagttcaatctctcagtccaaaaagtccgtgcagaaagagacctaaagtaggaaggggagtcaggaatctaacagagcagcccagaggtggagcagagtcagagacaccgtttgagatccgagcacccactgactgacagccttcagttccaatccaatctgcactgcattctgggtactaaccctgcacaataaccagctgcaattgccaagaaaacctgtgcagctggtggtgagtgaaaaccaaggatgtgaactcaatgtgctgcagctgaagaaacagagttgtacctggaaccgcccagtgggttcaccttgcccactgcctacacagaacccatttatcaagacaggggaattgcaatggagaaagggtaattcacgtagagctggctgtgtgggagaccagagttttattattactcaaatcagtctccccaagcattcagggatcagagtttttaaagataattttgcaggtaggggcttgggaagtggggagtgctgattggtcaggctggaaatgaaatcatagtgggtcaaagttaggttttcttaacgtcttctgttcctgggtgtgatggcagaaatgattgggccacattactggtctgggtggtgtcagctgatacatccagtgcagggtctgcaaaatatctcaagcactgatgttaggctttacaatagtgatgttcccccaatttggaggtatttggggagcaatttggggattgctcagactcttggagccagaggctgcatgacctctaaactgtaatttctaatcctgtagctaatttattagtcctgcaaaggcagactggtccccaggcaagaagagggtcttcgggaaagggctgttatcaattttgcttcagagtcaaagcatctactgaattccttcccaaagttagttcggcctgtgcccgggaatgaacaaggaaagcttaagtgttagaagccagatagagtcggttaggtctgatttctctcactgtcataatttcctgagttataatttggcaaagacagtttcatacccagtgactgttttcctgagtgctttccagggtggtggccaggcagaggtgtggtcgagtcgggaggtgggatggttccagcctcaggggcctggcttcttcttccttcctggagggacaaaatggtcatcttcctcctgctgtagtgttttcccctgtgttttgttccttctgctatgtgtggatgtgttgggataagatagggcaagatgagcaccgggaaagggggctggcaagaggaagggaaccctgtctgttctcttccccttcccagtgatgctgcctctggagaaggtgaggaaaactcgcacccaacaggctgcaggctcctggggccagagctttctgctttttccagactccatatgactgatgtgaaaacgttgagtttcctgagcctgcttgccctctgggtagtctaactgctctgataataaaataagtgtagaggcactgaagtaaagaatttgcaataaaaaagaaaatgaaaaatggaagccataagagaaatgagtattggatcaagtgtgaagaatgggaaatgtcaaggcacttgataatttttctgctaacaaacagacattgtgaaggtggaagtttccatggttttccttccctgcgttttcttttgctattgtcatgagatctaggggcatgagggatttgtcatttgagtgttacattgcaacaaaaagcaaggcagaagtacagaatccacttaaatgagagtatgaacacaataggaggttttgctacctggaattagatgttgaattgctgctctctaaactttattttctatataaaaagctttaaatacaatcatttaattattcatttaaagtttatattaacaacatttagtgtgcacctgctatatgtaaagtatcccactaggtactattcatcaaattaaagccagctatttagttatgaaaataaaccatggcccacataccctgtgaagccctgttaaaagcaggcaacatgcccaagaaaatatgtttcctttgaatttcacagaaatcttagtttgaggaagaaaaatcaagagtttttgttataagccactatgtgtatgctctgaaacagttaatgtagagaacagaggtagtggccataactgaaataaggagatagtgagtgagtgtgtgtgtgacctaattcaagtttggtggtccaagtggtatttttcttggcctgtaaaaactacaggtatttgcaaaactgttctaaatagtaatgtaatagaagttttttaaaaattgagttagtgcatatgtttggactcaatttctccctcttttggttactatatatggttctaatttccagctgtgcagttactattgtaaattctcaacattaaaaaaattttcagatacaaattatttttattgatacatactttttacatatttaaggggtacatgtgaattctcaacaattaatattaaataaaaggagaagaattctgttctatcccagattagaaataccttagaatttctatttgtgtctatttccctccattccattattttcttcctcttcataccacatttatatacgtcttaccatttatttatatttatttaatactttacttcaggaaacttagtattgttctggaatcagaaagcccttctagctagtctgtcttgccaggtctttccgattcttctccctcaagaagcaagtggtggtgaccacgtcgacataagagatttcccgtctgactcctcccaccatctgtgtaggtcacagaacctcacgccaactggctctcttcagactgtggtcaactggaaaatcgagtcagatttcagaagggtgggaaaatgaacctagaaagtctaatgtggagaaagccttaaaatatatccttcatgttccacaatagtgattattatctttggcgatactgcaacataaataggtattcttggctagttcatctctggcggcaccatcttggcatttacactctacagaaaaggtacctgaggagaaagatggtccaagttacttgccacaaatcacacagattaacagcagcacagtctgggtgtatatgtgtaatatatatctttttattatttttatatacaagtaatggttgtttcttgtagaaaagttaaaacaatgaagatgagcaggaagaaaaaaataccatccaaacacccagcaaataaccatactaatgtagacatattttcttctaatcttctaggtatgtatgtatacatatatgtacatatatatacacatgcacacttttttctaaacccatattgacctataacctccttttttttttacttaacaaaatactgggaatgtctttttgtgtttttaatattcagctattccatagtattccattttataattatactgtaatttaagtagccagccctctccttttggacatatatgttgtgccaagtgttgattacaataagtatttctgaaatgaacattctcacccatacatcttggtgctgctttttttttttttctataacccaggacagtgctgaagtgcttcttttctttaatttcctcagttttagttcctagaagtggcaatgctgggctgttgggtttacacatgtttaaggttctgatgcatgtgactaaattaccctccagaaaagttctgctttaagttctacttaaggctttcccaccctgggacagctgaagactggccagagctttgcagctgcaatgatgtgtttaccacctcccttatccagcaacatttgcaattagcctccgaccttgttcctgggattgtttccggtgaaaattagccatgcctggctaatttttgtatttttagtagagacagggtttcaccatattggtcaggctgatcttgaactcctgacctcgtgatctgcccacctcggcctcccaaagtgctgggtttgggaatggtacctgtggatgcacctagaggtgtgtttagacactagctgaaatcactttggtctttctagcaaaccttagccaatgggctccactcacaaagggtcagcttccaagagcagattttagctcagggcctcttatgttcaggacaataatggagtaaaaaaacaaggctgaaaaccagaagatatgtgggcttaagcagatatgtgaatagctacccacataggaaaaacaaaacaaaacaaaacaaaaacaaaaacagaaaataaggtgggagtccttcttttacaaccatggataccttttcttttctttttttttttttttttgagacaggatcgctcttttgcccaggctggagtgcagtggttcgatcatggctcactgcagcctcaatcccccaggctcaagcaatcctccacctcagtgtcccaagtagctgggactacaagtatgtgccaccacacctggccttttttttttttttttgaaatggagtcttgctctgtcacccaggctggagtgcagtggtgtgatcttggctcactgcaacctccacctcccaggttcaagcaattctcctgcctcagcctcctgagtagctgggactataggcgaacaccaccatgcctggctaatttttgtatttttactagagacggggtttcaccatattggtcaggctggtcttgaactcctgacctcatgatctgcccacctcagcctcccaaagtgctgggattacaggcgtgagccactgcgcccagcctggccaatttttttaaatttactttttgtagagatgaggtcttactatgttgcctaggttgatttcaaactcctgaactcaagcgattctcccacctcggcctcccaaagtgctcggattacaggcataagcctctgtgcccagccaatacctcttattatctaactgagcattgttaaattcagggatgggttgctgagggacgatatgacagattacactcgatttgatgtgtgctgactaaggcctgtgcatgcctagcattgctttagtcatggaatgaaccacactcaggttcagattctagtcctgccacttcctatgtgcttgagcaagtgccttcatttatctgagactcactttccttgtccatagttattccaattgcatttggttgcagtgagtagaaattaagtatttaggctgggcacagtggctcacacctgtaatcccagcactttgggaggccgaggcaggtggatcgcttgagctcgggatttcgagaccagcctgggcaacatggcaaaaccctgtctctacaaaaaatatataaattagctgggtgtggtggctcacacctgtggtcccaactacttaggaggctaagatagaaggatgacttgagcctaggaggcagaggttgcagtgagctgagatcgtcccactgcactgcagcctgggggacagagtgagatcctgtctttaaaaaaaaaaaaaagggaagaaatcaagtatttaaagcacctaaggacagcccccagccccatggtagtgctcagcaagtgtttggtgaatgaatggattcatgctctacgcttatatagagtttactttgctttcagattgggttctgcttgctcattgtacttatcactatatgagaattgtattgtttattttcaaatttgccacatattgtctgtttctccatcaacacaaaacattctcaggagaagagttggttcccagtgcctgaaaacagtgcctagcacacagaagatggtgaatcaatatttgtggttatttctcactcacattccgtccagcaacccagtcttgttaccaggaggctgttcagcacaggacacttatcacaccatttattgaccctccacttccccctctgccacttatcacaccattggttgacctgtgcttgcttccagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagcctcaggtaaaaacccacaaaccattctctgaagtggaaaaatgagctgccagtgcctagggagtgcagaggagcgtgctgagaaattcctgctgcaggtcagtgggtctaatgccgcttgcacatcagaatcacctgcggagcttgaaaagcaagtgatagggggctgcccctaggacaaactgaatccgaatctgtcgggtggggcctagcatatttttatgctaggggcatcagcatatttttaaaataccaattctaatgtgatgccgaaattgagagcttgtgctttcaatgataagtagagactctggatacaattgtaacgttggaaaggaagggcaaaagtaaaaataactacctcagggtgatgacattatctattttcaattttctataatgaaaataaaaaagaatgattagaaactgccaagctttcataacagcattttcacaggtcttgtcagaacatccactaacaaaagggagcttagcttagctgcatttggtcttaagataccatcacctctgtcttctgttttactccaggttgatggtatttttattattctgtcattgcacctgctgtagaaattgccacatacatttcttttagaattttgtgctaggcagtgctttgttttctataaagaactagtattctttgtcctttccaataatgtataactggttaaagttcctgaatttcatccgctatataagccaatgtcaaatcagtaactatgttcttctgtaatggtccatattatttttgtctgctacctctcaatcctcactttccatttgttaattcattatattaatatatgctttagttacaagctactctgagccctttgtacagagaagcagggtgtaagcaataatttccattgcaagtaggaatgctgtgcagttttagatagtaatataaaaactatgaatctgatcctagaagttttgcccttgaacaacaggaagcatttttaatcagaaattccaagaaagctaaaatccgaggtttttggggatttttgtttttcagtcatatatagagagatttttaatgtagatttacatatggaaaaaaattaatagaaagatatgctaaactctctttctgcatccccatagtagcgcatgtaatcagaatgacagtcagaaattgtgtcactgcttatttcagaaattagtgttcaccaccaaataagtcaatttctaaaagtcaggactcacccctgacaaagtcatcagaaactgtacttactggaattttctcagaagctctacctccttagaccatggtagtgatcacagtggctcagtctcataatcacctactcactcattcagtcagtcaacaaatgggcacattctaggcattagtgctaccatggtgggcaaagccagtcattttcctgactctgcggagattatagtctgatgtccaatacaatatgtgttaaatagcacatgttgcctaaatcttagctaaatcaaaaagcagaattcctctgaaaatccttagctgtgctcatttctaaaataaggatgatgacttcactttggcagttaacataaatgttttgttgtatatagatataataaaggtgattgcaagcagcattcacaagataaaagggcaaggaaattgactttttgactaacaatgaataatatcaacccgtaatgtaaaaatatgataccaactacctaatgatcatagaagatatcatttattcattctcatatcccaaagaagtcagaggctttgctaggcccttgagccaagacaactaaaaaataatactgtttaaaattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttacatattcactttagtcaaaaagatagggctggcaggctttaggaaaaaatgtgatcctacaaaattatgtaagatgtcagagggtccaagtatacaggactacttgattatgaaaattgcgtgagtaggcaagcacattggcttttgaacagtgtcagcaatctgtggtatgaatgtgatttcttccaggacttcttggaagagctgaagctggtggtgagaggctcactgttccaggtggccagcctgcaagactgcttcctgcagcagagtgagccactggctgccacaggcacaggtgtgggctcttgggcagtttgcatgccttcatcaacacaaactccaaagaccctgaataggctgggtcccatcaccgaaaagtgggactgtcaacagagcagcccaacaaaacgtatctatgaaaatcagtctcttgaacaaaatccagggcacagaatattttcattatgcttttatttttatgattcacatggaatttagacttagtcagtggcatcattatcattattttttttagctgaattaaagaaattaccccaaattaaattcaaagattctgggtttttgaatcatcttgtcaggatgatttcctggggaataatttggttttgagtcacttagaaatgaccatcactggctgaaaactctttgccttttgctgttcctacaggggactttaaccggcagttcttgggtcaaatgacacaattaaaccaactcctgggagaggtgaaggaccttctgagacagcaggtaacaagcgggacatatcatcagaaaagccctcgtcttcttagagcagctccccacaagctagtggagctgcaggcctgcccaggcacgggggcagcctctgagccagatctccgggggcccacgcagccccgcacgccagggctctgctggaagttctctggaaatggggtccaagctcgtgatgaacacaccatggctctaagcagagcgggagccatcaagggctgctaacgctactgtaagaagtgttacagagagccaggtgcggtgcctcatgactgtaatcccagcactttgggaggctgaggtgggcagatcacgaggtgaggagctcgagaccagcctgaacaacatggtgaaaccccgtctctactaaaaatacaaaaattagccaggcatggtggtacatgcctataatcccagctactcaggaggctgaggcaggagaattgctggaacccaggaggcggaggttgtagtgagctgagatcgtgccactgcactccagcctgggcgacagactgagactgtctcaaaaaaaaaaaaaaaaaagtgttacatagatagctccacaaggattctttcattcctggatgatatcaggcattccttttcaatccttttttccccttctcatttttaaaggttaaggaaacatcatttttgcgaaacaccatagctgaatgccaggcttgcggtaagtgcttttctagtaatgggctcgcctgagttggatgatgcaggctgatgaagggcttgcggtgaggctgtgttgaccgcagtttctgaaggtctaccacatagttggaggggagggaggaaaagttcaataggaaaccaaattttgttttgccttctgtatatcttcctggcggtgaatacgcctgtggatgattgtttttctctaggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgaggtaaaagttcacttagactgggaggggatccctaagtatcctcctcaccctgcagcttttggaaaaagaagccaagctgatgattaagggctgacttgggctgtcctccaggctccattgaaaccacttgcttggagaccctgagacaagggatggcggaaggagacatgacccaaggttatggctgcgtttgtcatttttcctctgtgtttccaactcttctactggtccattggctacagtgctgaggtttctgctttacacgctgacatttgcattggttatttctcttaaatagtctgtgctacaattttgtttttcccccacttttgcaaatgtggaaggggaggatttttctaagggtatatttcaggagtcaccgtggatttcttcaggcttcctaaaataaaggagcagaggggaatctcacaccaacaagggggaggccctgtaacctatgagtaactaaacgtgcccagggagggccccagaggaggcacatccagcaaataccagctatttgaccggctggcagagccccagaagagactgtttcaagaccctggttaggcaggccagcctagtggctgaagcctgcaatctcaacactttgggaggctgaggcaggaggatcacatgagcccaggagtttgagaccagcccgggcaacaagacaaaaccctatctctacaaaaaatatgataattactggggcatggtggcatgtgcctgtggtcccagctactctggaagatgaagcaggaggattgcctgaggcaggaggttgaggctgcagtgagccatgatggcaccactgcactctagcctgggcacaaccctgtctcaaaaaaacaaacaaaaaaaaacatggttaggcaatcaccagtccagttgcaaagcaatgttcatagcaggtagcaaggctgccaccaaaatgtgccttcaatgtgcctttctcctcccacccagcccaaggaaggctgaaaggagaagcgcaggggagagatgcaggtacataacttaggcacactgactccctggggctcctgcaggcccatggtaatgttagtaacactcagctgattaccttcgctagtagtaagcaattaagacggtctctagtaatccctcaattggagaaacaactgcatacatttcactgaactgcatctggtttttatctgtgaggtagaattttcctctttctgaaagggcaggaagtggtcatgttttttacattagttgaagtggtttaaaaaaaacaaaaaacaatctccaagattcctagagccttggaatagcatggacttgacaggacatggaggcaggcacaggccctgagggattacatggtaatgaagaggcaccggccctggctttgccttctcgaggtctttctgattgagtagttggtttgctgatgcttttggaggcatctaacagccagctaagtggtccagggacatagtcctttcacagagatttgcaaattccatgtcagaatatcagggagcttattacattgagaggtaggctggttaatatcaaggaccctttcaacatgcatgtgccattattctacagcacagcaaagcctactaaaaagcaacctcagattgtgtggtcagggattcagtgggtaactggagttggaagcctttatttccttttattattttttccaccaaaagatagttaaatgactaaacaagtatgtgcaaatagatgaagaaaagtttgagagtgttttctcggtgtggctaaagactttgaacttttttgtctccagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtaggctgaagtcatggtttctattcatttctcatcttaacaaaacaactgtggttggttcccacctctttggtataaacctttacctccatgagcagtcaaggccatgtggaatgtcatggtgcaaaatgagcaaattaggaagtttttcaaccatttctgagtatttacatttataaaatctagaagggaggaagcttttaagaggggataatagagtatcactagaaaaacagtaaatggggtaatatggctattggcataatttcagtcttattttgttgatagctgttgagcattttgtcctgcagaataagttgagaaccacggagacaaaagctttgaaaaattaggtcacttttgtagagtcattgttgccaatcgaagctgtttcagagatgaggggattttaagagtagaaataatcccccaaggcaacctcccctttttcttatgtaagctataaattgccataaagcacttgagtacttcttgacagtctccatttatttcccaatgctctactatattctggtcattatttaactgactgactgtgaaattctttttgatgtttttagcccttaaaaatggttgttctataaatatattttactaccttagggaaattattagctttgaagaagggcaggggtttattatttcctagctgcctatcaaagggttctagagggcatgatttttttaagttattgttatactttaagttctagggtacatatgcacaacgtgcaggtttgttacatatgtatacatgtgccatactggtgtgctgcacctgttaacttgtcatttacattaggtatatctcctaatgctatccttcccccctccccctaccccatgacaggccctgatgtgtgacattccccaccctgtgtccaagtgttctcattgttcaattcccaactaagagtgagaacatgcggtgtttggttttctatccttgcgatagtttgctcagaatgatggtttctagcttcatccatgtccctacaaaggacatgaactcatccttttttatggctgcataatattccatggtgtatatgtgccacattttcttaatccagtctatcattgatggacatttgggttggttccaagtctttgctattgtgaatagtgccacaataaatatacgtgtccatgtgtctttatagcagcatgatttataagcctttgggtatatgcccagtaatgggatggctgggtcaaatcgtatttctagttctagatccttgaggaatcgccacactgtcttccacaatggctgaactagtttacagtcccaccaacagtgtaaaagtgttcctatttctccacattctcttcagcacctattgtttccctgactttttaatgatcgccattctaactggtgtgagaaggcatctcattgtggttttgatttgcatttctctgatggccagtaatggtgagcattttttcatgtgtctgttggctgcataactgtcttgagaagtgtctgttcatatcctttgcccactttttgatggggttgtttgatttttttcctataaatttgtttaagttaagttctttgtagattctggatattagccctttgtcagatggatagattgtaaaaatgttctcccattctgtaggttgcctgttcactctgatggtagtttcttttgctgtgcagaagctcttgagtttaattagatcccatttgtcaattttggcttttgttgccattgctttaggtgttttaatcatgaagtccttggagggcatgattttttagactagaaaagggaggccagctagacatataggaatgataagaagctgttaagagtcctctaaagacaaaatctctaagaacaaaccaaggaaacataaggtacttggtgtaaggtagtaaggagcacttctcaatagatttccagtaacaaggcagacagaactgaagtggaagggagccaccttgctaaatttaacagcaaatgttactgcattccaaagtcaaagaaaataaaaggaaatggcgcagtgtccagaaacaaagagaaaactcaaagccagaactgtgactagagctgatgccacagcagatcctgggaggtgggagttgggtccaggtcttagtaacagggacctggcttttaccacctgtgtggagtggatgcagcaatgtagtctgggaactttggaaaggcctaacacccctgcataagtccaggaccctcagagaaccaccttatcaattacaaggagacaggaaacctttagtagccctaagaaacaacaaagaagctctttagctttaatacatggttgacaaaaatgaaaattgcctacagcaaatcaaagcaccacacttgtaccacatacagttatgagttccaaatctgttatacatataatgcagaaacacaagccaaaaaattaaaataataaccagccatgaagaagtgaaatccccagggctctgactcaagtcaaaggcacaccactctgtaaagacacaccaaaattcagggccaatggaatgcccacaggcaaaatttgggctactgaagatatgcttataaacaaaaatggcagtttatataaagaaactcccatgaggaaacatgataaatgcaaagtaaatataaaaaggtaaagaaataaataccatacttaaagaatagggcaatgccccaactgggcaacatggcaaaatcccatccctacaaaaaatacacacaaaaaaattagccgggtgtgatggtgcatgcctgtggtcccagcaaccttgggaggttgaggtgggaggatcacctgagtctgggaggtcgaggctgccgtgagctgtgattgtgccactgcactccagcctgagcgacagagcaagaccctgtctcaacaacaacaacaaaaaaatatagggcaatgtgagaaaaacagataagtttgtaaaacagacaaataaaacttttatcaatggaaaatcgttgaacttaatagatgggcaaaacagattagacacagcttagcagggagttcatgggctaggaggtgaacctaaagaaatcatctagaatgcagcacagagaaataacgacatggagcatataaacaagaggttaggagtcaaaagaagatattaacaagaaagttcgatattcatccaattgtagttccaaagaaagactagaaagcagtcgggggaagctgagaatgttccagaattgaaaaaagctaagaatcctcatttaggagaactgcattgattcccaagcaagattaaaaaaaaaaataaaactttcctaacctaaaaaggtgatggaacagatgaattatacaagttgtcttttctgaataactttcaataccatgaaagcaattctcatttgcaattagattaagtacaaactggtacaaatgcaagggagatggcacaaataaccctcagattaccattctacccgaaattccgcatcttcacttcacacaaagatagcaaaacaaaggagatttatttgcatttctatttaagcagcatgtctcgctaaactttctttgaacttttctgcactaggtctgcactgacattgatgagtgtcgaaatggagcgtgcgttcccaactcgatctgcgttaatactttggtaagtatttctcacagctgttgttatcaaagcagaaccggttattaaaacaagtgtatgtttatagatcatagcttccaaacacacctagaacatgtgggcataatatatttgattggcagaataaaggcaaaagtttgtgctgaaaaagtgtttaatatgagtaattttaaaagtaatttttatgtaagaataattttataagtgccaagttctttattttctatcaaagttgcaatattaggctattagataactatttattgagtaaataattattactcctgtattttaaaattgtgaagagcttggtagtttatattaatagttcagtattttactggtgactacacaatccccaaatggcattatttattttcataaaactttcaatcatggggtcaggagatcgagaccatcctggctaacatggttaaaccccgtctctactaaaaatagaaaacaaaattagccgggcctggtggcgggtgcctgtagtcccagctactctggaggctgaagcaggagaatgacatgaacccggcaggcggagcttgcagtgagccgagatcgcaccactgcactccagcctgggcgacagagcaagactccctctcaaaaaaaaaaaaaaaaaaaaacttttcaaaacttttcattgtattaaattaaagtgcttagcacttagggatgcctataacttaagtattcagatatgggttttatttctgaaagttcctgtcaaactgtgtccaagatgagagatgtaccagagttgactatcaagaaaagaactactgattacgtgtatgactatttgaaagttatccagcctctaggttccttgtttccttgtaagtaaaaacactttacatttatcaagtcacttattttaatcctcacaacaacctcataaacagggattattattatccccattttacaattgaagaaactgagggacagaaatattacatcattaagtccaggcatggtggagcatgcctatagtcccagctcctcaggaggctgaggccgaaggatcatttgggtacaagagtagtttgaggctacagtgagctgtgatcgccactgcactctaacctgggtgacagagggagaccctgtctccaaaaagaaaaaaaagaaatgttacgtatttagactaaggtcacacatcttccaggttggctacagagcctgagttcttctccgcaatgctatattgcttaggaatagatggggatttattgcttctcagcttttaccaggacaaagtagtctgcaaatagatttgcgagatcttggtgtaaaggtaataactgagccacctagagagaaggaaagtagacagtaaatagaactccaggaaaccccaaaaacgaaggactaggccaaggaaaaagagcagaagccagaaaaaggagcgaactgatagcacagccagggaggctgaaagatcgagacaagtcattggaaagcatgcattggatttggcaactaagaggttgtgagtgacttaaatcattaaacaatatatatacttcaaatggatgtcttttacgacctgtaaatgttatgccaataaaactgcataagatgaaaaagatctaatgtacagcatggtgactgtagttaataatactatattatatatatgaaatctgctaagagagcagatcttaagtgttctcactgaaaaagaaaaaaaggaaggtaactatgtcagttgatggatgtgttacttaactgactgtggtaatcatttcacaatgtatacgtatatcacatcatcacactgcacactttaaatatattcagttttgtcaattatacctcaataaagatgaaaattttaattttcattttttaaacatattgtataatatttattacatatatagtgtgcagtgtgataatatatattatatatataaaagctaaaaaaacctggcccctgaagtgtcattgcagcggagctgacagctcatttgtcagtttctcagcctacctcatcagaaattctcaatgcaggccaccagcatttctctgtgcacccattcctttgtcattccattgtaaaagagccaaaggaacagcaataagaaaaattaacttgctttttaagcagatcatctccctgtccccagagtaaacttctcacaccacctcccaggacttcactggaacttttgacctgtcccctatgccctccacggtggcgcgggcaactcagtgtcattggttcacagtccagccttcttccttcacttctattccttctttgtctgagtggccggacgcagcctccagtctgatggtgttttcatcaacattcacatgatcttacatgtaagcaaagaagaaggcatggatctgatgcctgattcctgccagcaatgagtacctgtgaaaatatacacaataactgtacctttgctcaaactgtacctttgcccacagctttcagctcatcacctgatctttgttccttgcagggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtggtaagttgttttttgacttcctctatcatttttcctcttccatttttaacaccacctctctccagtttctatgtgcttcagggtaaaagtactccaaaatgaaagcattgcaattaaatgagcatggagtgtaataggaacagggtccaccgagtttgtggggagcagcctgacatccatctaaccatcagctgccttttctctccctcttggctggggggcaaccctgtccacttgggtacctggatgccagagcctccggtgaagccccagctcccaagcaccttctatggaaaggcccagaagccagcagcagggaggtgaaggaacattcttctcccctttccttcttctgccccatctacctgcctgtataatgacaacatacctgctgtcatctctaactgtcctcatccttacaacttccagagtctgtctgccttgacgctcctgttgggggtgggccatcgtgtagaggtggggactgtcatagtccctccgggagaaaccttccgtctttggcaggtgactggcagggccagacggcgccatgctgtatgtctacctccactccaatcagggacagctccatgaatggtcacgcttcctgtgcattctccagccacggagctggtctggggaggggaggctgggaagagagtagagcagtcacagcagggcctgacatgggtcccatgctgagcttgtagtgggccctatgtgaaggagagggcatgctcctgccatccattcccaaatccaaggatccagagtcctcagcctgccatccattcccaaatccaaggatccagagtcctcagcctgccatccattcccaagtccaaggatccagagtcctcagcctgccatccattcccaaatccaaggatccaaagtcctggggatcctaggcactgaaaaatcagcagacttcagctgcccccctcctctgcacttcctgggatgccaggccctcggccggtggcccgtcagactctggggtcactggttcacagtgatcacccctgagtagcaagatggattctcggagcccttttccatctttatctcaaagttatgcttctttatctttatgcatacacaattttccacaatgagcctaccacttttcaaataggaaaaataagagtcaaaaatgagttaataaataaatataatgaagtcagccctccttggcaatacagatattctgtaacaaggtcagatggaagaatgtggtgtatcagagggggaataaccccagcaatttcctgaattcctcatggttgggcttgtttattaccaaaaagcagtcattgagaaacaagtgtatatctctgttgaaatccccattttctgtgaacaaattgacaactcccctgggatgatgggtgatggggctcttaatatgtttttgaatttgtaataaggcacaacgacagatggtaaaggattaataaacttggcgtgactactaaaataattgaatctgccagaaaatagctcattaaaaatgtatttgttcctagaggacattttttcctcattaaagtgagtcaaggatcagcctcgtggatcagccttccaggccttccaaaggccctgctggggcaagtgagcaggaaccaggagcccgggagggtctctctggagttctgcctcctaaatcctggttgcagagggagagcacagatgattgagaataagcaggctgtggctgaggaagtcactggtctgaaagcttttgggtggtgaggccaggaaatttaacctgtgctcacataagtctgatttcccttggcccagactctgctcctcagactctctccctcttccttcctttacctcccgtcccaggtcagctttctctccctctgcgtttccagttccctgtgaccttctgggtcccctcctcccatctcccttctgctgctctgcctgttcctggaagtgggagtgggagggagagttttctctctgagtctccctttatatctttgaatagtgaaccattacactattcaagtgcaattaaatagtttctaagccccacccaacaaggctgagtgactctgggccctccccctgggattgagcaaaggagcagagaggcccttgtcagccaccagcttcctgccaggctcagcttcccaggcctctgatgggctttccctttacagtgtggagtcggttgggctggagatggctatatctgtggaaaggatgtggacatcgacagttaccccgacgaagaactgccatgctctgccaggaactgtaaaaaggtaaggggtgtggggtggcagtaggcacacatgcactgtggctttccaaagtcacatcttctatggggagaggttctgtggatctaatttaaaattgtacttgtaaagtagctgcatctcagaggaagtgaaacagccaccaacaataaagccacagtgtcttgaggtcagaaacagttactggcttaacacaaatgtaggatgtcactcggaactgcattttccccctaaggacaactgcaaatatgtgccaaattctggccaagaagatgcagacagagatggcattggcgacgcttgtgacgaggatgctgacggagatgggatcctgaatgagcaggtacctgcttcgctgggagggcctgtgaattgccacgtaccagggatgatgggagaaagcctgtgatgtcaactatgtatatgaatcatcccaaatgttagtttccatgcctgcattccacagcactgcagctttttaccctataagattcacagatgtttgaaatataaaactgacaaacttgggccaccagagtgctgatgcttcacaacaatggaggaagtggatttagtaaaagtctgagtgatgttctgtcctttcatcttttaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggtagatttatcttgcttttgtcttttatttggaattcagttgaccttgttccattgttctctgagagagtaggaatagaatgactgattcggagccttccagctgtgggtggctcattgtggcctgcatctggaagacccaaggtggacttgtgtctatggaaggagaccccacagcccactccactacctaatggctctggatgtttccaggactctgtatcattgccagaaactttgtatgaccccttcaagcagtgtcttgtcagagtgtgtctttatggggtatctcccttcccatttctacctgtcctcactctccactatcctttctacatgtgagagacccagaagtggagaactgaatgagaaggcattgagcagggtcacagactatgcatcacaggctacacatcccattgtgggcccttgaaggaaaaacctttttgaaataccacctgccccaacacacacatacacacacacacacacacacacacacacatacaccactccagaacatgcacacccccctaaaacatgacctcaccttctgcaagcctaactgatgacccatttccagtggtatatgctggtaagcaaatcacagaaagccctagttggtagcattttccagtttccatgatgtaactccgcattgtcctcattgctgatttcaagctaccaatgtgacatcatcaaacacaaaactgaaaagagagggacacaatggacccagctccagcacaacactgcctagagccctagggtctcagtcatagctcagatacccacgagatcctccctctccagggtcagccatacagccatcatgatcccctcctcgtggttgctatcatagcccttgacatcttggacaaattagaattcagtcgataaatacctctgagagctgttcatttttaagtctcccagaatccgtcctttgaagctacctctggataactgcagaaaagggtagtctctgtgtgacactggcccaggcagaagcgactcaccatgcgcctgatctctccagcacctagaagaagtcagtgacattcccctgactcaaggtagcatttctttctcacaggaataaaaaacattctggacaactgcccaaaatttcccaatcgtgaccaacgggacaaggatggtgatggtgtgggggatgcctgtgacagttgtcctgatgtcagcaaccctaaccaggttagtaggatactggggaattcaaactccaggctgaattcctctatgcaaagactcatttaagacgggtgtctagaaaaacagcagagcctcttagctgttgccacttacctaacaaagcagaggtggaaaaatgacacactgtgggcctgaagatggtgggatgaacaccacacaagatctgaagccctagggactatctcccaggctgtcgattgcctgtgaggttagtaacacgaacttcatgatgctcaatacaagtatttttcctgcagaaaggaaaacggagcatggaaattaaccattgggagccttgtgtccctttagtccctaaacccctacacagcctatgtatggacatttcagattaagttcagccagggatgtgttgcatctcccttctcactcctcctccctgtctggataattgggtatgatgtgtcatttatttttaaagccctgagagaggggagtcatggttgccctctgtgactcactcatgattttggccaaattgcaaattgcagaagcaaagcaaaatcaacctgccttctccccatgcctatggctggctccctgtgacccgtgccagagttccatgcctccacctgccaccatgctaccccagcgcccctttccaatcagctcatctggtgtgtgggcagcccatccatgtagcttgatattttagaaggcttttttgaaaattcagcattgtgcctacaccaatatggtgttgtccttttgcagttttgcaccaccccggttccagagaaataattccccaaatccaatgatgatgggtgaggtctgccttctctggaacattcggtacatgcaggcccaggaataaataacatgtgctgttctctttgcagtctgatgtggataatgatctggttggggactcctgtgacaccaatcaggacaggtatggcatgtctcccaactgcagagagacagatgcaaacatccggagagggtttttggtttgtttttttttttgaggcggagtctcactctatcacccaggctggagtacagtggtgcaatctcggctcactgcaagctccgattcccaggtttatgccattcttctgcctcagcctcccaagtagctgggactacaggcgcccgctaccatgcctggctaatttttttgtattttcagtagagacggggtttcaccatgttagccaggatggtctcgatctcctgaccttgtgatctgcccgcctcggcctcccaaagtgctgggattacaggcgtgagccactgtgcccagcccggagagggttttaaatttcagaacttcctgctgctccattccttgggatctttctgggtggactgagctgctggtgggataatagccctgcctctggtcagaattaccatgaaaattctccctgaaagttctgtatagggtataacggtgtcagaataggttactaggcactccagcaagtgagatctatttcaggagaggtaatatagcatcatgcttcacagatgggctctggaataagacagctagatataaatttcagctccttctcttacatgccagctaaccttaggcaaattacctaatacttttgcctcaattttctcatctgtaaaatgaggatgacaatagatctagctcataggaccatcgtgaagattgagttgatccatggaaagtgctcattatggtttctgttatatacatagcactcaatagacattagctcttttatttttatattctttcagctcaggaaaacttcaccatcatcccaaaatagaaggctgtcagtttgctgagggattgctattatttcctggtccttgaaatttttttaattcagttttccttatttaagtggaattgttctgtggaagtgagttttgtgaaccctcctagctcaacacgatggagtcccacattaagactcaaggctggatcaactgatcagattctggaagaacatcaccaaaaacagacgtgtgtcactcagccctagcggcacctgcaacccaaggttctaaacccttttgtctccatagggaattcttacaaaggcagccaggacaaggatgagagggaaaggattctaaaagagaaagcaaaaaaagatgtaatttctctcctgatacctggatcagaggttgccctgcagaaaaccagttcctgacccaaaccttactcaaggacagctcctatgaagccacagctctctctctctttttttttttttttgagatggagtcttgctctgtcacccaggctggcgtgatctcggctcactgcaacctccacctcctgggttcaagcaattctcatgcctcagactcccacgtacctgggattacaggtgtgtgccaccatgctggctaatttttgtatttttagtagagacagagtttcaccatgttggccaggctggtctcgaactcctggcctcaagtgatccacctgcctcatcctcccaaagtgtgcatctctttcattatgctctgtgtccttgctgcaaagtacatatagtcatccctcagtgtcccagggtattggtcccaggatacccctctgcccccaggataccaaaatcctcaaatactcaagtcccttatataaaatgatgtaatatctgcatataacctatacctgtcctcctatatgctttaaaaatcctctctagattacttaatacctaatacaatgtaaatgctaggtaaatagttattatactgcattggtttcttatttgtatttttttggtgttattttttattgttctttttcaaatcttttcaatcctcagttggttgaatctgcggatacggaaccgcggatacagaggcctgactgtactagctaagtgaacttaaacatatttcccagtctcttcacatctcaacttcttcatctgcaaagaggagataaataaatgcatcgcacaggttatggtgaaaaatcaagataatgtaggtaaagctcccggcacagtgctggcccaagggtgacatgcagaaaacaggggccgtgttattattggtatcacagtacaaggaaaggcacatcagcaacagagcctgacatcagatgtccctctcctcttccgagaggaaggtgggactgtatcctgacaactgccctaaatgatgtgcgtcaagaatgttccctggtgcaggtcatcttgcactctgactactatctacattaatttctaaaatatcctgtcccaccagcctctagatatttgcccaaaacaaatgactcattctgctatgttttaattcccacaaagttgaaccttggagaagaggataggaactgcttgtttttgcataaaaatgttcagggctacatagaacggctgctaatggaaatagctcagtcttgtgttttataaagcagacctgctgcatgcacagggattctgctgtttgagccacatcattttctgcttgtcaaggctgacttcactttcactggaccctttctgtccccctgtaccatgtggtaggtgtggccctagagcatggtctggtccctggcttccctctccaaaagggtgcaggggcagctcctggcccaggacaggccgcaggtggaccaggtctaaaggagtgctcattcttttccagagtaaccatgagaggtctcagactccaggacacctcttggaggcagggcagactcatcttcaggtggcccctcagcccagaaagtcaggtggacagagaaggagagttctgagaagtcctttagaccagcactgagcccggcctacacactctcctcgagaaggcgtggccctgttcactttgcccttctccccatggcgttcaggtctgaatcctcattggatccactagccagggattgtgaagagtaatataacggaaaacactgtagggcttcctaagagtcagcactttttcatatattgaaatttaatatgcaacattctgattttcatcatttaatctccataacaactctatgaggtaggtactattctcattttacagatgaggacactgagccatagagaggtcaggtgtcatgcctgaggtcacacgctgggcacagtggctgagccaggatttacactgaggctgtctggttccactgcctgtcattgttcccctcacacatcctctgagttgagtatcatctagcagttcccagggactgattgataggagcatctggtcataaatcatagaaatagacccttatcttctttagtaggaaatgactcacttgttttaagaggttggggatgggaaaattgtctctgaggcccatagggcagccttatctaagggaatgaccccagtgggtttgattttaagagccaaccctggtttaaaaaaaacctcaagcacagactctccttcctaaaaatggatccttcctgttccctgctgaactgtgagccacatcacctgtcctttctcctgcagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagtaagcaggctcagcccagagctgcacagcacccctgggctcccttcagccaggcacatgggggcacgcctctctccaggcaccaactcagaatatccccagctcccatcagctgcttctctacacccagcttctctgcatagctgcagcttgtgtggacagcagatatctggtagacaccagtctccaactcagtcaggactgagctgctttgcatcttcctgaacaaccctaggatgccatcacacaggtcagggaagcagccacacactgtggctcagtccccaaagggcttggagagctgctccaccatcttacctgtcacctgccaccttccactgggagtcccagaaaaggagcaggatagagagaatggcacagtagaagtggtatatgctgggttcacaaacacagatgcctgcaggtgccaggcagataagaaaatgtctgcaccaagccagacatgagacagcagggagtgttggggactgaagtgacctggagagggcatgcccatccacagcagtgcacatgcaaaaatgccagcacgttagctgaacaacacacacgtgggggccaccagaagttagtgttagagatattctggtaacaataatttccctgttttctacacattacagtccagaaagtgctgtagacatttgcttatgtgaggtcaagcttaagatccaccagttggtgaactcaactgtaggtaataagaacttcttgaggacagagtggagggcaactgctcaaattgatctttcaaaaaactctgggaggactggcctggtcacccagtacaaggactccagaatggggcctggcaccagctcagacatgtccccagggctcctctcccaacactgatgggaaatcatggccctggttgtgggagcttgagcccttctgttcctcatgcagcccccttccctgccaaggagtggcggtgggtgtgagcgctattgagctcctgtcctttctccaccccactcaggcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccaggtgagtgtcacatgggcggcaatggctcagccttgcctctcaacagaggcccttctgatagtggtaggtcatgtttagagggtgcagacaataagccaggcattcttcacattcgctcttattcctcaacagccctatgacagactacttcaattatgcccattttacagaggatgaaattgtctgctacagctttcatgattgtagcagctttaatgatggtagcactgtggtaagtagctgagatgactggaattgggacccaggcagtctgaccctagaacccacacttctgatctctgcagcagactgccttctgcatatcctcctcattgtgtaactaagaagtgcaggcacagagaggcttagtagattttccagagtcacagagcaagtcacattgattagaagtatatgttgtatgctccccagttaagggcctgtccaatcagcttaagtgacagtctcagcaaacttatttctattcagctttgagcttttttttaacctttacaagcacatgctttctttgagcacataacacaatagagcaactatttcagataatgaaatctttatatggaggtcagacatcactggccactcactcatatggtgcctgaggttttgagcttccttaaggttacttggccccttcaagactgttctgaactccctcaactctctctgcagggcatggagattgtacagaccatgaacagtgatcctggcctggcagtgggtatgtccagggcctcagttgccactcacatagaattcttccagctactagtgtggtttgtctattgttctaatcttatctggtccctacagggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggtattggtggtttgaagtcattcatctccctttcttctggacctctcatcttttttcagatattgtgttttcccatgtggtacttagttaatctaaaaaaaattgatgcatttatgctaacgttagagtcagggaagactacagttgacccttgccttcattcctgtgtgccagctacattctaacctctcatggtgggaatcccagcctacatgaggtcagagagagggaaggtttagagtgcatcttcaggcacactgtgttggaaactggctaataaatttcatcgataggtccaactttgtacaggagggctgatgggctacttctgtcactcctgctaggacacaaggctgacttaagtagccagacgtttgataggagccctcattgggcaaatgtagggagcaatggatgtgcagcaggaacaaacatggaatgtgtaatggaatactgggcaaggcttagtagtaaaaggttggggtcacctccatagaaatgacatttaagtgtttatgctttgttctgaatccaaggcagccggattataaccatgactataacctggatcatcacttcagatccaggaagcaggaagggtggtgcctgtgtcctgtcctaaaaccttgcttgtgtcatcatgcaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcaggtaggtagaggccccatctccttaccttgctctagaagcaaagcattctccgttctgcatcccagagccttcatttccctgagcaattctgacctaggatagtccccaaggacatgccaggacttttgtgaccgcaggatggggaacctagaaaagaggtgggagagaagatattcagggtcagaccacccggacaggacagtaggaccaagatggggatagaaggagcagagctgaggggacgacccagcgttgtggggttggtgcatttggatggctgtgcccttctgccatgctctgcagagaagcctgagggtggacatgccaatcggtatgaggtaagaggtgtggcagggtctcttctccacaccctcccctgtggcacctctgggccctgtgtaatcacttactagtgcacatttcaccctgactgcagcactatgtcccttacagtctgtcttccctgctggatcacaaactgcatgagagcagcgcttgtatctttttttttttttttttttttttggagacggaatcccactctgttgccaggcaggagtactgtggcgtgatctcagctcactgcaacctccgccttcctggttcaagtgattcttctgcctcagcctcccgagtagctgggattacaggcacgcgccatcacgccaggctaatttttgtatttttagtagagatggggtttcaccatgctggccaggctggtcttgatctcctgacctcgtgatccacccgcctcggcctcccaaagtgctgggattacaggcatgggccactgtgcctagccatagcttattattttatcttgatctccccagtgcctagcacaaagcctgacatctactacacgtggcatgaactgatcatcatgtaggccaaagtagtctgacttctttctttataggacttttttgttgttgttttttaagtattctcgggagttaggaggcttagggctgtgtctttgaaatgtagatagtgttcttcttcatttgaacttgcagatcaacacccatcctagcctatgtaggatatttaggaaggagtactgagtgcattctcctcatcagggcaggaaagcagccttgtggaaaaaagaaaatcatgagggcaaattcatgttttgtttctctttgtgacattatgtcaaatgtactctttttgtctcacagtgagatgatcatgttctcagccctattaagcccaatgccccttttttattataaatattttgaaatgcccccttttccgtcccaaaatggaatcatagaaattacaacctacctacacgtataatctagaaaatcaatgtgagccctaacaatatcatagagaaataagaataatttataacaaaataatttaaatatttgagcacagccacaccagaagacaaaatgaaacagacacttgcacccatgcctagaatcactacgaaggtgacattctaacagactgttgtgtcagtgacttaaatgtttgttacactggttgatgacagcaatgtaaatttctcaaatggtacacattttagaatgttaattttcaaacaaattttctcaatttaccctggaaaatatagtttatattaaaatttgtgcaaaatatacttgctgtttacaagtgaaagtgagtcaggttctaggccctgatagttgctctttacctaccctggtgtctgaggaacactccagaagtgtatggaatgcaggacaggttttgattgttctcgccagggcattgctcgccatccagcatccctggctgccatcactcagtgccactgtgacaacccaaagtgtccccacagattcctccaactctacttagggagtgctgtctcctgtggagaatcattgctctgagattccaccaaaagatataaatcagaccaaaggaaaagccaaagtttttaagcatggtatctagacaaggcaactcacatgacaataagacacaaaactttctcactcaagatatcaggtttggtttggtttgatttttaactcaagtttgatagtgtgaccaacatcatgttaggccttgtgagagacagaagttgggaagaaacaccccccacccccctccacacacacacggacacacacggtccctgccctcaaggacttccagtctagtaagtaagtgggaacagctacagtacaatccaggtcagcgaaaaatggagcctaaaacagagcaaagaaagacgcaggtacgtataagaagtggggcccctgggcctcacagtgggcactttaccccgggttggatttcatggaggcccctccggccgtgttgtccgcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatggtaatgtgcattctcgttactgttcaacattgttactagaattagtcaaacactgccaccttatttttataccgcacttcccccccaaaagcccaacgctcataccacatagtcattaaaacctgatagtccctgtgtaccagaagtaaaaagcagatcacatttatcctattttatccatgtggaaattaagacccatagaatttaactgcatggtttagggtttggggttcagtgagaaatccagtcagatttaatttacaggaagcctttattttcatgtggttaaaacataatcacagatgcaaaatccattctgcctgctgattttctgcacggccgggaaggagcactcctgggctttaagccaacggtttgcaaagcagcctgcaggagaaaatggcggcgagggcctgcggggcgtcctgggcgggctaacagcgccccctacaggacgcctgagccccgggcgggggtccggggtccggggtggaagggagcctgctaacctccctgtgcccattcctattgcagacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaccgtgttgctcagacattgctctcacgtggctcaggctttgaggtgcccgttctcggagggatccctgttaacttgcagggtggtagtttcttctcagacccggtggccgataagatgagcctatgcgtgaatcacaaggcccaggccagaggtctcagctggggtccccccagtttgctccatacaaaacgcctaaccgttccatgctcaccttggcagcctccttatttcgggtaaggggtctcagaaacacgtgtttggggtggcaccttccctagggaggcgtttttctgacctagtcctgggacagatttgcccaattctttctgatgctgtcatcccatcccacaccttccacagacttctattctggccccttcaacgtaattcttaagcttatttatatatttggctccccctagtggactgtaagcatattgacaataaaggatcatgtcattacaatcaatatccccacagtacctggaatgtagtaaatagccagtaaatgtttactgaattaataaacgaagaatgaatgaatgaatgcctcttaaaggacagtagagtgtacatgatcataaaagtcctcctcaactcaaaaagtcacaacatatcctctatttgtggtaccagtagctggatgtacagcacagaaacttgcctaatttgtacactagcctttcttgtatttcaattgtaaatcaagatccaagcaaatttttataaattctctagaaattttgtttcaaagaatattgctgtgcggttatatattttcttattccagaattcctagagatatattaaatcatgtatgaagaaaaaaacaccacagttttatcatgactttaacagtgagaaaatacaatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatccaaaaaattagccaggtgtggtgccacttgcctgtagtcccagctatttgggaggttgaggtgggagaatcacttgagctggggaggcagaggctgcagtgagcagagattgcaccactgtactccagcctgggcaatgagagtgaggctggtgaaaggaggcagcaacccacaccatgcccacccctggggcagcctccctgttgtcggctgtgcaagcccaagaacgcagtatgtccacaggaaacagactctcttggttaaatcttttgtgtctataactattttagaaaccatgggcccacaggagatccagaacataattccatcccttagggagcttattacatttttgggaagacaaaacttgttatttatgcaaaacaagaaacaaagacgcatgtagaaccagcagtgtgctgaagccaactcctaccagctcataagagccaaatattcaagttttaggaatattgtgagccagttaaacggttggtagtttgaaattggccatggtgggagtatttacacagaaactggcaaacactacaaatcagggctccagagaactggttgttaaatatttatcagcacacaagtgattattctaccttgtcctattcctagttggccctccttatatttttgaagctgatgtagaaaacttgaggctttcagaaaatttcttgcataagaaatgaagtaagaaaagtgaaaatgggtggggtgctatggctcacacctgtaatcctagcactttgggaggcctaggtgggaggatcgcttgaggtcaggagtttgggaccagtctggccaacatggtaaaaccccatctctactaaaaatacaaaaattaggccaggtgcagtggctcctgcctatactcccagctcctcaggtggctgaagcacaa

SEQ ID NO: 16003 - DNA, 8880 bp, Human
acctttgcctccacacccggctaattttttgtatttttggtagagatgcctgcaatcccagcactttgagaggccaaggtgggtggatcacttgaggtcaggagctcgagaccagactggccaacatggtgaaactccgtctctactaaaaatacaaaaaatagataggcatggtggtgtgcacctgtagtcccagctactcgagaggctgaggcaggagaatcgtttgaacccaggaggtggagattacagtgagccaagatcgcaccactgcactccagcctaggtgacagagtgagactctgtctcaaaaaaaaaaaaaaaaaaaaaaaaaagaaggaagcctatctgactattgcttctcccccgccatccttcttacagcgtgaaaagtgttgttgtagagaaatgtacagaaggggtaactggctctgtctggggacgaggaaaggcttcccgaaggaggtaaattttcagctaaacttctcaggatgtagagtgcttcctccagttgtgggagagagagaggaggatatttcaggtgaagcgaacagctttccccgctgaccctgtgttaagttgcccaggggctctacggcgaaggttccccagaggaagggatcttccatacttcaatgaggcactttaagaaacccttgagttcagctggaattcagaccttccagagctaccagaaaaacatcatgtgggaaattgtgcccggcgcggtggctcacgcctgtaatcccagcactttgggaggccgaggcgggcggatcacgaggtcaggagatcgagaccatcctggctaacatggtgaaaccccatctctactacaaacgtaaaaaatcagccaggtgtggtggcaggggcctgtagtcccagctactggggaggctgaggcaggggaatggcgtgaacctgggaggcagagattgcagtgagctgagatcatgccactgcactcgacagagcgagactccgtctcaaaaaaaaaaaaaaaaaaagcgtcatgtgggaaatggcttttccagcctcctgtaggggccgctgctgccccagactcagccagtcttgtctaagaaaactcagaggacgtctctgctggggtggtggtggggtacaccctggacctgccgccatccaaggagtgaacttaagggcgacagtgcccccaagcctgaagaatatgcactcagtcaatggcatttgggggtagggagggggtgtagtgggcactgatatttttcagtctctgggtcaccacaagtttattaaaataaaagaaaatgtgggtaaatgctgccatctgtgctgtccctactcccaatacacacacacaggcacacacacacacaggcacacacacacacaggcacacataaacacacacacacacacacacacacacacacacacacacgcataacaaatcaggtcccagactagatgcaggagttgaaactgctttaaaaacactctaagaacttaactacaaacccacactccccatgcttctggggcttaagatctttgagctcattcttcagcatctctcctcgggaaagtggggtgggctgctccatgaggtggaggtgaagacccctgagtctgccccgtggagggggaggccccctaagcctagagtcccgctgcagggctctgtgccaggagcccccgtgagccatggcctcgaaagggcagcggtgatttttttcacataaatatatcgcacttaaatgagtttagacagcatgacatcagagagtaattaaattggtttgggttggaattccgtttccaattcctgagttcaggtttgtaaaagatttttctgagcacctgcaggcctgtgagtgtgtgtgtgtgtgtgtgtgtgtgtgtgtgtgaagtattttcactggaaaggattcaaaactagggggaaaaaaaaactggagcacacaggcagcattacgccattcttccttcttggaaaaatccctcagccttatacaagcctccttcaagccctcagtcagttgtgcaggagaaagggggcggtcggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcaccttcgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaaggtgagggggcggggtggcaggggcacggctcagagggaggggcatctgcatgaatggaggggctttcaaagccctggcactgccctggtgggagacactgtgtgcatctggcccggggtgggtgtctggggacactgacacatatctcacacatagcagatcctaggctgcccacacatcagggctggagggcacctaggaagcaccaggtccaacgcctgcaaggtgcagagtgggcactaaagcctagagaagagacaagacctgccagttcgtggcagagttggagaccagattccgagacttgattgctcagttgtgcatctgtacctgctgggctggccgaactttccaagctccacaggtttgtaggcggtctcagacggcagagaaagaaatgaatcttgaggtccccatgcttctgcaactttgccctcaggcaaggggatagaggaggcaagagaggtgcacacagtaaatggggcatcttggagtcatggaatgatgttcagatacatggggagggagcagacccagggcctaactcgcagtatgaccttgggaaagctccttctcacttggggtctccgttttcccatctgtacacctatatggggttggacagggtggtttctgagagcccttccaacatgaaaactttagatgctgtcctgaacatgcctcattctcctcattaactccagagactacctgctcccctctgtctctctcggcccacctaatgttactgttgcagcttttcctctccacttgctgtgtgatctaagcaagtccctccccctctcagggcctcagtttcttcctagtgtgaagagggaggtgggctgttggtcgctcaagttgcctgcagctcatttgctctggtcctaggctggcagggtgggggaggggtcagagggtgggagaggctcctcattagagctggcctggagggggctgccagggggcgggggaggcacagaggcagcaggtctggctgaggtgggggaggtggtctggctgcctgcccagccagggaaagctgtgaccccttgggggctcataaaataagtccgtgtgccccccagcactaagggagcttggagagggggagatggggagtttaaaggcctaattagtcaccttctagagcaatatatgaaagctccccaatggcaaattgcaatttaggaaggagggcatgctgattcggagatactactgagcttctcacatacacatacatagccttatgtttatacacacatgctgaatcacacatgtacatgcatgctgactcacacacacacgtgctgaatcacacacgtacacacatgccgaatcacacacatatgcatgtgcacacacaccttcttacatacacacacaagatcaatcatgcatatacagacatatatgtgctcttcaaatagtcacacaagcccaatcatttatacatataatgcgtcattaacgtatacactctttcatattcacatatgaacccaatcacacacatgcatacaactgtaacacacacacatgctcaggagagtaagacacataggcaacaaaatccttgcactggaaagccaggaaaattgggctgtaggtcagtgtggaccagctttgtcattaacttgctgtgtgaccttagtcaagtcactccccatctctgtgcctcatctgcataacaagagcaccaaggtctcctttaagggatggtggaagcagctgagaatttgagcaagtcatctaacttctctgaaccttgggattctcctctggaaaagcgtgtattttttttttttttttttttttttttttttagccagggtctttctctgttgcccaggccggagtgcaatagcgaattcacggctcactgaagccttgacctccctggggtcaatcaatcctcccacctcagcctcctgagtagctgggactacatgtgcacgccaccatgcctggttaatttttgtattttttgtagagacagagtgtcaccatgttgtgcaggctggtttcgaactccggagctcaagcaatccacccacctcagcctcccaaagtgctgggattgcaggtgtgagccactgtgcccagtcaacaggagtaattttaatgctcactccacctatctcacaaatgagacatcacgttagctcatggctgggagagagataggtagaaggcagttacaaagctgataaatctctgataacacgtatatcatgacacaaacaccagaatcacgcaaatcatccccagccacatcttcaggtgaacacccctacttggtcggctatgtaggaaatgctctcattttcaaaaaggctctcagtggtttggctcttggcttctgtcagaatggggcagaggtgaaagaaagctctctggacggggagagagctggggccttcccccgcagcctcgaagtgactggctcccttggtgaggttgcagggaatgacttctgggtgttctctctagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggccgccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaactgtggcaaatttcttgtttactccaggggacccagtgaccccttgaagaattactgacccagggcagggaggtgggttgcttcatgtataaactcagttttcagagccctatccccacccccactcctggaaactgaagcacaatgggacagagagtgcagctaagcagggccagtgctcacctctaaccgcattcctgttccttccaaaggcccctgggtcccgagctctatttgctccattggggcctggcagcagaattatattttcttcttgagattccttagtcaagtttgttgtctccaaaatagatccctaaaagggagggaaattggggatttcatttcttctaaaatcattcctacatcatcgaccaatatctgcctgccctgctacccccatactcacagaattacctgggcaccattgaaagagtcctttatctctcccctggggaatctgggctgccaaggctctccttctccctgttggggcatctcctctcgccactgaccactgttcctcacatgaccatgtctgtggccctgttgccctccagcttgacaccctcactacacctcactgctcacccatcagcccccagctccagaaacagaatcggagtcccctgcctttatattacacattatataaatacataattatacatcagataaataaactccccactaacctcagacagacaaatgccaggcacaccctgacaatgtttcctgcttggggcttggcccagagtaaatgctcacttccttttctcagctggaatctttggggaggcacagggcacagacttttgggaggggaacatagccctctggtggggagacaggcatatgggtgccttgggctgaggactccagttctacctggcagaatagacacagggagaaccaggagcagtctaagcctccacttcccacccagggggcttcaacatttcccctacctccctccagctgggtctttgattcctggggctcctcaccaaagctgcttcaacagtagggattcctacccagctatgggcagaccttgtgccctttccctctaggcctgaagcttgggcacagtgcgggggcagcctacctttgagctgcctccttggtctggaggctattacctctctctgaggggacagactgagcctggagcctcccctcactggctgggcttcgttgtgtttggctagtggtgggcctggcagctctggaagtaaacaaaggagctgccgtggcagacagagctgtggtgtgtgtgaggggagaatgggcctggaagggaggtgctggggaagccaaggagtgggctggggatccagggagagcagtgtagaaactggggggccagaaacccaagggcagatagataagatgaatgggtcacaggtggggctgactcccacaggtattatttcctgggctgcgtgtccctggtttcttggaaagttctgaccgaactggagcttctctctgccttagcccagtcagagaggttcatgtcatctgagccacaatgcccctcctactgaaggcctgggctcccaatggactgtttggattgacacgctaggagtttcctctaccaccacaacctgccctagggctctctttcagactgtggaccctcctgcattttcccacccagactctggggatgtgatcaggtcacccatcctaaccacaggatctgttcagctgcctccttggaaaacactctcccccagccacccacctccaaccgcaaccataacaagctgcaaactggtactgttcattcttgccccaaagggtacaaggcatctatcatacttgagagttcacaaacactctccacccatggtcactcagctctgaaggctgcacactttcaaaatttcagttctgtcacttagagttagaggccttgggcaagtaacttaattccatgaaccttggtttcctcatttgtaaaaaaaaaaaaaaaaaaagagggttaa

SEQ ID NO: 16004 - DNA, 20023 bp, Human
ttcaaattctcactgaactttgattttgctaaataaggacattaaaaaaaaaaccaaaaaactccactattgcctattgccactatttgattttttaaaaaataagcgtattttagcatctaaaagtaggaaggacctcaaataaatgagtctttgttcttggccagggaaaacagcgttgtcagaatttgataactgtttttctagggtatgtgctgttattcagttaaaaccttgcctgggacgctagcattcagtaaatacttgttgaataagcaaatgaaacttaagcttctatgtatagaaacctaagtcacttcacattctgattagcagagtaattgaatattcttttcaatgtgtagctctatccccagaaccacagaatattggaactgtaaaggccatcctatagtttaaccaactgcgttaaatagataatagaaagatgtggtatgtggcagtgacaacttgaaggttgtgactagaactcgggtctctggagtgttctattatatcacaccaagctggtcaccagcccatgtgttgatcctccattgtgatagcaacaaagaaaagacttcaggacattctttcctttaccctaatccttgatctgcagtcttatttagaaaagcttaatgttaaagatctagtttattcaaaactaaagataacaaggagtatgagaatttctatttcggagtgtaaaggaggagatgtttccttggcttctctgagcctgcaggccttccttgctctttaaggaagtagagagagggaggaaagtaaagtatgcttttgttttttaaggttactttgctgggagtagtttgcatgccttttggttttcttgggtggaattaactgacttaagttttaagtagttgggactatttaaaaacaatgcctatccaatgtttgccataaaggcagagggtattggctttagaagttaattcttctccaggagtgaaaattagcttctaaaccagaagcagcagagctaaataaagtaattttccacctggccagtgcatgatgtgaaaggtagattaaaaaaatgagagggcccattttctgatgaaagactaagccatgttgaaacagccctgttgaggattttattttaaatctatacattcacaaaggagctttgtgtatgtctttccctatttgttgtttggactaggaagccccacccagtgcttgttgaaggcagaaagtcgttgaaagcaagctgggatttgaacagtggattgaggtttcgaatatccagtgaaccaaaatatatcagggttcccctggccaagatgagtgaccattctgaggtgttaagtatttcttgaatggggattttaggaaaagtttctgtatttctgtgctcattttgttgacctctgtatgtgcaaaatctctaagggggtgtttgggcacttagatttcttggatgcagatttgtttgtatatgaaacaaattttaaattgttttgtatacactggatttaaaatagtttactaaagtgttttaattttttcatcttaattttcacagttcttatagtctttagatttagggaggctgttgatggcatccacatgtgcattttagtggcatttaaaatgtattcagctgaatttaacaatttctgacctaaaacttgacattttagatttaagtcggtaaagcactgatttaaactggattttaactggatgaaattctgatttaataagtgtactgactggataaaatgccaatgatttaattaacaagcacgtttaacaggatgccctatatattagttaaaagtgaagcaattgaattaggtaccttctctgctgcgtggaaaagaccgtatgactcacccacaccagccttctcttcgctctgagtgtagctaaccgtttctgttttttttcctctagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctgggtaagctgccctgtctccgtcccgtgctgttccgcctgtgtctgtctgtctccccgtctccccctctctattcccatctccagacaacgctggccaggaatggggtttggagagccagagtcaagtccaggctctttttggtatcactctgtgtaagtcatttaacctctcagggccttaattttctcatttctgtaataacagggttgagttaagaggtctccttgttctgaaaatatatatatattttttaaacgtgtatcgttttgctcacaaaacacactttaaaaaaaaaataacttgtgcatccagcccaaatgcactgcttcttaactggggcgattttgttcccaatcagtatctggcaatgtctggaggcattttggttgtcatactgtgtgtgtgggtgtgcctgctggcatccagtgggcagaggccagggacactgctcagcatggtacagtgcacaggacagccccatcatcaaagaattatctggtcccaaatgtcaatagtttgagcattgagagaccctagccttcacttaagtttttctggcgttcctgatctttttctgtagtgaatttctagtggccataaaaggtactgggagtgatgatcaactagagccaggaatattatttgggcagccgtttggtgctgtccaaaaccttgtcctttctgtctggcaagctagtatccatttataggtacctcaggaacccaaatgatttgtcataaaatacaaggaatgtgagcacactgaagacatttttaagaaggctcatttgctcagcagaattttcagtgtactagtggcatttatagaaagagaaggtgatcactgaaggcatgctcacataatattcctgagccctggtgggcgttatctagggcaaaggattccacctgtgtttggagttgcgcccatcctcactgtagccagagcttctcctatcagagtttagtattttgtttgaatagaggatcttgctgcttaaaacagttgaaaagaccctgatgggcaggccgtaattgacaagcgaatgatgggaacatgaatcggtcttagggaagcatctgtcaaagtggtcctcggttaaaacaagtgcctcctcctctcagtgtcacttgattgtgtgcttgaattcttcggaaaactgggtgtatgagacccacgatgaatttgcccacacgattgattggactcttccttcacctgctcttcagccagtgccagttccttttctgatcatgtgattgacgtgagaactgtagtctgtatatcaaatctttagaatgtttttgagtttcctgggacacaggaaacccagcacttagcatactacaaatctaatgtcttaatggcatcataaaaagaggctttaaacacagactccagttagctaagtggtttctgctagtgccggtactgttgcaggggccctgtgagatgccccagttccctgaaagaaatgaaaaggccagttaccggtaggtggtgtggaaaacatgggctagatcatcaggcaggacagaatgcctggctgtgggtgggagcaccccagcttggcgttgagttctggttctaccactgcgttgttttgtgaccaattatgagttgcttaacctttctttgctactatttccctgtttgcaaaatggttcattgacccctgtcttccacctcccaaggacaatttcaacagcctatttgtaaaaagatcacagtcctttaaaaaatataactgtaaagtcagaggtgatgcttgaaagagcaggaaccaggtagatgtggaaatgtcatgtcctttgttctaaagaaaaggcatttcatagctttttggatatgacgcaacataccataaatcctgacacatagttgggagtcggaaattgcaacaacgcccagttataaacccagctagtttgggtatgattgtaagaaaaaaaagctggccattctgtatttggggaattgattttcctaaacttatattatcttagtagtctagatttatcatattgtactatcatcctggcttttttaagacttaagaagatcaagtaaatttttttttctttctttagacactatatagatcatcaagggtgtctgtcttacaggtggatagtgatatgatctacagtgaggggacatttatttaaaacttaaacattcatgtgttttgggggtggtattttaacggcagcacctctgattgtcttttggagggctggtgtgtgtttgaagttctgtcctccttccagtggactctaacttctcctgatgcacgtgagacacattgtcctattgtcctgcagaaactaaagccaaacactgtcatttggggacaggttttcatttgtcagatctctttcgcccacatgagtgtttgtggacaatacagcctgctttccaaaactttgctaaattttgacagactttcctaggtgcttgcccaatgccagactttcttttctgttgaagattaagttgtgcttgctgccctctagtggtcagttgtttaatcctaaccttaaacggcttatttttcccctggtggttgggaagttgacggtttgtaattggctcatttttctaaattattctgaagaagataatttttcccgccagtatgtatgtccaccttcagtttgccagatcctgcctgctcagagacactgagaaccggaagctgcccgggcaattcagtctatgaaatgatctttcttgtgattaaggcaaacgaagaactgaatgtttaatagtgtactctgctgtacccagaaaaaaacaaaacaaaatcatgttataacactctaaaacttcaaacaacctccaacagcatttggtgtgtgtctagccgttttgttctaacccgatgttatataaaagaattttttcatgctttccaaaaatgtttatgtcaagaatatttaagtcagcatgccttattcaggtacttcagctaccttcttatataaatatttttgtttttcctttaagataaaaatgatgatggaggaaaaataaaacatcttacatcttcaagagagtgtagttattgtggaaagtttttccgttcaaattattacctcaatattcatctcagaacgcatacaggtaaagaacttttatttttttaaccatgcattagttaaattatgtagttatctaatttttttgttgttgttgttcagatactctgccagatccttggactagcttaaggataaatatgtagcatgttgattgcagtggttatttttattcttttagtgccattgtaacttgagccattgttcttatttgcagttcatttcttttctttcttttttgttttttgagacggagtcttgctctgtcacctcggctggagtgcagtggtgcaatttcggctcactgcagcctccacctccctggttcaagcaatactcctgcctcagcctccccagtagttgggattacaggtacctgccaccacacccggctaatttctgtatttttagtagagatggggtttcaccatgctggccaggctggtttcgaactcctgacctcaagtgatccgctcaccttggcctcccatagtgttggcctcccatagtgctgggattacaggcgtgagccaccgcgcccggacaaagttcatttgtttagtttatgactgctatgtcctgactcttatcttattaaaagctacagtattttaaaatgctgcatcttatgtctttatgattgagaatgaaatgagaatctatttagtagtcttgagattgtgaaaggagctatgacatcatgatgtaggaggctgcgtagatttgaaatttcatctcttccacttactatctgtgcacccttgggcaagttatttaacctttttgtgcttttagttttctttgctgtaaaagtagaataatacatatttccctagggctgttaggaagattaaataagttagaagtgttgctgttaatttttctattgaagataggcattcataatttcaaatattcattacagtaaggatgataaagaactgatgagaaatcctatgtgatagtagatcgagaaagcaaaaggaggaaagaagcctgttttcttaataaatagatatttgatctatttcagtgcttttcatacacttctataataaagtgccatttcttgccttaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtattgcatgaggggcgtcgtgtttaaatggctgcctacagtgattaatagctaatccaggcattctcagtggagatggtaccactcccaagggtggggggtaggcagccagaagttcttgggggtcacagagagaagcattcttagatacggcagtggtttgtggtcctccaaggcttacttaactctgtgggtttaactcttaaccctgtgtattttattcttttgatttgtttagtcttactttatttttagagaaagggtcttgctccgtcatctagattggagtgcagcggtgtaatcatagcttactgtagtcttgaattcctgagttcaagagatccttctgcctcagcttcccaggtagctgagactatatgtgctgctaccatgcacagctgatttttaaattttttttgtagagatggagttgcccaggctggtcttgaactcctggcctgaggtgatcctcctgcgttgacctcccaagtatcttagactacagatgcactccaccacgcttggctaacttaaatttatttttttgtagagacagggatttgctttgttgcccgggctggtctgaaacccctggcctcaagtgatcctcctgcctcggcctcccagaatgccagcattacaggcgcgagccaccatacccagccttattcttgagtaatttttcttgtcaattttatttttctgttgtgagagtgatcatggaaacagtgggtgagaacactggtctgtctagtccattcttgtcttgctgttgaaattccagatgcagccagttgaggccccagcttgcctcacttcatcacagccctttttcttcctttgcacatgtatggtgtgctcagtagtcagtgccaatccacctggagttgcgggggttttttttttctttctttctttttttttttttttttgagacggagttttgctcttgttgcccagcctgagtgcagtggcacgatctcggctcactgaaacctccttctcctgggttcaagcaattctccagcctcagcctcctgagtagctggggtaataggcacgtgccaccacgcccggctaattcttgtatttttagtagagacagggtttcagcatgttggccaggctggtcttgaactcctgacctcaggtgatgcactggcctcggcctcccaaagtactgggattacaggtgtgagccaccgcgcccagcctaggggttcttcctcacgcattttaccattccctgctggcctgtaaacttcttaagagcagaaaccatgttttacatgtacagcatcaagtcacatgcttcccacacggggcagaatagggggcgcccagtaaggaccacacgtggacccttgacctggcaagagcagaaagcaaaagaacttccgattaaagagtcttgtgaaccgttttgctgttaaatgttgtcagccctccatatccttgggttctgcctcagtggattcaaccaactgcgggactaaaatatttgggggaaaaatggatggtcgcatctgtactgaacatctgcagttttcttttccttgtcgtaattccctagataatacagtataacaactatttacatagcatttacttcatattaggtattataaataacgaagagatgattttttttttttttgagatggagtcttgctctgttgcccaggctggagtgcaatggtgtgatctcagctcactgcaatctctgcctcccaggtccaagcagttctcctacctcagcctcccgagtagtttggatgcaggcacccaccgccacgccagcctaatttttgtatttttagtagagacggcatttcgccatgttggtcaggctggtctcgaactcctgaccttaggtgatcctcctgtcttggcctcacaaagcgctgggattacaagcatgagccaccatgcccagcagtgtagagatgatttaaagtatatgggaggtgctggatgtggtggctcacatctgtaatcccagtactttgggaggctgaagcgggcagctcgattgaggccaggagttggagaccagactggtcaacatggtgaaaccccgtctctactaaaaatacaaaaattggctgggtgtgttggtttgcacctgtaatccgaactgtttgggaggcttaggcatgagaatcgcttgaaccggggatgcgcagattgcagtgagtaagtctagattgcactgttgcactccagcctgggctaaagagtgagactctgtctcaaataaataaataaataataagtaagtaaagtatatgggaggatgtgaataggttacgctacaatactgcaaattaatagtactacaaggccagttgcggtggctcacgcctgtaatcccaggactttgggaaacagcctgaccaacaatggagaaacctcgtctctgctaaaaatacaaaattagctgggtgtggtagcgcatgcctgtaatcccagctactccagaggctgaggcaagagaatcacttgaaccttgggaggtggaggttgcggtgagctgagattgtgccattgcactccagcctgggcgacagagcgagactccatctcaaaaaaaaaaaaaatagtactacagatactatgaatactgcagatacgacactgttttatattagggacctgagcatccatggattttggtatctgttggctggggtggtgggggcgggtggtcctggagccagtgccctctggatactgagggacaactgtattaatttaaaaccaaccttatttcccccataggtagattgttaacctcatagatgactggggttttccccatagaaatgtgtcctggtggtgtcacttcgtacaggtgtctggcacatacctgtatgtgtaaaaaagtagctcagtgtcccagggacatcttctccttggcaaactcggtcaaactgcagcatcttcctttatcacatagaagctctactggtttgtgctccccaaagaaacagattcagttttgcacatttcagtttgtgttagtttcaaactgaggattctgtgtggtgacaacactctgtcaagaattgcttgatgctgattggttcagtagagatagcaaattaaaaaacaattgctttcagacactccagtagattttataaaaattgtgatgaaatagtaatttttactgccttttggttaaaaatcttcatttccccccccatggtgcttaaaatggacatgaatcaaaactttgtctttacttaaagggggaaaaggctctgtgtgttgcaagtcagatcctcttttttttttcccctcctctgtgagacagggtcacactctgttgcccaggctggagtgcagtgggggcaatcacggctcactgcagcctcgacctccgggactcaagcaatccttccatccttccgtctcagcctcccgagtagctgggactaaaggtgcatgtcaccatacccagctaattttttatttttagtagagaagaggtctcaccatgttgcctatgctggcaaatccccttttaaatgattttaaaaaaagcaaaaaacaacacttttacatagtttggttcatgatgcatatacgtttcaagtattttgtgatgtcatttttttccggctttttaattctttctagtgacagcccagacaattttaatgttagtgacatcaaccaaattctgtgctaacaagtgtcataaaaacaattcagctgtaactgaaaacacttgcatgcgactgtgtgacttaggcgttgattacattatcagtgtcagaaattttgaaaattgacttctaaaaacctatacacatcttacctaattgtttgaccttaactctaaatatgttttttttttcaatcaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtgagcatatgtttcaattaaaaacactggattggctgagtgcggtggccatttgggaggtcagggcgggcggatcacctgagatcgagcatttgagaccagcttggccaacatggtgaaacccctgtctgtactaaaaatacacaaatttagctgggcgtggtggcgggtgcctgtagtcccagctacttaggaggctgaagcaggaaaatcacttgaacaacccaggaggcggaggttgcagtgagcagattgtgccactgcaggtctagcctgggtgacagagcgagactcagtctaaaaaaaaggggggggggggcggggattgattttacttgatcggaaataaaccattaagttgtctaatataatgtaacaaaattgcttttaagttggattttgattttttaggtgttttaaaattagagtcctcaggatctttggatattactgaagataataggaaaacagtcatagtgactggaatttactgagcatttactttgtgctaggcattgaatgaagtgttttattatcaggatctcatttaattctgttgcagcagagggcttaggtaagggatgagcaaactagcttttcatgcatcatcatcaataaagttttattggaacatgatcatgcccatctgttacatattgtctgtggctacctccttgctgcagcagcaatgtcgggcagttgtgacagaccacgtggcctgcaaagctgaaactatttaccgtctggccctttacagaaaaagtttgtgacccagcattaggaggtactgtgcatgcttttcagatgagaccgaggcatggattatgcagtttgctcaaagccccgctctgcctgtgagaggcaggagcctggtttttgtcctaggtctgcaaagatccaggctctatgcccaacgttctagtttaagaacttgttcaaagacttggcaagtacttatctgccaagataagtacttatctgccaaggaggggaactgggacaggagcaagtatgtgagcatgtggttcacatgttaaaggtctcactgtagtgcaccgccgtcccgtaaggctcaagtagtagtatcagaattatgcatgttggttttgttagtttatatttagttaattagtttgggcagaaggtgtgatgtctgtgtacaggttatactatgactcattcaacaataagattaaatggaaagcttggggctcacgggcagatttagttgttcctcaggtaactcttgtcccgtaaaaccgtcactgtatattcgttgagcagcctcttcaccaagtgcctgctggctgctaggatacgaagatgaaaagatgctcgtggtccaggacagaatttctctgtcatattttcatcgggactcatatgggaactgagatgacgttctccctgggcagcgtgagccttgtgtggttctgcagtcttttctcctgcttaggataatagatgaagaacacgagggagtaaagctttgtcatcacaggaataagatccagtccactctatattaaaacataaaaataatttatgaattatgaggagcagattttagtaacaggttactcgaagcatccattacaactgatcagtagtagcaaacagccatgctcctgtatctggagctggtgtctctctgggagctctgagcttctctgcttgtgtttccttcatctggagaacatcctgcctgctctgtctttgctttccagcctcttctttctcatcctctggaccagctcacatattggttttgtttgtctgagacagggtctggagtgcagtggcacgatcttggctcactgcagcctcaaactcctgggctcaagcagtcctcccaccacagcctcctgagtagctgggattttcttgtgcatggcaactgccttttactgaattctgattcttggttaagtcatctcagttaaattactaaaagtagctccaaagttcgcagcattatctagttagtcattctcctaatactttcatagcaaaagttgaacttaaatagaacccagggccaggcgcagtggctcatgcctgtaatcgcagcactttgggaggccaaggcgggcagatcacttgaagtcaggagttcaagaccagcctggccaacatggtgaaacccttctctactaaaaatacaaaaaaattagccgggcgtggtggtgcatgcctgtagtcccagctacttggaaggctgaggcaggagaatcgcttgaacctgggaggtagaggttgcagtgagccaagatcgtgccgctgcactccagcctgggcgacagagtgagactgtctcaaaaacaacaacaacaaatagaacccattgcatttctaggtcagtttggttctatgtattacgcttttttaaagaaagaattttctaaactgtattcagttttgatcttaatcatttaaaaaatgtttttttccttaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaatttttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgagttttagtgtttattgtgtttctggtttctgattttgttttatttaactttttagttttctttctttttttttttttgagatgtgctcctgctctgtcactcaggctggagtgcagtggtgcaatcacagctcactgcagccttgaacccctgggctcaactgatcctccagctctcggcctcccgagtatcgagccatcatgcctggcttataaacacaattttaaggccagcacgtggctcacgcctgtaatcccagccctttggaaggccaaggcgggtggatcacttgaaaccaagagtttgagaccagcctggccaacatggcgaaaccccgtctttactaaaaatacaaaaattagctgagtgtggtggtgcacacctgtggccccagctactcaagaggctaaggcatgagaaatcacttgaacccgggaggcaaaggttgcagtgagctgagattgcgccagtgcactccagcctgggcaacagagcgagactccatctcaaaaacaaaaacaagaaaaccccacactctttttcttttttctattttttttttttttttgagatagggtcttgctctgtcgcccaggctggactgcactggcgcaatctcgcctcgctgcaacctccgcctcctggattcaagagattctcctgccgcagcttcccaagtatctgggattacaggcgtgtgccaccatgcctcgctaattttggtatttttagtagagacagggtttcaccatgttggtcaggctggtcttgaactcctgacctcaagtgatccgcctgcctcggccccccaaagtgctgggattacagacgtgacctaccatgcccagcccaccaaccttcttccttaggattttagctgccattgatgttgcaaaagtcacttttaaagacttcttaaaattccacatctgttaattgaaattctattaagaagagcttccttatgattatttggttaccctgaaacacagtttcaaccaaaaaaaggagaaatgctcgttttgtttgttttttattcctcttgattaccagctttgaggatgagttggtgccagcattctccagaggtgacccaggaataagcttttacatttttggtatgagctcacaagtcttatacacttgatgtgttgagagcatgtggtcgtcattttgatgcctcaagtctcttgtttttggtcagtgggagttccaagttggcccagtgtttgcaggacaaaagtctgaaggcttcttaactttttgttaaaacatgttctggctgggcatggtggctcacgtctgtaatcccagcactttgggaggctgaggcgggcggatcacctgaggtcaggtgttccagaacagcctggccaacatggtaaaaccccatctctagtaaaatacaaaaattaactgtgaaaccccgtctctactaaaatacaaaaattaaccaggtgtggtggcaggtgcctgtaatcccagctactagggaggctgaggcaggacagttgcttgaactcgggaggcagaggttggagtgagccgagatcgcaccactgtactccggcctgagcgacagagcgagactcagtctctaaaaacaaaccccaaaacaaaaccggagatgatccaaatcccacctgtactgacccacacctgggaaccgtcatttatccaaggatcctgggttccttttatgggaagcggtaattagggcagtttgggcgcaaggggcatttagtcctacctgggtggttgtgctcctggcctttttaatgtagggaaaggaaataaatattatcaaaaaggaaacctcagtgaattatactgctatttccaactcacgttttagagttttctttgattttgtttttgattttctgaaaagctgggttcctggctttaacctactgtatataacagaaacaatgccaatgttattgctcttatcactgcccaatgaacctttcagatttctcttttgagttg

SEQ ID NO: 16005 - DNA, 24508 bp, Human
acaggcgtgagccactacactcagccagagctattctttttcaccaccgtcagcacataaaacgtttgcctcacactgccccacacatactgacatggtaggcattctgatcccccccactttcctcttggtgataattctcatttaagaaatacttccaatattctgagacactctggtttaagaaaaagtgacataacatagcatgatgtatatgggtgtactatttagggcccagcctagaatcagaaaatattgggtctgaatcccacctgagccaatggtaacgtctgtgacattgggcaaattacttagctctgtaagagtcaagggtttttttgtttgtctttgatttttttttgttttttattttatttcattttattgacattgggctgagatgagaactaaacggaaaaaatgatgtaaaatgtctagctcagtgcctgacttatcataagccctagaaagctttcatgagaatattatataacatatggaatctacatactgtatgcaatctatactatattatgtatatttagtgtgtattgcatataacataatctatagtgtatgctgtaacatatataccatacaatgtatatataaatatgtacaagattcataaagtttagtatatatcaatagctattatttttattaacataaacagtcattagcccctccagacaaatcagaaatgatggtgttaaagcttaagttggactgcaaaagatttttaagaaacaaactagaggcttacaaaagaatttaccagggaaggatttgccaacacttggggcaaaaatgactgagacacgtaattgaaaagcagggcgaggaaacagaatgtccctcccctcctccctggctggtggtagttttgtattggatcaggttgaaaggattcgagccactttaaaacaatcaacaaaaatctccaacttccgttcctgaattagcaaagcgagttctactcttgccagccgcggtaactctagaaattgtgtatgtttgtcactggacctgcctaggacgcaccttgggggagagggggagtactgggggcggtggtttcaagctctgtgtgcccctcctttgcacaaggtagtcggtgtagaagaacagaggcgggcagtggacataggggaggtggcccagcctgaattcaagcatcgttggtgcaagccacgctctcaaggcgcatttcctaacttcctaaagaagtaacaacagcaactaacttttattgactgttgactatagacaaggcttcgttgttgccgctttacgtgcattaattcatttaatctgcaaaacaaccaaacatgaaacagcaggaaggaaattctacaaactccccttcttgctcaagttaagaaagtctcctcttctggtgcatttcagtaagactcaaatcctccccaccctgggaggcgcagaaagccaaacttcctccaaaaaaaaaaaggcaaaaaaaaaaaaaaaatcacttcagtccaggctgggggtatctggctccccgggaggcgcccgggctccccggggccctggcagacgccggcagcttttctgggcccgcactcggggacctcgcccgcccggcatcgcgattgtgcaagcgccgggcggcaaccacggccgccgctgccggctcctgcccgccgggggagggcggggaggcgcgttcgaagcacacccggtgaactccgggcttcgcatgccttcctgggggttatctccggggtggagtctgccgcccccaccccacctcccgcgcccagcgaacatagccccggtcaccccaggcccggacgccctcgctcacctcgctgactccatcctccttccaccccccctcccctgggtcccgcgtccctcggagtctggccagccgggggccactccgccctcctctgcgtgctcattggccacccagggcatgctctgtctccataaatgcatggtccctgggcataggaacatggagagggacaggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtaaaccccttttcgcgcccctgactctctcctccctcttccgccctcccagtggcgctccaaaccctccccgacatgcgcgcctcgggcgcatggtgcgcttcggcgtctgggcagggagggtccccggtcccctaggaggaaggaggcgggaggagggaaagcgcttcgggcacggcggaggatgcgcgctgacaccgcgctgtgcccggccggctgcaggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctgtgagtccaatccgagggacctgggcatgcggccagacctgatgagcctgacggcgcctggaaattgtgaagaggcggagttagagttccctggggttggaagcttcttacgtagggcggataccaaagcccctctcccgtgccatcgcaaccctgagctcttgtacagattagagtcggtccacggaaaagccgtgctgtgcacccagcacctgcgttctctctggcaacagggcagggccacaccctcccatcaaagaaacgccaaaacagggttgtaccaactgtggtgttcagactcttgggcaggatgaggttctgaagtcagcgtaccaggcaaacatcttatacaaacaaaattatcccttaaaactccctgaaacaccttgtaagctcaaaagcgaggagttagcctctttggctttttacagtgacattttctgcagaggattgggggacatgccttatttctacttgtaaaggtggaataaggagggatatcaaagttgtgttttaggtcgataaatgctactatgggatgtgattcttctgctttttagttgttagcatttaacaagttagcacctttatttacccccaaactgtaatgcctaatcgttatattttccaggatataatgactggaattaaaaaccctattaattcacggtgcttcacaggctgtatggtctgctatggggcaggtgcctacaagtgcacgatcgcaaaaggctttttattactccagtgactctctgactgtatgttattatttggaggcgatggcaaaattctaaatctgagatattttgtaaatatgaagcccacaccaatgagttgaaagaagacaagattcttccctcaaacagatctgagttgctggtgatggggtgttcacatgcccccttttaccgctaggaattgtccccaggcctcccagccccactccctgcaaggacacctcaaaatccctgaacccaaattatctggacttcaactttttggtgcaatctttgactaggaggaaaggtgctttttcatcctattgtcaaactattgtcaaaagatgatcactattttatcccaaatattctgatgctaatattctctggctatttcttggcatgattctcagtgtttgtttgattttatggttcctgaagttgcagctggagtatttctgcatctccttcttttcttttcagtgtgctctaaatgtattcctgcttctctcacagggaaggggaagactggcagcgggtccggagtgcctttcaaaagaaactaatgaaaccaggggaagtgatgaagctggacaacaaaatcaatgaggtctgcaggctggggccagctttcctggggctcgtggggacatagggatattggtggagcttcaagtcacagctacaaagaacaaaggaaaaaagaatgcaattcgggtgattcaaagtgggggtcttctctttctctccattccttcctacagcctcctccccaccaaacccttatttctccctcctccaccctcttttaaagtcatatcacaatgagggagcaatggagagtgtggactttggtattctacagccctggatttgaaccccagctttccactccctggctatgagacctggctatataccacttaccttccctaagcctcagtttccccatctacaaaatgggagtaacagttcccaccccacgggtttgctgtgagaattaaatgagataacattgtaaagttcttaagtagtgatatttgagctgggttttgcaggaggagtctgaaagcagagaaagtgggggaaggcattaaggcagacagagtagccttctgaaaacagggaggcatgaaatgacgtggtgtgttcagagaatcggtcatttagtgtagctgatgtgaggctttctctgaaatgatactggataggtcttaacaatatttttgtattatactaaggtatttggacattatcccttagccagcacggagtcaaagggagttttaagcataaagtaatctctttttacttctgttcactttggatgtttattttgaactggatgcgtccccagatgggatcatataggtgaaggattgcaaactcagaagcttccagggctcacatgactaatataaaataataaggcagacccagtaaaaatttcaggaaacgtgatagtgcatgcccctcccaggagggacagcagccccagttccagcaaacgaatgccatgtcagaatgcagacctcatgtcaccaagtctcataattattatttacatttttaaactagtagtggtaaatccatatgttcatatgaaacctcttgttttttttaatggtaacaaattcaaagaacttttaaatgcgctatgcgggcaaattaaacttgcaaactaaatccacacatgtgggctgtatggccacaccagctcacggcagggtccaggatggcaacttatcagctctgtgtgcataagtgagtgacttggcctctttaagcctcagctttctcatctactacatgggaaatgagtagagacggtacctactactacttggttgtcagaggatcaaccaatacacttcgtacagtgtttggtaccatatggacctcattaaatgtgaggcattagttattgaaaactctggtttatgaaactggcatccaaaggtcttatgtgactatcccaaggtcatagactacttagggaaggagctgtgtccagaattggtagatcttctggttccaagttcaacatgcttaacataaccaccaaccaataaagagacgtttgcttgcccagatgtggaagggcacacctcaggatagctgctgcaacacaatccttgagatgctgggccaacagggacagttagctgattcctttgtggttttattcccccattctgattagaaaaaaaaaatgttttccttttcttaaattgccagaattatttttagatcaaaagctgaaacttaagcttcagggtggcttcaggaaaagctcaggaaataacccaggacgaggtcattaggggataaggtgggttcccagggagaatatataattagtgtgacttcaggatgaataacattatggccagtgaatatgcgatgtagcaagacctgaagttagctcagtgagctttaaagttttgttttccttcaacggctttaaaatgtgtcttttgcggttgttttctttgaaggtcttggccgattttatgggcagaatagatgagctctgtgatgaaagaggccacgttgaagacttgtacagcgaactgaacaaatggtcgtttgaaagtaagttgtcgtcacagacttgctcactgattttgcaggtgattttgcggataaaacatggctcttttgacaactcttttgtaaacaggcattattgctgcctagggaaaggccagagcagcccttttaatgcttcttttaggtgcttaagttatgccttgaactatggattgttaatgagtcatacaacaaacatttgttgaatacttgctgtgtgtctggcactgtgctaggtactagggatatgacaatgaatgaaacgcataacccctgtacccttggggagcttatatgctagacaaggtgacagtcaacaagtaaacacattttaaaatatactcttccaaggagtaaaggaaaagagaaagggagttaagaaagaacatgaaaggcaggcatggtggcacatgcctataatcccaggactttgggaggctgaggtgggcagatcgcttgaggccagcccaggaatctgagaacagcttgggcaacacagcaaaaccttgtctctacaaaaaatacaaaaattagtcagggttggtggcacatgcctgtagtcccatctacttgggaggctgaggtgggaggattgcttgaccccgggacgctgaagctaaagtgagccgtgattgtaccactgcattgcagtctgggtgacagtgtgagaccccgtctcaagaaagagagagagacagagaaaggaaggaaggaaggaaggaaggaaggaaggaaggaaggaaggaagaagggagggagggagggaaggaaggaaggagggagggagggagggagggaaggcagaagggagggagggaaggaaggaaggagggagagaaggaaggaaggaaggagggaaggaaaagaaaaagagaaaggaaagaaaaaagaaaagaaataaagaagaaaagagagagagagaaagaaataacatgaaagaatgaaagaggggcaagtcttttttagtaagaagacatttgaggtaagtcctaaaggaagggaaggagcaaatcatgagggtacctgtggaggattgttccaggcagcagagaagaaagtgcaaatgccaggaggtggaagcatgagcgccgagtttgaggaacttcaagctgctggtgtgagtggatcacgatgaacaagctgggaggaaggggagcctgtgaaaggagatgaggtcaaaaagaaggcaggtgtccaacagggcacagctcataggtcctggcaagactttacctctcatctgactcagatggggcaagtaagggagggaggacatgaccgctttcttcaaagattactctggaaataaagggcagagctcactgcccatgggggtgcaagaggagagcaggcagctgtgatcaggtgggacagcgcctggctgaggacattcagggctgtgggagaatctgagagggccacctaagccggacatggccaggggtcgcttcacagagatggtgcccctcagctaagtcctgatggttgagtaggagttcaccaggtgaaaagggaggaaggagagtgtccctgcagaagaagtgcggaatgacaagcatatcctgtaacagaggctggcagagggccagcagccagctcatggagggctgtatgagcgggagtttgaattttagcctgtaagtaaccgggagctgcgggaatgtattcagcagcagtgtgatatatgggcagatttactgggaggatcactgtggctgctgatgggagggatagaaggaaaacctataacacttccataaattcaaggtcagaaatattgccataaatagataaatataagtaactttttttaattacttatttgagacagactctcactctgccccaggctggagtgcagcggcgtgatctcggctcactgcaacctccacctcctgggttcaagcgattctcctgcctcagcatcctgagcagctgggactacaggtgcacaccaccatgcctggctgatttttgtgttttttagtacagatggggtttcaccatgttgcccaggctggtctcgaactgctgacctcaggtgatccacttacctcagcctcccaaagtgctggtattgcaggcgtgcgataccacgcctgactaacttttgtgttttttaagtagagatggggttttgccaccggttggtctcaaactcctgacctcagatgatgctcccacctccacctctgagagtgctgggattacaagcatgagccattgtgcccagcagagtaactaattatttttaaagttcatgtaccatccagagctatctcacatattcccagtggtgtacctgccaaccactgtggaacacaaatacggggaaaccttgaaaggctgggaagaaataagtagagtttggaaaacatggaggtagttggaaaagctgtgggtgggtgctgactaagctaattgactctcactcctcaggtttatgattttaggccatttgtttacctttttaatgctagtctcctactttataagtcaagagccaattatccaccactaaaaagttggttgcagtaatcctgtataattttttttttccagactgtgtcactcaggctagggtgcagtggccagtggtatgatctcggcccactgcaacctcggcctcctgggcccaagagatcttcccacctcagcctccagagtagctggaactacaggcacatgtagccatgcctgaataatttttttatttttatttttttgtagagacagcgttttgccatgttgcccaggctattctcgaactcctgggctcaagcagtctgcctgcccgagcctcctgaagtgttgggattacaggtgtgaaccaccacgctcggccctgtgtcctttttttaaaaaaaaaaggttacaagagataatttttaggacaatggggaacattttaaaatgggacacagtagattttttatggaatggtcgctaaggttcttagggatgttaatgacattgtggttatgttggagaatgctttattcttaggacattactgctaaagtatttaacggtgaagtgacctgagagctcaaaattattttcagatgcttcagcacacacaaccacgtatacacttgtatgcatacatacacacaaagagaaagaaatggcagcaagatgttgatgagttcgggggattcaggtattcattttaccattccttcaacttttctctaggtaaaaagttttgaaatgaagagttgagaattttatttgtaaaaaggttccttctaaataaaatgatgaaatggaaggaaaaaaaaccctatatgaagtgctagcccagtacctggcgtgtaatgggtgtttagaacataattattcccttcccttctcttcctctggtgaatggcttccaattcattatgtcaggagatagaatccaataagtgactctaaaaacacagctgggttagaggcagagtgcagacccgaccctgcagcacctttgctagggcccctggatctcctgtgtgacttgatcaggacagtggatctctgatcatgacactctgaggtgatgagtcattggacctggagataatttctagaaaaagaaagtgatggtgtcccctttctctcagactctgcttttcctcaatattcttggactgttgccttttctcagaaaatcccacacttttaagaggcatagaattgagtctttaataaccagctaaacatagactccaactccagcattgctgtttgtgtaaagtgatgattattttaaatgacaggtatctgcctcgtgttgtatgagaagagatttgggcttctccagaagaatgcaggggatgaagctgtgaacttcatcatggccatcaaaacagtaagcagcctctttaagaaagcagttttcttgattgatgttttacagatcgatttttacagaacttcacagtgattcccaaaaaatggcatacacacatattttatttcaatagttaagtgttcattttaatgtgcattatatattttagtatatttatgtgcatatatgcggctgtctccaacctttttggcaccagggaccagtttcgtggaagacaatttttccatggacagggcagggtggtggggcaggggagggaggatcatttaagtgcattacgtttactgtgcactttatttctgttattattatatactcaccataatgtagaatcagtgggagccctgagcttgttttcgtgcaacacgaaagtcccatctgggggtgatgggagacagtgacagatcatcaggcattagattctcataaggagtgtggaacatagattcctcgcataggcaattcacaatagggttcacactcctgtaagaatctaatgcagccattgatctgagaggaggcagagctcaggtggtaacacctgctggcccgctgatcacctcctgctgcgcggccccgttcctaacaggccactgaccagtactggttcacggcctgggggttggggacccctggatatatgcacgtaacataaagaagcacattaaatccattatttctttgtttaggcaaggttaaaatagctattttaattaaagatcagttgattaaaaatactttttaaaaagagcccaaaatttttcagattttatctttttgaatagtttgggtggcgtgtagataggataaacgctgtgaaattggtttggaaatcactgaagtttggaaattattagaaattgaagtgaatatgaaagttatcgtttttcctctttttttttttttttttacaattaggtcataagattacaatttttatcaaacacatccagtggaaaatcatcccccacattaccttcaatattgaaaggaggtggaggtggggtacgggcattgctcccaggaccggtgcagagagagccgggggtgtccttgtaattccagccttttaaaaagtgcagggtgctgcggtttagaatgttcctcttccagaacgaacattgtctttgagagaaggagaattcagaataaaaaggcatttgcatttctctcagatgatgagcacgtttgggaggatgatggtcactccagtcgagctgcacaagagcctcaacaccaaggtctggcaggaccacactctggcctgggacaccattttcaaatcaggtaaagggccgcccttcacaaccagccagaaccagcccagcacccccgtgtctggagcttcagagaggaggtctggagtgatctcctgagcctcatcaccacatttaggttttgcaaacacaggtgttttggggattgccccagcatacacaaattctaagtaacaagctttctgtagtcttctttgggaattaagagtggttaaaagtaaaatctggccaggtgcagtggctcacccctgtaatcccagcactttgggtggcccaggcgagcagatcacttgaggccaggagtttgagatcagcccggtcaacacggtgaaacccagtctctactacaaatacaaaaattagctgggcgtggtggtgggcacctgtaatcccagctactcaggaggctgaggcaggagaattgcttgaacctgggaggcggaggttgcagtgagccaagactgagccactgcactccatcttgggaggcagagtgagactccatctcaaaataaaaaagtaaaatttatagagtcagggactcctgagttcaagttcagctctgtcactggttgtggtggcttggccaaatgtgcaatcaccttttcatcctcagttgccttgtctctaaaatggactaataattaataataataataagagaacctacctcaatgtaactgtttctgggtctactacagattacagttaacataaaaacctggcatatcacagtatctccgtggactagatctatttctgccacatgacgaaggggaatatttgatgctaggcattgttcacttacacatttagttaatcctcacaacacacctataaggtaggtccttttattagccctgagaggggtacctgagacacatagaagttagccaacgttcccaagattgcatgctaggtgatggcaaagccaaggtttgaagccagacaaggagcttccaggactcgaactctaactgctgtgccatatgtgatcagcatgattattaccatataatgagcctggtggttgtttgcttaatagtgagggaggtacacgcctagattttatgttataaatattagaaatttttaccattattgtcaacatggatggacactctacttgtgcgtatgtatgtggggtatgtgtgcttagtaatatctgggtccaagttggattctgaaagtgaacccaaatcctaccttcttttacacttttttctcccaagatctaaactcttactactcaaaactatgacctgcagcccagtggcatcagcatcacctagaagcttattaggaatgcagagttccaggcctacccaagccctgattcagattctgcattttgagaagatgcctaggtgactcctatccacattaaagtttgagaagccttgctcatgtcggtattgaaaaatccttgccgacttgacaagaaggcaataatataattagtgtgtgtagcaaattgtcagtgttcctgaaaagactatttagatattgcaagaaggagtttggactgaggttttcttctgtgattttcctcatcccaattttcagctgacttcctctctttcttctctgctctaatagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacggtaagggtgggctggatttgagtttgctaaatgaacggtctgtaccatttttagatgacagattttaaatagtaattcatctcattcatttcactgggattcactagcatcaactccacaaaaatgaaaagtctcatactagatgccacggtgcctccgcgcacagcatctatgccacggtgcctcagcgcacggcctcataccagacgccacggtgcctccatgcacgggcttctgtgcttaaactctgggtaggaggagacttcatgtgccccagtgacaaaaagccagagtaggatgtgatgagtgccatgatgtccatgcaaactgctacgggagttcaggagcagtaaagttctctgccctggcaagatacagaatccagatttttcaaaattggaagtattttgttcagttgcacatgttaccccaaagtgcctaactgtggctgttacttactgtaaaaaaaaaaaaaaaaaaggcatactctctttcaagccaataatatttttatctgcttagaattgtaaacaaagtcccaaagagtctgggacaagtggattttaactgaagcaaaacagctcattgtaaagaccaaaattctgtctctgatgtggccgatactccctaggagatagcagatactaagtgagaccaaccccaaacaaatcctgccataggcattcaggtaggtttaattgacttggatactagttcgagctgtgatgggagtggcgcacgctaacctcctcctaagtccaacatttcatgcaccttaaagtctctaagcaaaatgtaaagcagttgtttattttccatgtgcttccccttctgtgctgtttcttgcctgaagtaaaggtagggttttctctatcaggagatagcgaggttctcatttctcctcctgctccacaaggcggttgaaagtgggaatccatcctcgctcactttcctgttgaactgcttaccctgggtggctccttccagtgatcaaagtacagtgtcacccattattcttttattttttcaactggaacgtgacctctctgagggcaatggcttagagttgtccactgctgtgtttccaggacatagaacagtacttggcatctagtagcggctgatagatacttgttgaataaatgaaggaattcaggaactattgagtgcctactgtatgcctgggactgttccaggttcttgagagaccaccatgaaccagagacaagggttcccactctcatggaacttgtatgcaagtggggaagacagacagtagccatgtaaacaaacaaatgtggtcactttagatagtggtgtggattgtggaggacgccatcaggatggtgtaatatagagagatggagatgattaaagggaagccctctctgagaaagcagtactggagctgactctggaataatgagaagagccagccacagaaagacctcgtggaagagcgctgcaggtagaggaaacggcccatgcaaaggccctggggcagaaagagggatggagctacagaactagtaaatgtggtcagagctgagactggagaattggatgggccatgttagccagagccttgtgagcccagcctgggtaaggcattagatttgattgcacctgtgatgggaagctcttgcagcattttaagcaagggaatcacctgatcatttatgtttttaaaagtgggctctggctggtggatggagaatagacttagccaagagagtgggtacagcaggccagtcaatgagcttggtctgttccatggaggtcaatcaaggatagtttgtgcccctgaggttttccaggccacttcccctcaaatcagctgctgcagcttagcccctgcagttttccctacaggctcagactgccttacgtggctttggtaaaagctacagtcatctgccctttggaaactctatttggtacttgcggtgagggactcactgatatggttaaatctgtttcttttttggtcctggctattctgaaagtcacatttggaaaatcagaaccatttgaaagtgtatctaatttgatggctacaccctcttcctgttttgtaaattagactcttataataatggcatctacagtttatttgcagccgaggctgccagtcctctgacatgaagaagactgccttggaggcatcttcttccaaaaataataaaataaccatcatctctgaatggtcttgcacttggtgctcatttgtgtgagtggcacatggcacttagcaacagcgtcttcatgtctgcggaggtggacacaatgatcattttcaggaaatatttggcttaaattagcaaagtacggcctaaaaaataaatacatatgactactagtggtgaatattatgtagcttaaagctacattggctgtttccaccaatattttttctctagtcattgcctgtgcagaggaaataaaagatgccacttaaaagggtgtgggcctttgtcagaaactgtagctggagtactcagctcaatgtttgaatttcttatttttggtgttggcaccctcgtatgagggctgtttacatgtggttgtaaccctcagtgtaggtagtgcctgtttatttttgtggtgactttttagggtgtggccaaaggaacttttaaatttcagaaatgccatttattgtccatttccactataacattctcttaaagcctctcattagcaacaccctgaggatcaccatccctctctgtttactccatttttatatgaatgttttttatatcaagcaacttttaattaaatgtttattttgagatcattgtagattcacattcagttctaagaaaaaatagaaagggatcccttgcatccgttacccagttttccactaatagtaatgtcctgtctaacgagaaaacgttgtcacaatctgaaaattggcattgatttaacccactaatattctcatttcaccaattttacatgtactcatttgtgttcgaacaattattgcgtcaaactgtattttaggtcaggcacagttggctcatgcctgtaatcccagcacttttggaggcaggcagatcacctgaggtcaagagtctaagaccagcctagccaacatggtgaaaccccatctctactaaaaatacaaaaattagccaggcatggtggtggatgcctgtagtcccagctactcaggaggctgaggcaggagaatcgcttgaacccaggaggtggaggttgcagtgagccgagatagtgccactgcactccagtctgggtgacagagtgagactccatctcaaaaaaaaaaaaaaactgtatttaaatgttctaaagcagctgattaaaggattatactttgattccctcagtaaataatttaaaatatatccttaattgatatgttttatgaaataagtctgcttttttatatattggatttgtctaaaggcgtagctataaggacgcgtgaaagagcttcactgatacatttgcagaataaggtggtgggcatcacctttttttcagctaatagtggtttaatgcagttatttacaaaaactcaagtttatgtccatttggcttgcagacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggtaagagcctatctctgagccaatataaatgtgttagaacactgttctcgtaaacacaaaacaagtggtcccctactcatgggcggcttcccctagctaattagaaacaattatcacactgcaaaaaaatctttggagccatatttcttttctggcactcatttcctaaatcatttgggcaaattctattaaatcttggaaagccagtgccctcccctttaattcaataatcttgctactctaatgaacgctgtaagcactaattaagataggggcatgattgaaggttatgagatggaggctcacaaaagagctatattattatataataggacacagagaaagctttgcttttgagcctctggtataaaacattttttggaaattctttttacatccttttgggaaaacaaaactcacaacattttaggattagaaggatactgtcaactttgtgaagagtagattggagaaacatagaacaaacatcacgcttcaagggctagcacggaaacatacacattttagtctggaatgaagggggaaaaccaacgttaacagtttactaaacagccttgcactggggttttaactaactcaagaagatgagaggaacaagagatacaattattgagaagaaaaaaacaacttctttaggaagatctgtgatcatgctgcctctttgagtatgcacttgggcagcatttatttaatccaatctgcattcccattgacacttcagagagaacttagactgtgctcacctttacatctttgattttatcttttcaggcttacgccgagtgtaccatttacaactcggactcttgacaaggcaacagttctgggtgaatatgctttacccaaaggagtaagtagaatttgtatattctataccttacaaaaccttggaagatacactttgcaaatattcaccagatctccctagactttgtactggaaaatattcattttgggaatgcagagatggtagagaatagttgacatgttgcatagtatagaattagaattcacggctatggagacagagacctgcattcagtttcatcttttatctgtgttgtcttgagtgagttacataatctctgtgagcctcaacttcgtctgtaaaaggggtttaataacagaatctgctgcgcagggtggttgtgagtatggtgcacaattctaaagccctttacctatttattacctggcacattttaagcactcagcgcatgttggcaaccatcattattataaatttgtggatttggcttttgatttgtaaggtgacaacttgtgtcaattttgccattcaaaggtctcttctggttattttaaatactatgtgtctctgcatgtgtttagacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttgggtaaaacctttaccggtttctgcaattatgttctgtgctgtttcacaaggcagaagaagagaggggtaattctgtttttgtgtgcgtgtgcattacagattgtccgcaaatacgacatccaggccacagacaatgagcctgttgagatgctacactcaggcaccctggtgcccagccgggaactccccatcgcgttttgccagcgataatacgcctcaggtgagcatctaggcggttcattatcctctgcaaggtagtgagaatgacgagggatgagctatgctgggaagtcagccagactggggtttgaatcccagctcacctctaacttgctgggtgaccttgagcagttccctaaactctctacttcctttttttttttcatttgtaaaatgatgacccaaagagagtgtatcacaaaaatttaatatgaataccaagtagttattcctgagcctggcatcaattaagtgttcagtaaatgctagcagctgttcatggtttttgcatgtgaatagtaagggttggcaaactttttccgtaaagggccagttggcaaatattttaggttttatggaccatacagtctttgtcacatcctcttaatactaccttggaacatgaaagcagccacaggcaatttgtaaactaatgagtgagctgatgtcctagctttctattgctgccaccgcaaattactaaaacttagtgagttacacgacacacatctattatcttacagttctataggtcagaagtctgatgaggctcttccaggctaaaattatcgtgttgtcggggctctttctggaggttctagaggaggatctattctcttgctagtttggttgttggcagaatttagttcttcatggttacaggactgaagtctttatttttttgctgctgtcagctgaaggcgatcctcaactttgagagatttcccatattccttggctcatgaaaccttccccaactgaaagccagtaacaatggttggttgagtccctctcacactttgaatctctctttcttcttacattgcttctgtctgacaagatattatccaggatcatgtctcccatctccaagttcataaatttaatttcatctggaaagccctttttttcatataaggtagtatattcacgtgttccagggattagggcattcacattttaggagatctgttattctgcctacaaaggctgtgttctgataaattttataaaaaacaagcggtggactgtatttagccctagggtctaggtttgtgttatgcaaccacatgtaatataaatgtatatatttatcagcctgtattgaacacaatagaatattttttctgcagtatgccattcaatactttttctgacaatagaggagttctcatgttccctccacaacttttgccatgtccatataccaaccaggtgctatttatttcaatactactgagttatttcctttaaataacataagccaaatagcatatgttggcctcgtcctgagtaataatttccttaatgaaattaagagttagtaagtctagttatgttctcctaatagacattacaatgaattcaaaactattgaagtgatcaaaagttagcctaagaaggccctaattttttttttttttttttttttgagacagtgtctcacactgtcacctgggctggagtgcaatggtgcaatctcagctcactgcaacctccgcctcctgggttcatgcgattcttctgcctcagcctcccgagtagctgggattacaggcaggtgcacaccaccacacccagctaattttttgtatttttagtagagatggggtttcattatgttggccagactggtcttgaactcctgacctcgtgatccacccgcctcggcctcccaaagtgctgggattgcaagtgtgagccaccacccctggtggtggaaataagacatttgtaacatatggctttataggctgacatgtcggtgtttaaacccggattctatcattgtgttcttttagcagcaccttctaggattttcctagaaaaaaatgctgtttgccaatggcaagttaaggagcatttgcttattggtagattatttagagaaacatgcaattacagatgaaatttctgaacaaggcccaaatgaatacattattattcctccaccaagtgtctgatgctattatgaaatttgtcaaattctgagcatcccaaccaacagaactgaatcaagtagggtaaggaaagtattctagctgcattgtgacaccccagccttcagcaaagagcatgcatgtttatcacagtaagccacaccttttaagttttagcattttttctttggctaataatttgtcttgtttaaatacacttctttgatatacaattagggtatacctttttttttttttttttttttttttttttttttttttttttttaccaagaccaaaacagccatttcaacttttctgcaagaatggtgcttatggcttctacgttaccggaaagcaaacttcaaacaccacaccatacaacagcttataaagaatatttaggcccaggtgttgatactttttcttctgcaaaattgttccagaagctgtactgtctttctagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatttgagagacttcccctctttattgcctttgttacaacaaaataaaaacaaattcaaactttattttactggtagaaaattttctcatatggcctacaagccctatatcacaaaatttacccttagataaatctagactttaatagcagttttactgaaagtttattcttgtaattgcaaaataactttccattttgttgctgcttaaatatttcccaagtccagttacttctatctctaccccctttccaatcacacaatcagtcacacactggttgtgtgattgaaaggggggtagaacggcctgggagcctgttctctcttgtatctttcatgacatgaaagggaggctggcacttggcagtcaggtagaggttacgaaccatttcagcccctgcctaccacattcactgtttgaatacttaattcccaagaataagtttacatttcacaatgaaagacctacaacagccaaattttccgtggctgggagcaatactgacaatctcttgcctggaccactaatatctctagtctctgcaggagctcccagctgatctcagtcctctcttgcttccttcccctctgttctttgcacacttgccttactggtcttttcaaacccaaacctgatcatgcctcatcctgcctctggggcttcccattgctcttacgtaaagatccgattctgcaatccacacttccaggccctatcaactgaggtcccactgatcccccaggcctcagcccacatcatccacccccagaggcctctggaaccaggccacagtggcttctgccagtttctgctgttccttaaatgctagcaagagggttcttcccaccgtctccctcccggcatgctctttctctgcctgttcttctcctacgcaccatctacgtccacccagctttcatttcctgaaggaaatcttccttgatgacttagatcccacaggggctgtccccagcaccgggattcattagggttgtgattcccaaggagacctgtgcgactgtggggacagcaggatgaggaagggaaagaagccaaacaagcgtgtggttttgagtgaagttccagcctcagcctgatctctgggagctctggagtgtacattgcagctcagtttgttctccttgtgcccagggagcagggcttccacactccttcagttcaggctgcaccttggggtataaactctaagatacttctagactttacatgtccaggcaaaatggctatagtagccagaaggtagtctttgaagaaggctgcaggtgccagccatgaggagcaaagcatgaaaaacctgggcgaagggcacaaagaccggcaaatgggtgtgaggagcacagggtggagcaagggccacgtctgctgcccctcacctccctgagcaggttgcctggagccgacactgacatggccaatgtggtcatgatgataataatatttattgactgatcttgctgccccagtctctcctctgtgcacttgctacatatgaattcacaaatccttgtcactgccctgtaagtagatgtgatcattcttcccatttcacacctggggaaactgaggcacagaggtgctcagtaatctccttagaatcacagttagtatgtagggaagccaggattccaacaaagatagattggttcccggacctgtgggatgcacgtcatgtactgctcatctctactaaaaatacaaaaaattagctgggcgtggtggcacgcgcctgtagtcccagctacttgggaggagaaaggcagattctcctgaggcaggagaattgcttgaacccaggaggcggaggttgcagtgagccgagatcatgccactgcactccagcctggcgacagagcaggactctgtctcaaaaaataaattaattaaataaaagtatacaaaattgatgggattagaaaaatcactatttggcaactagatttgaaccaaaccaaatgtatcaaatttaatctgtggatttgtagtt

SEQ ID NO: 16006 - DNA, 78125 bp, Human
gtttaaactggagcctgcaggaaggcaacctgaccaacctgctcatgggtgctttaaggatcataggtacgagaatcagctggagttgttggtgaaaatgcagattccgggtctcatccctagaccaaagatatctgaatcatttggcgatgggtccaggaacctgcattattcaacacacttcccaggtgaccgtaaatgtcaaaagacaaaattacaacaaacttaaacatcttaattggcttcattcatgattctagaatcgggcaagacttcattcctcaaaatagcacaagtgtcccaatgagctgagcagaggaggttggttttatagacagaaaagggctgaaaaaagcagaaacaaagaacaaaaagcagattggtcatttcaaagttactttccttgtaaggcaggaacagggaaacagaacaagagagaaataactgattggtcgcatcgggttacttcaggttactttttgttgtaaggattaaagcaaagggaacttcattatgttgattaaaacggtctgcttgggaaatcagggtgtgtatctctcttctgattttgtgaaaggttatcagtctgatgatgtagaactttagcatgagtgactccattttgatttttagtctagtctgttgagaccctaatgccagaactttttttgtttgtttgtttcgctcttgttgcccaggctggagtgcagtggagctatcttggctcactgcaacctctgcctccagggttcaagcgattctcctgcctcagcctcccaagtagctgggattacaggcatgcgccaccacgcccggctaattttttttttttttttttttttagcagaaaccgagtttcaccatgttggtcaggctggtctcggactcttgacctcaggtgatcaacctgcgtcggtctcccaaagtgctgggattacaggtgtgagccaccacacccagcccttttttttcaagacagggtctctctctgccacccaaggtggagtgcagtggcgccaaaacagctcactgcagcttccacctcctgggctcaggtgatcttcctgcctcagcctccccagcagctgggccccaccacaccggctaattttttaacttttagtagtgacgaggtctgattctgttacccaggctggtctggaactcctggcctcaagacatccgcctgcctctgcctcccaaagtgctgggattacagatgtaagccaccgcgcctgggctcctatgatttttatttaacataatgcaccatggaatttgtgctctgcttagttcagtctgagcaggagttccttgatacttcgggaaacactgaaaatcattccatccccatccattcattcctgcagcacccaagtggaaattctgcgtttcagacagggacactacccttagagagcagtgggcttccccagcagcgtagtgaaacatgatactcctgagtttcatgaaaaaagggcagacatctggccagagctgggaggcaggaaatagagcacggtgccctcctcccatactccagcttggattactgaggctggggcccaggccctgcaggaaaggaggtgcatgactactttaaggccactcactctgtgactcaacgggccgggtcggggctggaactcaatgccctcccgggcctggagagcccacgcgccgtgggcggggctcccggggtcgcctaggcaacaggcgcgcgccgcgcccgagcccagagccccggagcggaggagggaacgcgcgctattagatatctcgcggtgctggggccacttcccctagcaccgcccccggctcctccccgcggaagtgcttgtcgaaattctcgatcgctgattggtccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggtgcgggagcgccccggagcgtggcgggcccttcgcttaggccgcttgaacatcccctcagacctccaggccccagactccctctgggtcttgccctctgcctcgctcctactgcttgaggattcgatgggacagcgacgcactgcgtcccccccccctttgtccccggggcgggcgtgtttctcgccgcagcgtcggagcccccttcgatcccccacctcccttctgttctccagctcgggtgatctctcaagccgggggaccgccggtctgtgctctcaacgcgaatccctcgcaccccgaccccgccccctgcctgtccactctttgtcccctggggtgatttagcacccccactatttccttttctggagtggaccacctcagactctcttcctttgtctccctgggggaaaaggttactccccccgtccctccttcacatttcctttcccctagtctcagtgtgcgtcgagtcccagagatgacagtcccctttcccctttctgttcattcatttattggataggagttggcaagcttattctgtgctaggcaccgcttaggcattggaggtggtgtttgctaatcaggacaggcaagatcctagccttagtggggcctagagtcgaatagggcaatcaaacacaaaagcaaataatttcagatagtgacaggtgctgtgaagagaacgacttcctaacggggtacagggtgactgcatagaaggccggctgtcttagagaaggggatcagggaaggcctgtcaaaggaggagacatttgctttgtgagctgaaccaagaggagcagaaagccgtgagaatatggggctaaagaaccttctagccaggaggcctgcggtacccactccattggggccatgatattatcctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataaaatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaattgtattcagcatgcaactagcatggagtgtgtcagtcttcaattcatttccttcattgttcttaagtttttctgccacaattaaaccccacaagttagtcaaggtgttgagattttcactgcttcttaatggattgccacattccctgaggtagtttcttttggtcttagagaattgtcagggccagcttttctcacctccactgtatggatatttttcttttctaagatcttgaaatcagaagcttttctcctaagtgtaaaagtagctctttgtcatacaactgtagcgttttctgaaacagagttcagatgaccttgagtctaaagtggctaactttccaaggtgtgtatcgctttaccaaaaccattatttttcaaggattcaaagaatgtgtttacaattgatagaaaatggaagtttaaaaaaattaatactttatagcatgttgaaatgagggcagccttatacaaagtcatactttgagcttgcctagcctattgtgatcagagaataatgtaatttttgcttacaacttggtaagcaggtcagttattctaacttattttctgattagaacaaaaagatgtaaaaacttgaaaactattgggaaaagaacaaagagtgaagaggacttttgagtgctgaggaatgtggcagcttggaaaacaaactttttaggcagagattctttgctaggtcagtttgataaagtgagcataaccgtatttttaatctttaatgctaatgaatagcatagatgctaataagcatctaggtctataaaaagtcagctttgatagtgtatatagatggctttaaacattgttttctagcatttaaacactttcaaatcatccggttgcttgattgggcctagctgtctaagaggagagaatgagcccagatgaggaaaagagattgattttactgagctagaatgagaggagagagggttgagtgaatgaaaagaatagctcatgtgctcccctccatctgtagtttaagaggggttgggtccggtgttttgcttgttttctcgtctgtaaattctttgattctctgacaccactcactatatttcattgtgaatgatttgattgtttcagataaaggggactgcaataatagcttgtgacatgaaggcaagatttattcatgttagaggcaggctttgtaaaatgggccactcttccaattgacatttgtttttatagctgttttcattatgaaatacaatctaatgcctgactaggttaaaaccatgttgtaacaatagttcactaaaattccttactgatatacagcttatgttgttatattccaaaaagatgaatattaaaatttgccaataatgtttatttaaatactattttcttcagaggaaaaaaaactattttatgcaaaggagaaagatctatacactatgactcacttcacttaaaaaaaaaaagactaacggaaatgacatggagagactgggaagttctagtcatcttgagtgacccattagatctaaatgttcttgtttagccctggtttgagtgaactaaatttaggtgtctgatcagtactttggaaatggtgtaaatgcctttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtacgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagcaggtactttttctgaggcctgcctgagcctatatatattttgcacaatttggcattcctccctacagtgtttatgctgatttgtttctggtaacaactaatactggcaaatcggctgggcatgttactttatgctgcccatattcaggaaaattggaattctagctgggtcattgttcccagatgatgtagtttggcaccagccattccatgttcacattttgagtatccaggagggctggggactttggagtagttggtgattccctctgccacatttcactggttggtcactatggcatcctttccaccacactagtagtctaggttctcagatgttgcttatgagcctgcaatggtttctagtttcacactgcagaaatgagtgaagccggttacccgttaatatggtcccatcatcactagagtaattcattgttctaaaaccagatctgagtctctcactcctctgcaactacttctgattctttcataacacttgtaaagtccaaactcctctttagcatggcagccagcttccagtccttccctcctatgtggcttccattctagccagacaagaaagggcagcgttctccaaactcatcctcgcccttcattcctctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtatgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggcccccaccacattttgagtcatggcctaatgaggtaatttagtattgcctgctgcagtggctttggaagaaaggctggcattcttagccagtagaagctgataccactgttttgtttcacagaagctttaaatataacaataaatttgtgcttggcctacggtgaactttacaggcaacttggaggtaatatgtttgtctctctaagaattgttgaattcctcttccctcatccctcctgactggttctcacaagcctagcgggcctttgcatgtggttggttcataaaatactttttgattttgggatataaaatatagttctccataaaataacgactgttaccaagtctttgatttttttttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcggttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgttgtgttgcccaggctggtcttgaactcctgggcttaagccatctgtctgcctcaggctcccaaagtgttgggattacaggtgtgagccactgtgcccggcccagtcctttttttaagagaaaaacgtatgacatcgttcgatttactgagtgcttatggttttactaaggcagtaaggttttatggataccctatggtaattagatagaattagtgctctgaagtcagctctgtaatatggactcagagtaaacatggcaaagggacacttaaggtctgcattttctctgggaaataaacgtattctttactactctgaatctagtgctgggaaattctaaatccttcttgaggattaaccacttgaagtaaagttttgggtcccaagtaggcttgtgtccctgtctccttctctttacttttcagatgtttcttcctagagactgaggtatattttacttttacagatgaagaaggaagcctcggctgtgtttgtggcttttgtgggtgagcaacatcacttgcaaagataagatgagcttagcaaaactaggctttcaaaataatttttaaaaatttcttagtgattagaaaaggaaaactcttcccttgtctctgttaagaaacgtttttcgacttttttcctttcttaatggatcttttattggcacttctcttccttttgcagaatcttacttaaaagtcactacgttacattacagcaaacagcttagctaatttttatccagatgggccccggttacaggattgtacactattgcgaatttcttacaggaaagtgaacatcaagtaattattccaaatagagttctcttaagaacgtgagttacttaaaaatgtctaaggatgaagtcacttctgaatataacttcactcaagagaacaaataagcaaactgcatttagcataacatggtaaattagctttaactctccttgatgtttgaacatttgtcgctgttaactactgtttcacttttcaaatagtcagggcttagtttgcttctgtaaggataaagggaaaatacgccttcactgagtcataaatatttttgtggctaacttttgcacagagaaaagaggcctctaagaaggtacccagtgaatttttttttcggggcagggagagaatatgtcattttttggtttgttgttgttgttgtcattgttttgctttgttgtttttactctgaactgaactgtatcttgacagcacttttgaattaagagcattactcttattgttctctactacctggacgccacctccctgttgccatagtggtaaggatcatgctccgaggtggggtgaggcagaatggggccaagatcagaaagttacattaagctacatcaggtttatacaagcataaaaccaaatttttggagcagtccccagaatacaacctggtttagccacacctaaaggttgctcttgaatattccttgagaatccacatccctagaatgctgggtttcaatgggccctttatgtacctatcatggtgtcatttctgagcatttctaaatattccttcatgtcttactgacagtttttcttgaataaatcttaggaatattagtgccattatcagtattttgtttggtctgttcacaccacaaataactacccaggtctgctacttgcccctatttctctacctgctaatgaaaatgcttttgaaagtttgagtaacagtattggagtgtgcacagtggtattggtaggttctgtactcatccttaaccacttgttttcatcctttgtgagcttgaagtttctccaaaaaatttatcacaaaacttatcagacatagttaatacactcagagagagaatcactgaaaaagtagatgtagtttaacaaacccagtgccttttttttacccatgaatacatatttgtcaactaaacctcattttgcaacttgttccactactcgaatggtaacaaacttttggtttcccaataggtttggaagatgttgcttttgaaagtaggaaatagatggctttagaagatggaagaatattttgtttgaagtgggagcgtggtatgtccttagctgtctgtgaaatgcagctgaagatgggtgtgggccttcatctgcatttcccatcttcagtttgaggaggtagttacccttctaaccacttaagaactgcatggtacatgctgttttatttacagggcaaaactgtgctcccgtagtttccctggtgcttgccttcacgttaacacagtgtcatcgtttggcagtgtttatgtgccagggtccatgttagaaggaggaaaggtatagcgaagttaaagggtgcagttggcctcccacctttagttttgtaagtgcctttaaagtttgatttttgtaggttgatcataaggaagtgataagtatgttaggttatttgtggtttgagctaattttagtctctttttacagcttgctttgtatcctttgccattaaaacatgctttctagaaagacaacttttgaatgtaggacacagtctatattctatacttggctacatttcaaaaaatattttctcagtactttggaagttggacagttggaagcatagtgacagtatttaaaaatctttgattccggccgggcatggtggctcacgcctgtaatcccagcactttgggaggccgaggtgggtggatcacttgaggtccggagttcaggaccagcctgaccaacatggtgaaaccctgtctctactaaaaatacaaaattagccgagcgtggtggtacatgcctgtaatcccagctactcaggaggctgaggcaggagaatcgcttgaatctgggaggcggaggttgcattgagccgagatcataccattgcactacagcctgggggacaagagtgaaactctgtctcaaaaaaaaaaaaaaaaaattaagtgatttctttgctttgtgacacttctacttttccagcaagtaaattatattctttcatacaggtatgaaattcttgttccaagctagtggttaaaaaggcacagttgatattagaggatttgtaaaagattatgaccacgcctgcaatgtactgaagcaaggctttgctgggctgtgtataggaaaccttccccagcctgtgcccttgcttgatagaacattttgctcctaagggtaggtgcctgtatctgtctccagtactggttagtttcacacagaacagttgtgtttcagagctttagtctcaagctgccctgctcccctgaagcagccaccctgagcatgtgcactcacaggaggggacatgtgaggtcatggaagaagacgactcaggaagaagaagacttgggtttgggttctgactctgcctttgactgttgtgggattttgaggagttgcatacaggatctgtaaaatgtagtcattagactagactagacagccatatagcattacctagatgtaactttctacaaagacatggtcacaggagaagaccagagggtggggtgatctttctggaaaaattggggcttcatgccttactcatgctagatatggtagcattatatggctgtgcctgatccccctaatctaaaagtgggacagaactttaaaatttcatattaactcaaattaaaacttgaaaaaaacccattatttccttaaaaataataaaatgccctgtgggggcataagtcacattatattttaaaattcctgaatgccacatggatgaatgtagttccttttgaaattcttcttttgtctaaagaggaatgttggattttgtaattggactaaaaaatcttccatttgagagagaaacagtctgctgcatgttctacccttgttcaggataaaacccactaatagctaacatttattgaattctgtgttgtgcctcaggcactgtgcaaagtcctttacatgcaatgctgtttattatatactgtcaattggtctataacagcaggaaatgtttcaggaggacaatgaggtcccagaccctcagtcttctcctgtgtcctggattcagcttcacaatagcactatggcagtgtggccactgcttcagcttccacatacatggctgtgaagagagacaggggattgtgctaagcctccccgatttattaggacataggaggagagagtttgtagtttttgacctttgcctagttttctaacctctttcctagatgtcacaaattggccacccacagtcatattttgcttgcttcacgcaatgctttttaaaaaagagaagagtttaatttgtgccattgtttataaatgaatcaggagaaatgacatgcaactctggattctggcctctcttgaaaaatctgaaaatcacaccgtctgagcttacactggcagtggtctgctggactgagggacacaactccttttggatgtacatgtgtgcgttgcagagtttaccacagtcccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaattttttttttttttttgtatttttagtagagatggggtttcatcatgttggccaggctggtcttgaactcctgacctcaggtgatccatccacctcggcctcccaaagtgttgggattacaggcatcagccactgcctccggccaggtatttgtatttttagtctctatgccttaccgtctcagatcaggaggatttggtgatttatcgaatgtgggggaaggggaagaagaggaaacgggaggaatgttccagattagggaaatagctagatggaagatgcagcccctcatcaaggtggggacacaggaaaaggaacgtgtgcaaagaagatggtgatctggttgtgaccatgttgttagaggacgtccagggaagcatctggtaggtggtggggtgtttaaatatagaacattcggagaatgctccgaagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaaggtctcatttagttgttgtgaattttaagggatattttcaatgatgttggctggtttatcccattatgtggtctttttttttttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctggtctcgaactcctgacctcatgatccactcacttcagcctcccaaagtgctgggattacaggcgtgagccaccatgcccagcctatgtgctcttattagcaattctcagtacacagatagctttgagtgattctttcaagtcaagtaccttattaaaaaactcaagtgtactgataattatcttacttttaaatggctaagtgataagactgaatttttaggtactgtaacacttcagattacagattctgatatttttatggttatttatatttatttatttttgagatggagttttgctcttgctgcctaggctggagtgcaatggcacgatctcggctcactgcaacctccgcctcccaggttcaagcgattctcctgcctcagcctcctgagtagctgggattacagtcacccgccactacagccggctaatttttgttatttttaatagagacaatgtttcaccatgttggccagggtggtctcgcacttctgacctctggcgatccgcccgcctcggcctcccaaagtgctgggattacaggcgtgagccaccgcacctggcctggttacttaaatttaaatacaaaaattatgttgattaattctgaatgatttcctgattgctccccgtttaccattcacacatttattaaattcttcgcttgccatatagaagcagtctctctgccatatatgccatatagataacagaactagctgtctgcaaaccactgaaattgtgaaaacatctccccttttttcctgtttctaattctagctatgaggattatatacagaagtagtcctggatttgattttttttttttttgatgattgttttttgatagttgttgactacaaatcatttaaacgtctgaaaggggaaaggttttccttaaaaatggatgacaaaggagaataaaaaggtattttgactatttttttgaatgatgagttttttttttctctttcttgttttcttttggagtcatttatgtgtcactgagtggataccatggaacatgtggcagaagtagatatatggggtaaaagaaccatagttcataagctccttgacagaatcactgaagtgtagccgttatatggccactgtcgcagggggaggcagcagttttgaagaaggggatgagtaataatgagtgataaaaaggcatcctggatagaagaccaaactctgcagaagaccccagtttgattatgcttttgttttctgatttgcggaggagagtgaaaatgcctgaggggtgcgggggagcacatagggtgtatgtgtgtgtgtgtgcgcgtgcagattctctctttcactgtatgtatttgtatgcatgtatgtatcttaggacttaagctttctagtcaataaattgccatagtggggaattgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcattggggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttccagactgagtcttgctctgtcacccaggctggagtgcagtgccgcagtcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagccctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattcttgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcctaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgtgtctgaaaccaaatcattgtttttgtttttaacttttttcttaatatattatccttagttcagccctgaagtttattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattattattatcattatcattatttttgagacagagtcttgctctgtcgcccaggctggagtgcagtggctcaatctcggctcagtgcaacctccgcctcccaggttcaagcgattctcgtgcctcagcctctggagtagctgggattacaggcgggtgccactacacctggctaatatttgtatttttagtagagacaggtttcaccatgttggctaggctggtcttgaactcctgacctcaggtgatccacctgccttggcctcccaaagtgctgggattacaggccttagccactgtgcctggctgattttttttttttttttttttttaggtttgttttaactggaactttacgtgaatgtaattgaatttagaataaaagcacttaatttcacagtgtgcagtgaactttctgttacttattttaacagtaaaaccccttgcagtaaatgacttggagcaaagattgcttttttaaaaaatgttttaatttgtttttcttttcttgagatggagtcttgctctgtcaccaggctggagtatggtggcgcgatcttggctcactgcagcctccccgcctcctaggttcaagcgaatctcctgcctcagcctcctgagtagctgggactacaggcacatgccaccatgcccagctaatttttgtatttttagtagagacagggtttcaccatgttggtcaggatggtcttgatctcttgaccccgtgatccaccctcctcggcctcccaaagtgctgggattacaactgctgggattacaagtgctgggattacaagcgtgagccaccacgcctggccaattttttttttttttttctttttgagacagagtttcactctgtcacccaggctggagtgcagtgtcacagtcaaaactcactggcagccttaacctcctgggctcgaatgatcctcctgcctcagcctcccaagtaactgagactacaggcatgtaccactgtgcccagctaattgtttttttattttttattttttgtagggacagggtctcgctattttgcccaggctagtctacaactcttgggctcaagcagtcctcctgcctcgacctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacggggtttcaccatgttggccaggctggtctcaaactcctgacctcaggtgatctgtctgcctcagcctcccaaagtgctgggattacaggcgtgagccactgtgcctggcagggagtcttatagaagctgtcgtggacaatgtgggaagtagtgagcctttgtattccagtatgctgggctccactgtgcttgctctggcccccggtcgctctctgtgtgttattgagtccccatccacggccatactcttcgtcctgcttctctccttaccatcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctggtatggaatctgtctgtagttgtactttctacctctgtatttaaggggagatctgtaacctaccaatgccagttgaagaggatggatgatagagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccccatagaactatgttaatgatttgtatgtatggtatttaatattatacataataatgattgtatgaataaaaaacattctgggctccatgtggatgatggggtgtgtgtgtgtgtctgtctatgtgtgggtgggtgtgtgttcatagatcccttttcctgcaatcctggcactggaattggttttatcatttccaattaagtttcattcccatgaattttggagtacagactgggtccaggtatgcagggcatagattagagccctgagaaataggattaggctggaattgctgggttggagatcagtagcttccaggaacactttttgggcctggctgtcttcattatccccttttgttttctcctggggtctgcaggtattgccctgttttgttcctctaatatcactttttttttttttctgcttttgaccagggtttttgcctctggtctacaactgaatatcctatcagactctcctgattttgaaataaatatatagtttttttgaggtgttctagcgaatttctaaatctaaatgttgtggcagagttattacatactaattttgctatgagaggttgtagaatcccagatgactaatcttgtaaaccatacacgcatttccatctaattctccattgtatatcatgttgcagaaaataacagcctctagagtttacattgcctcctttgactatatttcttatttaagattagttttcagataagaccttttcatggcagtacataactgtacagagggcttccaacttgtcttgggagctctcatctctgggagacatcacattacccactgccccctgccccccgcccccagcctggatgcactcagcctgtaccccatttctgtcctcagccaaacactgctgaaatgcaagagctttcaattgctagccagtgaagatgcagactaagggatttccatgtagaagcccgctcttttcagctggctcgtcgagagctggaggccccttgcttgttcacatgaggctttttgtccctgacttggtggctgctgtttcacttctcagcagaaagggacacccttgcccccccccagaaaggaagatttgatgtaccacttccgaaaggttcagtcgggcatcactgtaaccaagaagataggtcaggtgaggctggaggtggaacagggctgctcgctagaactccagattgttccacaagtgccttctggcagagaatgatggaagcttccgtgatttttttttctccttaatagttatgagcacagaagaggagcagattgtctggctatagaagctgtcttattttttatttttgtttttgagatggagtctttctctcttgcccaggctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggaactcctgccttcaggcggtcctcctgcattggcctcccaaagtgctggaattacaggcccaattttattcttgggatgtatgtctgaaactctttccttcacttccttcccaagccttagttcaggcccttctcatctgtggtcttcaaagtcgccttcagctggttcaggtccttcctttctgctgtatctttcatgggaggacatgttatgtatcactgtcctacttgaaaacttccattccccattgatgagggtgttacctccagattcctaacacaggtgctgaaggcatgcctggataaaggcactcccttgatctcctggccaggtccccgtacacctgcagcgcatgctccacattctgtctttactgatgctgtgtcttctgcctgcggagccacccaccattctattcacagcccctgcctcagcggagcacgtgcctccctcttcctacactgagctgtcctttctattgaatcccctcttttttgtagtatgggaaatattttattatgaatactcttttctctgttgcctccgtgaccacgttaactttgccctaattcgccttaggactccatctgcttaggggaaagttaggatttggttacagaaagcaagctgctagaaagaacagtgtttagcttctgacaggcaaaataggattttgcaacatgcttttcctttttaatgcttagacattttatatgaattaatatttttatttggttgcttatacattactttctttttagctagaatgtgaaccctataggaacatggggattgcctttcacatctttgtatcctcagtacctaatgttcagtcaccctgtggtcttgtgtcgtatatacatttagccttccttaattaaaccatatgtactggtccccgtcccccacccccaaatagagagaaagaaattccttgaatactacattgccagtatcaaaccacaccttgatatcctctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctataaggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtgattagaagtggcttagcaattctaaagaacacagggaaggcgtgtggccagaacattggtccctagagcacatcgcctcctgacataccatttccttaagttaatgttttaccactatacataggccctcccctttgtttacccagatttttttaattttaaggatgtttttaataacttagaatcctgtaatttgttgaacagtcctgtattccctttacttatattccttgagattttataaaatattttttacatgtcccaagtcttgattatatctttttacctcttgttaagaaatacttacttttctatttttatgctatatttcatgtttactgtagaaaacaaaaaaagtaaaatttttctttattcctatcactgcagcttataagcactctaaacattttgatctatattttgccaatcatatattttagttaaaattgttgttgacataattgtagattcctgtgcagttgaaagaaataatacagagctgagcgcggtggctcacgcctgtaatcccagcactttgggaggccgaggcaggcagatcatgaggtcaggagtttgagaccagactggccaacatggcgaaaccctgtctctactaaaaatacaaaaattagctgggtgtggtggcgggcacctgtaatcccagctagttgggaggctgaggcaggagaatcgtttgaactccggaggcagaggttgcagtgagccgagatggtaccattccactccagcctgggcaacaagagcaagactgcatctcaaaaataataataataataataaataaactttaaaaataaaacagagagatcccatgtgcgctttgcctagttcccccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaaaaaaaaaaacagaaatgtgaaaaggaagttgtgttagagtatttggagttgagaaagcatgaaaaggacagaagagaagctggttgtcaggttgcatggggtagctacaagcacactgaccagaaagtcagctggaaaaaaaatgtagaaacaggagataaaacggccaaggggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttgaagttagctaatattcatttcttctcccttctttcaccctcctccagagtctgatttgaagtattcctagctgctacctataaaagcaataagcaagattgttttacttttcacaaactcgtcctgttctgtgcctctgcctcggacatagctgtagtatagagtgttgtctcccttacatccttctatcttagacctactagtaaatattaatgctcactctaagttcttctcaattcttttttttttttttttttttttttttgagaaagagtttcgctcttgttgcccaggctggagtgcaacggcacgatttcggctcaccgcaacctccaccttctgggtttaagcgactctcctgcctcagcctcctgagtagctgggattacagtcacgtgccaccacccctggcaaattttgtatttttagtagagacaaggtttcttccatgttggccaggctggtctcaaactcccgacctcaggtgatccacctgcctcagccttccaaagtgctgggattccaggcgtgagccaccgcgcccagcctcttctctcaattcttcctgaagctctttctgcactagattcctcaggaagggcttgtgggaacaatcttctgtgaatcaacagtacatattcataatagtttgtcagcagcctattattttaaggccatttggtctgtatataaaaatgtttggatcacattttctttctttaaggtaaatatgttattctgttgtcttctggtataaagcattgctgtaaatgtttgacagtctaattatcttttgcttataagtgacttagggttttttgtctatgtgcccaaaggattttttccctctttctctcttttttttttttttttttttttttaaacagacaggatctcaccctgttgcccaggctttagtgcagtgaggcagtcagagcttactgaagttttgaactcctgggcttgaggaacaaaggatttttttaaccttttaattcaaagtctaatcatttatgcaaccatgtcttggtgttggctgttttgggttgttctccctcaaaaatccatgtgctctttcaatatgtagttttaaatcttttttttttaatttcaggaaaatcttgaattagagttttccgtttttcgtctggtacattgcttgggtttccttcttcaggaactcagcctgttatgtgtatgtttgatcttctttgcctgtcgtctgtttctttcacttcctctcacttttttaaacttcatttattaaaaaaaaatttttttttcgagacagagtttcgctcttgttgcccaggctggagtgcaatggcgtgatctcggctcactgcaacctccgcctcccaggttcaagtgattctcctgcctcagtctcccaagtagctgggattacaggcatgcgccaccacgcccagctaattttttgtatttttagtagagacagggtttctccatgttggtcaggctggtcttgaactcctgacctcgtgatctgcccgcctcagcctcccaaagtgctgggattacaggcgtgagccactgtgcccagccttattaaaaattttaaaaacatacatttaaacttaacagaaaaattatgagagagaagggggtggtgccaggcttttttaaacaaccagctcttacatgaactcatagagtgataactcattaccatgaggacggcatcaagccgttcatgaaggatctggccccgtgacccagacacctcctactaggtccatttttaacattggggatcacatttcaacgtgagatttggagggggcaaaactacaaaccatgtcactcagggattggaggagcaagtaccacctatactttggactcaggtagaaaggcaaaatatccaggaaataagctgctaccgtccagggttcagcagaggtgcccatcagcctgccaagtactcaagagtccagcctctagggagctaatcatcatggtgagctcttcgaggcacagggagctgggaagacagtgcttgccacccctgcctgaatagtgtttgcacagagagttctgttgtgtcttgattgggtcctcctgccactgggaatgctgtggattatactaggtctctatctggcttgtttcagggctccatgtgaaaaccttcttgatatcctagccatccacctgctcagtccctagtttgcaaggaggctgtggggagcctagattctgtgtcagatagaatgtactacattccgtctcaggaatgtaccacatcagaaaacagtgcgacctgcaggagaagtagaggtgaagaggcacattcttccgagaaatgtttctctcaacacccagcattccctggatatcagcaggaaattactcactgctagaaaatgccccatgagccttctgttaaggaggtcaagggagagaacagagaaagttctcaaagttgacttggtcactggtactttcttatgcggttcttattttgtttgccatcgtcatcatcatgctatgtctattttctcaatccaaatccactgctttcaccttggttctttctgaccggtttggcacactcattcagtaaatccttatggagagcccaatgtctgcataattgtgctgtgctgatgaccaagctagacctacgagtgtcggctcctttgagatgtacgggacagctcttctgtcatctcttctgggaagcctctccaggcttggtgaacagtggcaagatgtttaacagttgtacatgtgtcccatgttcctttctaagagcctgggcaaaccagacccggtcgcaggtcatcgtagtatggcgtgagcttcctctctcctttctgaccttttgtgtgatggcaagaacctgcagagtgacacaagcagcaggcttctgaggttgctctagcctcagaatggccgtcccttctccaccctggccctcattgctgaggtttcctttgaagcaacagtgccggaacagactaggggaagcagcttggacatagctgtatgatttattaccacccattgaggccaaccaaagtcggcaaggagaggtagcaggtcagtggtgcctggaagcttcctctttcctttgcaccagatgtgactgctctgcaattactcctaaatttgctactctcgtttttactagccaaccttgatgtttttcccttcttcctgtagaatagacttcccctctgatcagtactttctactcaacactatttgtggccacagtgggaactcattgaggacagggaccatgacattactacctgacccatcaacacttggcataacttgaaatgcaaggacaaaaattggctgcaagtacaatgtggtcttcactctgaaggtgatccttaaaacttggctttggcatcatattgccttaatatacctaggggattgggtaaaaccagttactttaaaagagttttacaattctggccttctagctatcttgtcttcttaaacaagagcacaagatgaatgtatcttagtgaaattttatatggtttgctttgagtaatcttgcgaagattgatttttagcacagtaggaaagacacattctaatagtgatttttttccccgagtttatgtactgctgttgcatgaaaatctgactagatttaatgttcctaaagttctttgttcatcctgatttttgcaggtcctagggaaagctttgttttcctcttaacctaacttagatgttgtcatttcatgagctttggaggaagagtgtatagccaattgtgtaatgtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatcttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttttcaatattttcttgtattttactgcaagtttatacacaacataaatatgggggaagggggaaatgtttataccagagccatcctgcccattctttccttacagaaggacaaaggagcagtatttattttaactacaaaaatactattgtaggttttaaaaattccgtatattttgatatcttgtgttcctcttgacctttaatttgctaaatagttgcaaagaatgaaggtaacctgcatcatcttcttaaaaaccaactctatctaattataatagtttgtctatctctgaaaaatagtgatgtgttcattctgaaatcagaactaccggatgcagctgcattttgttactatttgaatttcgggagagggaggaggatgcagcctttcgagctgctgaaatacacaaacacaaagaagacaccaagcatagtagaactgtgttaagctgaccaagccagaagaagcacctattctcagcatagtatgagacgtaaaggcaatataatgggcatagttgaagatggtagaaggaaaatagactctgatggtttaatgttaaatgctttttttaaaaaagtggtattccaatatcgaagaagaagactttctacttttagaagcaataaaggaaattgcagaggaaagggtcaataggttggaatacataaaaattaaaaacttttaaactttttttttttgagacagagtctcactctgtcacccaggctggagtgcaatggtgcaatctcggctcgctacaacctccgcttcctgagttcaagcaattctcctgcctcagcctcccgagtagctgggattacaggcatgggccaccactcctggctaatatttgtatttttagtagagacagggtttcaccatgttgtccaggctgatctcaaactcctgacctcgtgatccgcctgcctcggcctcccaaagtgctgggattacaggcatgagccaccgcgcctggactaaattgtttcagtattaattttttttaaaacaagatcttactgttgcccaggctgaagtacagtggcccaatcatggctaactgcagccttgacttctgggcctcaagggatcctcccacctcagcgtcccgagtagctgggaccacagacatgtaccaccacacccagctacttgttttatttttatttttgtagagatgaggtttcaccatgttgcccaggctggtctcgaactcctgggcccaagcaatcctcctcccttggcctcccaaagtgctggtattacaggtgtaagccattgcgccctgcctgattttttaaatgtgcaaacagataagttggaaaagtgatttccaataaagataaagagttgatggttttaaaatacgtaaagagcttatatgaatgagaaaaacactaacattccaaaagattagaaggcaaaggacagaaagaaacaaatcactatgtctgggaagggacatgaaggagcaggttcccactgggccagcggggctcaaacccactggggacgtccgagagactgcaagggccatgccttcacattgccgtacctgagaagcaaggagctggggtatttatctctttcacactttgggaggctgaggtgggcggatcacctgaggtcaggagttcgagactagcctggccaacacagtgaaaccccgtctctactaaaactagaaataattagctgggtgtggtggcacacacctgtaatcccagctacttggaaggctgaggcatgagaattgcttgagcccaggaggtagaggctgcagtgagcataaattgcaccactgcactccagcctgggtgaaactctgtctcaaaaagtaataataatcatgataaataaaataacattagattgttagcagaagtagccacaggtttctcccacctctctgcaagttgctgagtgtgattcccatcaagaggtacaatgtctttttatttttattttatttattttatttatattgcctatgttgtctaggctggttccaaactcctgagctcaagtgatccttctacgtcagccccccaaagtgttgggattacaggcatcagccactgcacctggcccagatactttttcttgagtaggaatttcgagtcaccctgaacattgcatgccttcgtagtggggaagacaataggaaaccacaggctgtaggctaaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatactcaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcactccactctaggtgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtatcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaattttttagactgttctcttacaggaatggttttgtggttctcagcattttaaaaaaaatagtggttccaatatgttttattgacatcaattactgtaagtctgattcattttctgcctattgatttctacccaaggtgaaattcatgacatttaacagaaagcataagtgattttttaaaagcagacactattagggacggtaaaaataagatttaaagtcgggacacttgaaaaagcaatttttatacctttggtaacgattctattctgattctttgtataaataatataaacaaaggctctagaagcttactataatgaagttggtgtgctgtttctaaattctggtttaaggcccaaattcattttatctgcattaacttttttttttttgagagtctcgctctgtcacccaggctagagtgcaatggtatgatctcggctcactgcaacctctgcctcccgggttcaagcgattctcctgcctcagcctcccaagtagctgggattataggtgtgcgccaccacgcccggctaatttttgtatttttagtagagacggggtttcactatgctggtcaggctggtctcaaactcctgaccttgtgatccgcctgcctcggcctcccaaagtgctgggattacaggcgtgagccactgcacccggccgtgttaaaatttttcagtggtagaccactatgtcaatatgttgctttcactgacaacagtattttcttaaagataggataccccatttctagatgaatctcattctagctggaaaataatttttcagttctgaaactacatcaggcctcagggaatcaaaactagctattagccacacacatataaagtggctttgctttataaacgatttagggtcaccatcaatgacaatggtccctttttattgtatttttaagagtttcttatcttaaatggctgcataactgtagagttttaaaaaaattaagtaaatgaccatgttaatgctctattaagcttccaaacaatattgtaatttactttgaagatttttttttattctcaacatcctgcagcttgaccgtttgcctccgtgtctcagtgctgcttattttgaggtgtggactggagtccatctgtcccccttgcctctgaactgctccgttttgtgtttcgtaattcttcatgctgcatcctgggcgcatttctctgtagtagctttcaatttgctcatgctttgactgggcttagtctagcgtttatcctatctcttaaggttttttaaaaaattttcatgattattcatttatttccaggatttctcatttcttcagtcacatctccttgttctggttttacttcttcctgtttttattcataacatcttttttatacacgattccttcatgtatttctaatcttaagtatatttaattgcttatttgattcttttttttttttattgagacagggtcttactctgccaccaggccggagtgcagtgacatagtcatagctcactgcagcctcaactacttggactcaagcgaccttcccacctcagcctcccaggtagctaggaatacaggtgtgagagccgccacacccagctgatttgtcttactatgttgcccaggctggtcttgaattcctgggctcatgtgatctgcccttcttggcctcctgaagtgctgagattataggtgtgaaccactgcacctggccaagtatgtttatttatttattctaatttgagagggagtctcgctctgtcgtgcccaggctgtagtgcagtggcacaatcccagctcactgcaacctctgcctcctgggttcatgcgattctcttgcctcagcctcctgagtacctggggttacagttgcgtgccaccacacctagctaatttttgtgtttttagtacaggcggggttttaccctgttggccaggctggtcttgaacttgtgacctgaagtgatccgcccgccttggcctcccaaagtgctgggattacaggcatgagccaccacgcttggcccaagtatgtttatttttaaagtccccaacaagctatacaataaattgcatatggaatggatttttgttctagttgatttgttggttatcatttgtagaactaactagttgtcttctgtgtttgataccttgcttctaggtcattttgagttgggagccttttgttttgtttttattctcatgctgtttttgagcctagctgtgcctttatggttttctctaaatttaattgaccattgttttatatttggagcagtgggtgtacatcagagtgtgaaagcagccccaccctctccaccagaaggtctccatgccagtttcacgaagcatttttcatgccctcattcctgcccttatcccttgatttgtggggagtttgtaaagcagttgattgttttttttccacgtagttttccaagtgcacataattgttctgttagtgacttgtagctccattatctattaaccttgccccagaccactgtacaagcggacccaacgcttcctccagctgtggcagggacagttacttggtatcctgctgccttttcaatgctgaccagttttgccccttcctcccctcaacccctgtctttcattcaactatcaccaaaccaaaagattctggtttgctttttagtatgtgttcttattcagtacatagtcattttaaaatttaaaccaaaacagacttggtactgattagcttaattttaagctttttctttattattaaacagtgtagtttatcttagcatttcatattaagtatatgatttatttcatattgcttatatgaatgtacacataaatataataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacactgtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttgtggaccgaggagaagggtgttaaacccagattgtgatgtttcacttgatgaagtgcttaatataaacatggaaatatttccgcaaggataaactggcttttatgcctgtgtgttttcaggagaaatagaaatctctaatcaaatattgccagcttttcacccaagtttgactttttgcctaattgagtttgggaggtgtctgaataatggataatgagctttcctgaataaatataaaaattaattaactccaggctctaattcattctgttaccagagttttgtaagcatgttacccctttgtgttcattgggagatcatctgttaccttcttaaatgagtggggaaggatgggaaatgaggaagagctataaaaactattcaggtgaagaaggtttctgcccctccttgccccttttaaaatctccagctcagcagatgctttgtttaaacttgatcaagtgcttgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaaaccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatataccattctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaacagcatctatatgagaatatacccaagggaagtacagagaggaaaaaaatgtggattggggggtgcctcagtgacatatggaacaatattaaacaagtctgcccccaaaatacttgaaggaataaggttcaagttttttccaggtttaatgaaaactataagcctacagattcaagcatttcaacaaaccttcagcaaaataaacaaaaccacagtaggcctggcacactgtctcatgcctgcaatcccagcactttgggagcctgagtcaggaggattgcttgagatctgcttgggcaacatagccagaccctgtctctacaaaaaataaaatgaaataaattagctggatgtggaggtccacacctgtaactctagctagcctggaggctaagaagggaggattgcctgagcccagtagttcaaggctggagtgagctaggactgcatcactgcactccagcctaggcaacagcaagaccacatctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgcaaaaaaagaaaaacattcaaaagaaggcagagacagaggaaaaaaggaacaaagatcaaatgagtcaaatagaaagcagctaaactagcaatatggcagatttaaatctagccatgtcaatagttatattaaatgtaaatgttctaaatacctgaattaaaggatgaagattgtcagattagattgaaaaagcatgacccaactacatgctgtctgtaagaaattagaaaaagaacaaattaaatccaaagtaagaagaaaggaaatagagtagaagttagtgaagtataaaacaaagagcaaagaaaatcaattaaatgaaaagctggttctttgtaaagatcagtaaaattgataaatttctagctaaactggccaagaaaaaagaaaagacatacaaattaacagtatcaggaagaaaaacagagaattcaaaggagtgtaatgcaaactttatgctagtaaatgcaataagttagatggtatggaaaaaaatgtgaacaatacaaagcagactgtggttgcctttggtggcagtagcggggtgggagtggaaggttgaattgactggaaccagaagcacaagtgaactttttggggtgatggaaatgttttgtatcttggttgcattgatagttaaatggttgtagacattgcttaaaactcactgaacacttaagtgggtatgttttattatttgtaaaatatacctcaaaagcagttttaaaaatgtattcaagtacatacttaagatctttgcattttactctgagtataccttaattttaaaatctgttttttaaaaagtattatgtagataccttttattttcccaatgtctttattaaatgacatctccacgttttgcttcttacctctatttttttttttttatttctctgtctctcaggcatgcacacacacacaccaaaaaaagtacatatgcataatccttttggctgaataaaatcagttgcaactgttatttcggcccttatttgctccgggtaaatattcgttagctgagtggtttatctgtatcagatatttcttacatcttcatccagtcacaccagctggactgaccagattgtttttcacttcaagggcagaatttgtactcactgctgaatgcttccaaatgatacgtagaataacaaatttaagacttagatttttactttttcaggtctttttttttttttctgtgctgtatagcatttccctgaaagcttaatctcatctgtaagtgatgcagtggatgtgttactattggattaatttatttactcttaggtaggtttgtaatctgtcatcatgctgttgtttttttgtgtgggtttgtttttggttttgagacagggtctcactctgctgcccaggctggagaggctagagtgcagtgatgtgtttatgggtcactgcagattcaatctcctgggctcaagtgatcttcctgcctcaaccccttgtgtagatggaagcacaggtgcacgccaccacacccggctatttttttaaatgtattgtagagacgaggcatcatttttttgcccaaggctgatcttgaactcctgggctcaaacaatcctcccacctcggctcccaaagtgctgggattacagatgtgaaccaccactcgagctccatcattctgttattagttgttctctagtatgagtcaaaaactcttacctgcccttttacagttttataaataagtaagcagaatagcagaatgtggacattttttaaatccaaattgaatatgcacatgactcaaggagtcaaatagtaccgtaatcggtttatgataaaatccagtggtttggctgggtgtcgtggctcacacttgtaatcccagcaccttgggaggctgaggcaggtggatcacctgaagtcaggagtttgagaccagtctgacctacatggtgaaactactaaaatacaaaattagctgggcatggtggtgcatgcctgtaatcccagctacttgggaggctgaggcaggagaattgcttcaacccgggaggcagaggttgtggtgagccgatatcgcattatttcagaacaattttccacaagatcagtgagtgctgtccaatagacatataatacaacccacatacatgactttacattttcttgtagccatagtagaaaaggtcaaaagaagcagatgaaattaatagcctgggcaacaagagcaaaaccccatcttttaaaaaataaaataaaatatggtggtttgctgtccccacctcagaccatttctctggtctttctcattgaccaccactcccaatctttgttctgctgattgattacagcttgtatatatctccatatttctaagcaaaatgtttatcttttttaaatttataaattctttttattatttttcagagacagggtcttaactctgtcgcccaggctggagtacagtggcaccatcgtagctcactgtagcctcgaactcctgggctcaagcagtcttcctgcctccgcctctcaggtagctgagactacgctacaggcacataccaccatgcccagctcaaaatgtttatcttttgatacattattcgagaccattattaaggtggatgatttagttttcttaaacagccatcccctttcttttcctcccctctgcttcaccgcccccattttcccaatgttttaccttttggttaaatcagtactcattgtttacattatttgcctctgcacatagtcacagatagtattgtactgtactgtactgtgtttcttttttaaacattatttctgttgttaataattgactttttaatttttttcctattttgttttttaaagagatggggtcttactatattgcccaggctagagttcagtggctcttcgcgggcatgatcccactgctgatcagtacaggaatttccacctgctccatttccaacctggaccagttcaccccttcttaggcaacctggtggtcccccattcccgggaggtcagcatattgatgccaaacttagtgcggacacccgatcggcataacgcatgcagcccaggactcctgggctcaagcagtcctcccgggctcaagcagtcctcccacctaagcctcccgcgtagctgagactacagacacttgccaccacaccaggttaatttttgtgttttttgtagaggtggggttttgccatgttgtccagactcatctcaaacttctcagctcaagtgagcctcctgcctcagcttcccaagtagctgggattatagacgcatgccaccacaccccatgataattgcctttttttttaatttgcataattttctttgtagcttttgctaatgttcccatatcttcttatagccttacagaatgattttccacaagatcagtgagtgctgtccagtagacatataatacaacccacatacatgattttacctttttttgtagccatagtaaaaaaggtcaaaagaagcagatgaaattaatagtatcttttacttaacccagttcattcaaaatgttatttcaataaatggtcaatatttaaaatacttgagatattttgcttttatttatttcttttgttactaagtcttcaaaatccaatgtgtattttacacttacagaacatctctttttagactggccacatgtagctcagggttactgtattggacagagtggtttcagtttcaagtttttccttggagacatcctacttgaaatttccattctccatgtatctgggtggttggtctatagacttgccactcacagctgtcatcttgagactttctttgcttttcttctctattggatattcagtttcctggatttcaggtcttctcattttcctctagtagttttgttaggtcatggttggtatggcatggttgggatagcgtgttcacacagctatctcgtgagtcatactcctccaatccagcctgctcgcttcccgtgtctgtcatgtagttgtcaccctgctatctctccctccagtttttgcagaaatttcctttgtcttcactcttggtcttcctctcccatcccccatgtatcctatatctttctctttcttggtttatttcatcactcaggtggaaaagatgctccagtggattactgggaaaagggggagcatggatgataaaggtattgagaccttacacgtcagggaatttttttttttttttttttttttgagacggagttttgctcttgtccaggttggagtgcagtggcgccaactcggctcactgcaacctccacctcctgggttcaagtgattctcctgcctcagcctcctgagtagctgggattacaggtgcccgccaccacgcccagctaattttttgtatttttaatagagacgaggtttcactgtgttggccaggctggtcttgaactcctacttcaggcaatccacccacctcggaatgtttttattgtcccttctcatttcatgactgctgggctaggtatagaattccagaatcattgttcttagaatctcgaaggcattgcttcattgctggccagctttcagtgttcttgcaaagtctgaagctgtgctaatcacctcatcctttgaaagtgaactgttttttcttcccagaaacttacagaacattctctttgtccgcagaattctgggattgcaattactgtgccttagaatgggtctgtttttatcattatgaagagtactggatgggtcgggaggttttcttgaattacttcttgatgttttctttccttgtatttttttgtttgctaattttctatttttttttcttggtttactttcttgggcagggggatttcttctacttatatttgattcttcagttgagcttgtcatttttgctatcttgtttttaagtttcgagagacatctttgttttatataacattctgttcttaatacatagatgcaagatcttttctttctgagtatattaatatgtatttgaaatctttctattctctgcagtttgtttcccccaagggtttttttttttttctggtttttgttttttgtttttatgttagagactttcctgttatatctggtcatcagtggtacctgcatgtggtggagagtaggggcttattggagtatgagaaccttgagcaggtgtaaggagcctgtcaacactgcgctggcctcagggcctctagggaggctgccagttgtgcattctgaggataccttttggttgtgccttttgtctggtcagattatctagagatgctctgcctcctacctggaggagaagggtctagctgccagcggtgtgagtgtctcttggggaaaaggactcgagttcctggtgtttggcttgtgtatggccgcttaccccatttttggtggagcgctcacatcttccactgtgccaacagtcttgctgcagttcatagaccttctggtttacatttttccagaaagtatgtctttagatttctgcagaagtctgaggagcatggaaggagcttggggaatgagatggcaatccaggtcttcccagatggctctacctttatcccctgcagggaatcccactcctccttcctgactgggagcacagccagagccttgggaggaatctggagtggaaatctcgggcggtctggctttcttactgttcacttgtaattttgctttctcacaactgccaaccactaatcagcctgatttccagcttccagaattctattgctgttgtctgctctcctattcccaccgtaggggatggggctgtctttttttttttttttaattttggtaaaacatacaaaacataaagtgttccattttagccatttttaggtacacagttcagtggcagtaagtacattcacgttgtgtgtatttgtttttttagtaataaacaatataaaattttttaagtaataaaacacaaataaaagattgtttaatgtgattatcgtggaattttaggtgtgatcaggagccatggtgtagtcttctgttgaaacagggtgataggatttgtttaccacctcctaggaaagcagttggatagtttgttggcataaaagtacattttatctatttttaataatcgtagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataagctgcttagcccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaaaaaaaaaaaaagttattccagggaaacaattctccaactttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgaggtgagttgtttgcccagagtcacccagtgctgtttgaacccactcacataaccaaccaataccattacgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatatactttcagtgtttgggcttaaattctctttcaagtgtctttgtgatatgctctgaattttaaaaatttagaatcattgaagttcattatacttgaactttaaaaaaaaaaaacaaaaacctcgtataaaggtcaaggtatgacttcatgctgctgtgtacttaggtcatttaatcttcaaaccactggatagaggttaggttgaagttcgatcttaaatcctacctactgtagctcattgtaccagcaacagctgtagggactaggtggaattcatggtgggttttgttcccttttaaagattgaagccaccatattttctgccctctaaaagtttatgtcagccaggcatgggtggctcacacttgtaatcccagcactttggggaggctgaggtgggtggatcacttgaggccaggagttcgagaccagcctggccaacatggtgaaaccccatctctactaaaaatagaaaaattaggtgagcatggtggcctgcgcctgtaatcccagctactcgggaggctgaggcaggagaaacatttgaatccgggagatggaggctgcagtgagctgagaacatgccactgcactccagcctgggtgacagagtgagactcttgactcaaaaaaaaaagttatgcatcagagaacagatcctttgatgccctcctctgccctgaaaggtttttgggggagagtaataagtatcacaacaagatatgacctgagaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatggctttaggccacagggcgattttgaacatttgtaattttgcttaataattaggaaattaaaattctggggaagacagaatgctctatgaagaaaggctgctttgagcaaggagctaggtcagggcgcgttcaactgaggcctttcttcactgcctttttgtcttgtcccagttcctccccatttatgactaaaatcagcccagatgcttctcgtcatctgggatgcagagcatcagcccagctgtgttcagtcctatggggccattgagtaagttcttggtgcatggatacagggcaggcctttaccaggccctgagcccctggtcctcccagcacctctggggtatttaggggaggctgatgggggagggggttgataaggcgggagatgtctggggatgaggttgaggcaaaagtgacttcttgaggactttgctttttggagaagtcaaatttcctacttcttgatttcagcccttcaactctggtatggagtcaggaagccctttaaatacctgttgtcgggtgtatcatgtcaagtgttgcattagcaaatgaccatgtatccttgtgctactgtcctgcctaccccgcatcctagcgcttccttgggacatgagaagctctgtctggtttgtgaggtggcactggggatgttgagaaactgtttacacagtttccctttgccctggggatttactaaaggagtcgaggcagcctgaccccaaagcatcacccctggacactatgaccgaaacatttccccagtgcccaaaccaagaacacccttcccatttttttttcagtggtgttcattatgtaataatacaagtctctcttctcattttttaaaagtcagaagtacagaagagcagagaataatgtccaaggggccctccttcacctcccccgtgcagtgtcagctaagtgtggtgcgtgtccttgcagatcttaggggattgtgatccttcagaccattctaaactggggtggtgctgggagttagggaaggcatgaagggagtagtggagagctgcagtgactggggtcttcatgccagggtggagaatgcaaggcccaggtggccagccatgtgccacgggatttctggctgccaagagctgtttatctgttcactggggagggaagagttaaatgtggtctgcttttctccgagtcccttcagcacagggagtgctgacttgtcttgttcaggtagtaagttcaagatgagctcaggaaagaaagtgagaggacactgagggctagtggttgagccaagtgtgatgggacttaaagggagaagatttaaagaataaggagcttatgggccggggacggtggcttacgcctgtaatcccagcactttgggaggctgaagcaggtggatcacttgggtcaggagttcgaggccagcctggccaacatggtgaaaccccgtctctactaaaaatacagaaattagctgggtgtggtagtgtgcacctgtaatcccagctacttgggaggctgagacaggagaatcgcttgagcccaggaggcagaggttgcagtgagccaggattgcgcccctgtactccagcctgggtgatggagcgagactctgcctcaaaaaaaattaaaaaaaaataaagaggttaggtgaaaatagatgagaatggaaaccatgagaagaagtgatgctggccaaggacatgacaggttctgatgtggaggtgataggcaatgtctcttccagccactgctaataattgagacaaactcaaggcattcataccctgtgtccagtaaacatctgtgcccattgccaggtgagctggattgaaatgggccagctgctcagcagacaccctcatgccccagtgactctgttccccttgggccacctcattgaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccgcgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgtctgattttttggctggtgagagtgtggctacctctgcggagctgtgggagcggctgactagatgagatttgcctccattcagtacctagactcttgccctgccacacctcttcggagtgagcattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagctgagaatagccgatttctgggcagccggcctcctgtgtagactgtcctgtgtagactgtcctgtgtagattgtctgtgtagactgtcctgtgtagattgtctgtgtagactgtcctgtgtagactgtccatgtaaactgtcctgtgtagattgtctgtgtagactgtcctgtgtagactgtcctgtgtagattgtctgtgtagactgtctctgtagaccgtcgtgtatagactgtcctgtgtagactgtctctgtagaccgtcgtgtatagactgtcctgtgtagactgtctctgtagaccgtcctgtgtagattgtctgtgtagaccatcctgtgtagaccatcccatttagaccatctgcctgtgcaggcgcaggccagtgttcagcagggccacaggctcctcggcctccctgccctcgctgctccccaacactgccaaccctgctgcggggtccaggaggagatgggctgaggatcgtggagaccagcaggagcgtgtggcccaggagcagggaactgggtgtccttgggccttgccaggtccaggctcagctaggacacggctctcacagctgtcctggttgcctccggccacagaagaaggtgagggctccagagaggccacctttccaaaaaaagcacagtcatggccctagaatgtaaaaaatccaagtgttaagaaggaacacatcaaaggaaacttcagcagtgaaaacttgaagcattaaccacgaagcctctgcctccaccacacacaaagaaacggctttagttactcgcagaaagtcttcctcttaggacagcgcgtgtttaaaatcataggggtttggtttgttttgttttggggttggggttttttgggggttttttacccttgcctactttttaaaaaatgaaagtgtttatttgcccaacaataacagacagggagcttgcctaagtgttctgttgatgatataatgtatcttgtcttagaaaaaaactttttcagtgaaaggtggtttttaaattttttcttccctccttagtagcttgattagtaaaatgtgaagttacaaatgtgaagcaaacccccacccttcaccactagtcagcaattttgagtaaagaaacaaagcatcaggtgctcacagcacacactgtcttagagggaaggggaagcctggtggcctgtggaagccttcagcatagctccatctgcaggcttctgaccctcagcactactgacacttgggctggatcattgtctgctagggatccgggcagggagtggctgtgctgggcgctgtaggaagtttagcagcatctctggcctctatccaccagatgccagtagcaccccctccccagatgtggcagtcagatgtgtttctgtctagactccagactttgtccaacgtcccctggtaggccaaattgcccccggttgagaaccaccgctctagatggtattgagggttgggaattttaaatcaagacatttattcagaaattaccagatatagtagcatttgcttcttatttatttctttgttgctaagtgtttggcaaaacctctttgctgtgagcacaaggtttgctttagcaattgttgtcacattacagcaaggagtggtgtccagcgctgtagttatgtatttgagcagtgtccagtgctgtagttatgtgttccagcctcaccaggccctgtgcttcattgtctcccactcaagactgaccacaaatggcccacagatccactgtgacaacctttccctttgggttactgtggtggcatcgagaacatggctggttggctttgctgtagtttactgtgataactgtgccagcagtccctgctttcctttgttaagtatcccattccactggaggattacttgggcgtgcagattggcatgaaaagcaatgtatggtttgagattgttaaagtttctttgggatcaacattttcaattctgtatcagcattatccctcccagagggctggctgggagaaatcatgagaagttacagtatcttatttgctcagctaatctaattataaatgatccacacagcttgtggtaaaaccagcttttggggagttttcatttaatgcatacttgtcttctgatttccttccttcaccaaatagtgtaggatgctccctcttatttttggcaaacatgcctgttatcttttgggaccctgggcttcctggaaaccagttatgcagaagatgattgtgtgtgttagactggggtcatccagatggctagagttctcactggttctgtttaaggattgactttagacacctcagtgtaggctgcaccatggcgtaagggttgggattgttgtttagaagggggaagtaagcaaggtgagtttaattggccattgcagaatctcacccgtatctccctcctgaaatcctcactaaagctgccgtttgctttcaggtgctttcatgcacaagacactgcattttgtatcacagggtccatataattcatttttctctcgtacttagttctctgtgttaagaattacttacttagttctctgtgttaataatttttggcgaaaccaaattacccgtcacagggttactgtagatgtctttcataggttttccaaacaccacttgcccacttgtttgggaaggccccaaggactgtttaacatctgccttcatggtggaaacagcaactatgagagatgctagcatgttggcactgccatgttcctctggtaccagcccaagataggactcaatttgaggcctggtgaagtactgtgttctaataaaaatccatctacttttcatggccgtatatatcaatgtaatagggtaactggaaatgtgatcttgtgccttttaaaaattttgtgtgtttaaaacaaaaatttctattggaaatgacagagcatagcttgttgctgtagacacctgagagtccttaaaaataaatattgggttattgacacttagttgcatgacagaattcctcacttgtacagttccaaagtcttagtctttacccagattacagagggttattaagcattaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagcccgtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccaccttactagctcatcacagtgtctccgtttcctcttctgtcaaactcaggttttgcgagggttctgggaggtcctatacgggaagggttagcagttaccatgggtgtgtagcacgggctttatctgaagggaaggtggagccgtagggagaccatgtggagtggggctccagggctgtgtgggtggggagggatctgcttctgggttaccccatgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactctagcctgggtgacagagcaagaccctgtctcaaaaataaataaataaaaaaaatagtagaagtaagatctagaatgtagcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatatggataccattttctagagaggaaagaatgatggaattgcctagtgtgagtctagcaattatcctaacatacacaaatttctccttgttctgtgccaagatactgtatttaatatttaatgaacattaaatattatttactagtgtatttaatggctgaggcagggttaaatatgtattattttcatcccagcagagttgggggaggtcctagtaactatgccatgagctctgtgagggtgaggtggtgtctttgcccccgcctccctggcacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagtgagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggtcagcattgcctttgtttgaatccaggtgtgaccattttaacttttttgtctttgaaggaggctgtcagttgtaaaagttcaaacaccgtctggtgtcaggggaaatagctacccttcatgtttaaaatagctagaaagttgtcaaaatgttcaccatgttgcactttgtgcctttgaagtgctcacatagagagcattgataggaagacgagactttattttcaaaagatttcatcttccaagtacatggctgcagccctgagaggccgagagcccctcgccaagccgtcacctctgctcatgcaaagggatttcctgacaaaccagccgaagtgaacactaataggacttcctcttgctgctctttcaaggatcagtggaaggagctttcccacgaggacctggagcccccacctgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaaggtaatatgattgggtcccagcttgttggggtgaggggaaatgactttctgttctagaaacacacgctggtactgaaaccctgtggatgcagcctcctgttggcaagcagcgcttccgcatccttggggaacagggcgcgtggaccacagccactccactcctggctgctggaggtccggtattgggcacagggtggccgcaggacatgagccacttctgtgggcttctagtgccaccttgtggtgcttgttggaatgaggggctcggagccaccgagtagggtttttctgccccccctgacgacagcgccctcccccaggtttccggacagtcctgaaatgtgatgtccaggcttgagtgccctcagtccccacagtggtcctttggggaatgtaaccttttttatgtggtcttgattaaatcccattttacttccttgcaggttaacaaccattattgagtacctattgatatgtgtggtgtactgagttaactagaacatgtcccctggtctgtgttctagaccatcttgctgggaaaaaggcagacccaaagcatattttggtgggggcccatggacagtgatgtgatagaggtgtccgctgaggtggtcagggaaggctgcttgcagtaggtggccgtgcacggaaagtttgcagaatgagcaggtgttagttccagctggagatgactgccggctgtgcccttggtacctgctttctggagggaagttttaagacgtgtgcatacttgacccagcagttgtatacatggagaaatttactttgcagcaactctcaaaacaagcgtgtaaagatgtgtataggtagttgtgtttgttgtggcattgtttgtagtagtgaaaaattagagacaggccaatgatataaccagggacctgatcaattatgttctctcccggtgttgggatattctgtagctcttaaagaatgagatctgggtgtactgatgtggccagacattgcaattgcagtacatgagaaggcaaatcatacagtagtgtgtacaccagtgagtcctccagccagataaatcctcacagtgaccagtcgcccaggcaccttgtgaaccctaccctgggtgtgggtgctatctgaagtacctgggggagggggtgacaagtggacttcaggctgatgtgggccctggcctggccctccctccaagcagagggggctggctcgctggaaggttaacatcatccaactctgtctacacgtggcttgttttttcctagaattcctgccacaatagcagcatccttgccattcattttctccaaagtgagtaacccatctctgccctctgattcctcagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtgacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaagtgatttttttgactttttgaagtaattttggacttgcaaaatgttgccaaaatagtacgaagagttccccagtaccctcgaagtttcctcgactgtttcaaagctggctgcaggcccaggctcatgagactgggaagaggacaggctgtggtcatgtggacccacaggggcctggggctgcagaagtcagtgtggcttccaccatttcaggtataaaaaagggcatctaagctttcaagaagagggaggatgctctagggcagcggtccccaaccttttctggcaccaggaaccggttccatggaagacaattttttcacaggcctgggggtggtgagggatggttttgggatagaaacttccacctcagatcatcaggcatcagattctcataaggagcttgcaacctgatctcttgcacacattcagttcacaatagggttcacgctcctaagagaacctgatgctgcagctgatctaacaggagatggagctcaggtggtcatgctcagtcgctcgccactcacctcctgccatgcagtccagttcctaacaggcctcagaccagtaccggtctgtggcctgggggttgaggacccctgctctaggctggtactgctgatgcttaaaaagagagggtttgccagaaatcagatgggacaaaagggcaaaggccgtgccacagagtgcccatataggggagagcacgcctggagccttcgagagcatgcagagaagcctggagactgcatttaccggagctgctgcctgaggccaccctccaagtgtccccacagcgcaccacaagaccacaggagtgacctcctcactggcaggtatttggggaaacaactgctgtctactcttttgggtaaaaagtgaaacaccaatagtttaattgaaatttcagaaaattgaacatatgaacaaggcaaataaatactaagtaagttaaaaacacaaaatatgtccaggaagtatcgatgagaatgttcaagttaaagttctccaatgccattgctacagcaacctcaaaccctaggttctctctgcactattaacacagacatctcaggacatggtttgcttttttttaagacttaaataggaaactaatttttctttctttaaagcaattgcgttcttcagtgaactctttctttaggccagttgatggcttcttagcagtttattgacgagatcctagggtagcttccgaagctgggttgattgattgcatttgggtgcggatggccaaagtgagtggccctactgcctgtgctgctcagggctcctgggctgatgtggt

SEQ ID NO: 16007 - DNA, 9226 bp, Human; identical to SEQ ID NO: 12596

SEQ ID NO: 16008 - DNA, 26787 bp, Human
atccgcccacctcgcctcccaaagtgctgggattacaggtgtgagccaccgtgcctggccttttttattactgccattattttgagatggagtctagctctgtcgccaggctggagtgcagtggcttgatcttggctcactgccacctccgcctcccgggttcaagcaactctgctgcctcagcctcctgagtagctgggactacaggcgcgcaccaccacgcctagctaatttttgtatttttagtagagatgggcgttcgccatgttggcgaggatggtctcgatctcttgacctagtgattcgcccgccttggcttctcaaagtgctgggattacaggcgtgagccaccgcgcccagccagttctactttcctattatgtaacaattataggctgggaacagtggctcacgcctgtaattccagctactcgggaggctgaggcaggagaatcgcttgaattcgggaggcagagctttttttttttttttttttttttaaccaattgcagctttagcctcacttggttctaccttccctccttccttccttccctccctccctcctgctttctttctttctttctcttctttttgagacggagtctcactctgtcacccaggctggagtgcagtggcgcaaactcggttcactgaaacctctgcctcccgaattcaagcgattctctgcctcagtctccagagtagctgggattatgggcgcctaccaccacacgcggcaaatttctgtatttttagtcgggacaatgtttcgccatgttggccaggttggtcttgaactcctgacctcaggtgattcgcccgccttggcctcccaaagtgctgggattacaggcgtgagccaccacgcccggccagttctactttcttatcatgtaagaattataggccaggcgagctggctcacgcctgtaattccggctactcgggaggctgaggcaggagaatcgcttgaattcaggaggcagagcctgcagtgaaccgagatcgcgccactgcactccagcctgggcaacagagcgagtctcaaaaaaaaaaaaaaaaaaaaaaaagaattattaaattacccaatcatagaattacccccacctcctgactgcatctaatccagagagaagctctgcttccttaaaccctgcccaaaccctgtaaattctttccaacaccctcttccaaagacgtcccggtgtttcccacggcgtactgccctacttgcaagaccataaactccactttgtccagctacaggagtgttctcgatggtctttggctggagagcacagccgcagtgagagctccctaaagggtcgctgctgttgttaggtctcaagggaaattgcgtggcgcacccattcaatcagatttcataaacaagtattctgaggctccccgacagctgcctcttgcgtggttgtttctcctcaggagatgttatctctcctgggggaagaccgggaagatactttggtttctgacctcccaagcagaaaaccagccgtcaaatttcttacgaagtaaaaacccttagggaggtgggcgcctctagctccaactcagaatttctcaaacaccatgacgcccgggggtcatgtgggaaactaaagctccagcgggttcatatgactcagtgtctaacccactaccctaacccaggaggaagggaccccaattcactctacaagcagcgcaaaagaatgctccaaaaggctgaggcaatatcaacaaccgaatgttcttccggctgcagctcgctcagacgccgcgcacaggtcgctgggcggctacagcgcaagcgcaaccctcttataaatggactacaagtcccggcatgcctggcgacgcggcgtcgcctggtaactcgcgccacacgaagcgcgctaggttggctcttctgcgcgcctgcgccttggcgagctctgcgcaggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgaggtgaggatctgagcccggcgtaagggctaaggattgaggcgagaagcctaacccactccagtgtgggagaacgggcctgcggcctagcagccggccgccgccatgtgaggcagccgcgcctaggcggcccggagcggcagagccggcgaggactccggagccgcaggcttggccgcagcccgctttcctcagggcggcagcgctgaggcggacctcctgccgtggttggcgtttccggaatggagagcacacgttgagtcgtcctcccggaaggggctcgaatgcccggttaataaccccgaacgagactggggctggcgatccctgcattcctttctgctgggcactgccgccccagctcgcctcactgggtgccgggggtgccaggggtgccgcgaggagcctctcttggcttggtataacgccctcgttaaaactttctaggctatcttgtcggggccggtatcccgcccttgtttgccttcctagcattgttttttaaaaagacgagggggtgatggggttagaacgagagaaaaagattctgcagcctcaggaagtgactgaccttcccggaaagtttccgggcgagcccctgagcttcccttaacagagggctaccggcgacgtgagcgggaagtgcgggctgtgaaactggctggatctttttttaccgtggtacttggatctcagtgaatttcctcaaatccctttccctcagatttatcctagttgatataacgtctaacgacttaaaatgaagttgatgttaagtactcccagtaggtattgcttaacattgggggaggccccgtaagttgttgagaatttcctcaggcaataggaagccttgatcacaagggcaaaggaatggtcgagaaaggccagtaaatgtgctcacaggaagtagaataatctccagtttgattagagttaaggggtgaacacttgccaagcaggtaatgactagttcatggagggctgtgaagacgaagttaaggaatttggaatatattctggacgggattccagtctcttacttggttctcacaacagtcctgtaaaataggtctattgttgtgcccattttagagatgaaaaatttgagtgttacagagttgtataatgcccatgatcaaatactaagtggctaaaccagtagaattccagattgactaggatcttaatgggttagagaaactgaaagtttgtatatggtccttggcggttatagacattgctctaggctgctgtatttcaaaagttctgagagtggcagtgtttcacacttgttttgtttctactcatttttcaaacttctcataacctttggcaaatacagtacttacgtgtgcaagattccatggggtgttattctgtgtatgggtcaactagatgacacacaaggtagaaataggaccatcaacgtagtgacttggagggctagagggatcagtgggattaggctttgaaagaagtggaatatgaatgcattactgctggatgaacagaattttgtgaagcaaagatggcagaaccagcatttcggcataggactttggaagccaataaagtattagtttggccacttaggggtgccggtccaactgtattttacaggaaaccggggccgagggagattaacttgtccaagatcatgcagaaagttagtaggacaagaaccctggtctttggcttccattctgccaggtagaagttaggagtagagaggggtatgaagaatagggtatagggcctggttcctgtagtgctgttgactaggtaagtatttttaggccattcctttaacatctggctactgtacagacttgtgaggatcagataaaactctgtacttgaaaatgatttataaactgccaaggactttcccagagtggaagtaatcctgcctggtggtcaggctagacaattaaagaggctgctattaaaaagtaattttctgttttattcatatttctgttttttttttttttttttgagatggaatttcgcactgtcgctggactggagtgcagtggcgtgatctcggctcactgcaaccgcctcctgggttcaagcaattctcctgcctcagcctctcctgagtagctgggattacaggcgcctgccaccatgcccagctaattttttttttgtatttttagtagagacggggtctcactatgttggtcttgaactcctgaccttctgattcgcctgcctcagcctcctgaagtgctgggattacaggcgtgaaccaccatgcccagccttctgtttttgttttttttttttcttgatgtataattgaaataaactgcacacatttatttttaaacctggtaattaagccagaaacttcccaaaacataacgattttcaacctagtagaactatgattttttttgtttgtttttgttgttttgtttttttagagacagggtctcgctcttgtttcccaggctggagtgcggtggcacaatcatagctcactgtggcctctgtcacctgggctcaggggatcctcctgcctcagcctcgcaagtagctgggactacacgtgcatgctcttgcacccgctaattttttaatttttgtagaaatgaggtcttgctttgttgcccaagcttgtcttgaactcctggcctcaaacagtcttcctgcctcagcctcccaacatggaaccatgatctttaaaaagcagaatcctagaaatatggctgctacctggtaagggaaaagaaaaatcccctactcaataggcattcagtaattttcagactatttgttaaaagcagcatcaatatttaatacttgcctacttgctactaggtcccattcacaaggagtcagaacattgggttttcataaaatatggtaaggtgtttttgcaaaaagaagctttaaattaaaaaaaaaagtatttgattcaaaatgggatgtgtgttgtgtgaagttaatgaaacacaaaagaatacaaagaaaaacagcagaatctaagccaggcatggtggcattcacatgtaatctcagctactcaggaggctgaggccaggagttcgaggctgcagtgcgctataattacaattgagagtagtcactacatttcagcctgggcaacatagtgagactcccgtccctaaaaaaaaaaaaaaaaatcccacaatcctatcacacagagatggcaacacttagcatttgttctggtcacctttggaaggaacttttagatcaatgtcttgcttctctgtgggttcttttgtgactcacacctgcttctgggtatagtatgactataaagttgatttcttgggtaaggtatgatctatgagaggaagcttctaatttgatgagcatcagggtaattttagctggtataccttttctttgccctctccaatcaaacgtgagaagttgaaaatagaaaatttatgcttttgaaggctttgttgtgaacctaaaatataactcaagtgatctgtagttttccatatgtgcactgtcaacagctatttgcttttcaaatccaaactagtttcataaaagaaaaccaatttggagtgtagtcagcttataatttggaagctagacatgaaagtcttaaaaagccattttagtcaagactaacatggcctcatttttggggaggtctgctttgggtgctgcttcgggatccctggtccttatttgtaaactgtacttcgcaggatggtatgaataaaataaggcaatgagtatgtatgttaagtatccagacagtaattgagagagatgttaattatttcagtttatgattcctggatgtttattatcctttacaaggctacaaccaaactgtttagctgtagaccataaggtttttcaggggataagaaggcacttgtgaggctgtcttctggtgatatcaggatccttgccatcttcagtctgtcttgatgaataatggttaaaaggcaattaatattctagggaacttgatgcttgaaaaaatgcaataaatggatggtaatcccttccagaaccaaatttatagtgtctagagttttgtctgtccttttgccaagtctccctatttctagaatgaagatgaaatgtagctacttccctgtattattgcagtactccttgcagtgggggactctttcctctttgctcttctatcttggtagggacacttctttaagttggccagataatgttcttcagactgactgcatttcagatttaattatttatacagttggatccttgttaagggagaaaagactaactttgaaaatgctatgcaaataccatacttctctactgggcaaggacagtaactgtattaccttattacagactgtagcttggtttcagtctagttccattaatgatcttgggacataaataagtttatgttataatcaattttgggaagcttttgagagttttatatgtttgggaaattagagcacctgaattgatgaaatttcagtgataggaatcaagagaaaaccatgctttatgaatggtaaagtattatataaattacaattgctaatatttatcgagtacttacgtaccaggcactatggcaagtgttttacatttacatacttctttaaccctcccagtaaccttgtgtggtttgttgtcattctgctacttgtctccattttacacatgagccgtggaataacacaggtacaagccagagtcagaatttaaatctagtcagatgggctccagacttgtgcttttaaacactttactattaacgctgtccacagcagatcactgggcaaaatgctgaatttaagcatggtattaatagaatatggagagagattggtaaggggttcaggaaaaaaatacttgggatttgaatcaggttctatttgacttcaaagaccctgcactttctttttttttttcgagaccgagtcttgctctgtcacccaggctggagggcagtggcacgatctcggctcactgcaagctccactgcccatgttcacaccattctcctgcctcagcctcccgagtagctaggactacaggcacccgccaccttctgctaattttttgtatttttagtagagacggggttttaccatgttagccaggatggtcttgatctcctgacctcatgatccgcccgcctcggcctcccaaagtactgggattacaggcgtgagccaccgcacccagcctcctgcgctttctactctatcaggtgtctgccctgtatgttgtttaaactattatgtctagataacttttctttcttcaagtgatcagtgcaagcagatagtctacaaattataaattagtttttcacctactctatagtggacatttagataagaataagagaattttggggcaaggcatggtcctcacacctgtaatcctaacactgggaggctgaagctggtggatcatttgagcccaggagttcaagaccagcttggggagcatggtgaaaccccatcaatactaaaaatacaaaaaatagctgggtgtggtggtgcactcctgtaattccagctactcaggaaattgaggtgggaggatggtgtgagtctgggaggtcaaggttggattcagctgagatcatgccactgcactccaacctgggcagcagagccagaccctgtttcatttaaaaaaaaaaaaaaaagaacctttaatgttaaacaaaaagcagagtgaaatgttgtatagaggtttctcttactcagagatttgctatatgaagagttgctgatggatttccttgaagatttgtagttaaaaaaaattttgtttttttaatcaggtcaaaagtctctcaagtctctgtgtaacagccccaagttaccagccttgaataaaacattgatacccctggccaggtgcggtggcttacacctgtaattccattgctttgtgtggccgaggtgggaggattgtttgtgcctggcagtttgtgaccacctgggacaacagagggagaccccgtctctacaaaataaaaaaattagctgggcatggtagcacatgcttgtggtcccagctacttggggagctaagatggtaggatcacttgagtccaggaggttgaggttgcagtgagctgtgatcatgccactgcactccatcctgggcaacagtgagaccctgtttcaaagaaaaaacaatacaaaaaaatttacaccccgcttaggtattgttttcctatatctgtaaagtgaggggcatagcataggttgttgccaaagtcccttccctaaattccatgattcattcaaatgtccaaatttgctcatgaaagtgaaagtgaagtatctgtgatactttacaaattgaaagatgtgtacatgtttcagttcacctgatgtttaatagtaacaagaaggttgggtggacaatttattttattttttggtaaactcccctttggtgttttaatgtatcacatactcttttaagagtatgccttttgaggataaagcatatttggaatgtgagcatcattaaaaacaatcatttggtccctttttgttttttgtcttttaaacagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaaggtgcgtggttgatgtgagagagttactgttgtcatagaagccctggttctatgagcgttttggcttttggatatgcagcgacctctcagcctgacaaggctgttccagtgaagtcaaggccatcagtagtctgtatgcagtggacctttttagatttctgataggcttgttgcagggatgtttccatttaattcacaagttgcaaagatgaaaccttgctgttccagagctggttttccagttgaacccatcaggtctcttctctgactttttaatggtagttgtatttgagtgtgggcagaaagaaatggtactaagataggcagttttgtgtcttagcaagtctgaaaatgtatatgagagattaaaattatagcctaaagtatttggggttagacaccagctttagttacttacccctgtgctgtaacatagacataatttgactgttagagagaaatgtttctataaacattgtatgtgtctgttgaatataacactgtgccaggatagagacaactgacattcactgagcatctgccctgtgctaagtgtcttctacatgtttaaaacaaatttggaaagtaactcattcctgttgtaataagataaaatggatttgtaaatagtttcttgaaaaactttgtagcagaaggatcctaaaatatttctagtttataacatggcaggtcaaatggaaaacttgttgaacagaacctattattactcattaatggtaggtaaaatttcactgataacttgtatttactgcacagctgtattttaatgaatgtgaaataatttgttaggccttttgatgattagttgattcaataaaatgttgagctagacagtagaatttaggtgaacaaggcatatactcttagtattgagtagggagatagataagcaagctggtaataagtacctcagttggagtaagcagaagatactatccaatcactctggggatacctaacccagttgtggggaaagatggataagcttagagaaggctttggtggaagtaatttaaccaagatcctgtgagatggaggtaagagggcccacgggaaggtttgttggtgagagaccgcacgtatattgcagtaggaactgaaagtagttcagtagggttagaaccagggattgaagtgaggaaggcaagaagcagaagtggaagatttaaagttggagagttggaaattgtgttagagctctgactttgtcttgggaacagtgaagagtgatatggtcagattactaaataaatattctcaacatggtcccctaaccagatttttcctatagatctttgagatgacctaccattttgtttttcagaaccataacttttgtggccgggcgcggtggctcacgcctgtaatcccagcactttgggaggctgaggcaggcggatcatgaagtcaggagagcgagaccatcctggctaacgtggtgaaaccctgtctctacttaaaaaaatacaaaaaatttgctgggcatggtggcacatgcatgtagtcctagctactcaggaggctgaggcaggagaaccgcttgaacccaggaggcagaggttgcagtgagctgagattgcgccactgccctccagccttggcgacagagcaagactccatctcaaaaaaaaaaaaaagaaccataagttttgtgattgtggagggactaattaatagtcagtcttttctggtgacttgattaattgctgaactatgtttgtgtaactcataatttgatgctttgccttttagttgttaataattatgccttggtctttttagatgcttctgatgatctagatgacttgaacttctttaatcaaaagaaaaagaagaaaaaaactaaaaagatatttgatattgatgaagctgaagaaggtgtaaaggtagtattgctttcttgttgaaggtaaaatttgacctcttgcaaggttgctaatggctgatgtttccctctctttgactcatctcttactagctttgcttttgttattagcacttaattgccactggtagcgtcattttcttgggagtgtgtctgactaggtatcttaaagggattgtggttcaaggaatttaaatttaggtcttacatattgtattgtgtgccattaagatgatcacaaatgtcccttgtccttaactatactgagatttttggctgtggagaactatttctatgagtgagaaatccttctgagcaaatattcctttggtttcttaaacttttggtaacatattgaatatatacaaattgatatgtgtacctctaagcagcaaagaatgaaccacagtggtggttggtagctgatgacaatgtggcctgtaggcaaaccagagcactcaggctagttttatggagttctctgatcttgtggatacttgagaccctgtgagtcttattactgaattgatttctaatacaaatatctcaaaattcttttggacagggagtaagtaacaggtgggcaggaaggtgaataggagggagggtaggtggatggatgaaaggggaaggagctgaagatctgttttcctccctagagttaccattttaaagaccctgcctaggaatcactttagcagaatccacatgtctatttataaaacccaagataatagcagtacacacactcactcacatagagcgcgcacacacacaacagcaaacatacaccaaatatcttgtgccctctactcaaaattttctttgataagtagtttatttgctcaaactcaagtgaataaagtacatcccacatgtagcaggaaatgtatacagtaattcattgggttttagaaataatgtcataattttatgacagttaattcagtaaataagtatgagtgattacagcaagtcaagcttttgaagtattgtgtggtaattgctagagtactgaaatgagtaagatatttttcctgtttgcagagatattttggttcaaggataatttagaatccttgagaacaagctggttttatctggattcatcttgttctctccctgtttggggattctcttttccttctactatagggaaattgagaaaaatgctcagattataatcagaaatgggatttaaatatcctgggtaacagggcgacatgtagagatgtgctacagaaagttttggttaacaaggctttgttggttgattcctccagtagcttttattggaagattagttctaaataagtgcttgaatactatttttgaaggcataacataagaggatgttagaggtatcctggtcatcaggcaaggcacggacattcacttgaagggtttttgaggtcttgggctactctcccacctgaatttccagaccatccgagggcttttgaaaagccttgaaaaatgctttttgcagactggacgtgctgtctcatgcctgtaatcccagcactttgggaggccgaggtgggcagatcacctgaggtcaggagttcaagaccaatctggccaacatggtgaaaccccatctctactaaaaatacaaaaattagctgggtgtggtggtgcacacctgtagtcccagctacttaggaggctgtggcaggagaatcgcttgaacccagcaggtagaggttgcagtaagctgagatagcgccactgcactccagcctgggcaacagagcgagactctgtctcaaaaaaaaaaaaaaaaagaaaaatactttttgctgttctccaccttctgctgtgtcttggtgtcaatatggaagtagatcttactgggataaaataataatagtatagcactagaagttggctagtgtatgctaacttatattcagcatttctaagttcttatttattgacttagagactaggtgagtatctggtgtcctgtttgtatggtatgtagctaataccatgggcagatttatttatttacttatttatttgagacaaagtctcactctgtcgcccaggctggagtgcagtggcgcaatctcggttcactgcaacctccgtctcctgggctcaagcgtccctcagcttcctgaatagctgggtttacaggcacccgccaccacgctgggctatttttgtatttttggtagagaggggtttcaccatgttggccaggctggtctcaaactcttgaccttaggtgatccgcctgccttggcctcccaaagtgctgggatgacaggtgtgagccactgcgcctggctggcagattggtcttgatagccacatgtggcactaagactacacaactggatttgggatcccgaatctgagctttatttactcccagctattccaacttttctgctggtaagatttctgaaatgactgtagccattgtcccaggtcaggatgtaggcacacacaaaatagatattaatgaatgagtaaggttgacagcacagttcaggatagggagctggataagctggtagaaggaaggagaaatcagaaagctggaaactgagactggccttttctgctcttctgggatgtttatgactcatttctaggttttaatatgccctgtttacatccatgcctctggcaactaatcttggggtcaagctttactttgtttccattccattccatcacttgatcctaattccccatggcttctgcctttccctctttgataatgtcatctattggagtgatgcccaaagaccacgccacagactggtgccaggctgactgtcatataataaaaaataaatatttgttctttacgttcttggctcacaactgctaaaatccttggaatctccgaagtgataacagggtctttggtacgctaatgagatttctgaaatgactgtagccattgtcccagttcaggatgtaggcacacacaaaatagatactaattaatgaggaagggatcccttatctggggatctctagatagctttaggatgggggctggtcaccagaaggacaaagctatgattttagagggttggaactttcagtggtccccctgccacctccagagagggaaggtgtggagattgagctcagtcaccagtggttaataatgtaatcagttggccaggcgcagtggctcacacctataatcccagcactttgggaggcccgggccggtggatcacctgaggtcaggagtttgagaccagcctggccaatatggtaaaaccccgtttctaccaaaaatacaaaaattagctaggtgtggtggcgtgcgcctctagtcccagctactcaggaggctgaggtagaagaaccacttgaacccgagaggcggaggttgcagtgagccgagatcacgccactgcactccagcctgagttacagagtgatactcagtctcaaaataataataataagaagtaaataatgtaatcaattggtcatacctttgtaatgaaacccctagacatgggttcggagagctaacatgctggtgagcacagcaaggtgctaggagggtgatgtccctggtgtggcagctccacgcctgccctccttgccacccctcagctcccacccccataacttgtcctatgcattgcttatgtttggctgtttgtgagttgtgtcctttataataaattggcagtagtaagtactttcctgagttctatgagtcgttttggcaaattattgactcttgatggcgaatgtgggaacttccgagtttatagccatgttggacagaagcaggcagcatgggaacccaatacgtggtgactggcatctgaagtgaaggcagtcttgaggaactgagcccttaaacctgtgaaatctgatgataactctggatagtgtgtgtctgaaataaactggaggacacctaactggcattggagggttggtgtggaaaaacacatatttggtgtcacccggaaaaatctttcccaatgactatatcaaaatcacttagaaacttctttaaagtactcctgaaccctgttcctgctgaagatcatcaatccgatttaaacttttaaattttctcaagtgattcttttttttttttttctttgagacagagtttccctcttgttgcccaggctggagtgcggtggcacgatctcaactcactgcaacctctgcttcctgggttcaagcgattcctctcaagtagctgggattacaggtgcctgccaccacatccagctaatttttgtatctttagtaggtgtggggttttaccatgttggccaggctggtcttgaactcctgacctcagggatccacctgcctcgacgtcccaaagtgctgggattacaggtgtgagccaagacgcctggcctctgccgtgattctgacagtagcctggtttggaaataaggacaataattataagatcctaaggctgaagaataaagagatgaatgagggggaaagatcccacaagtgtcttgaagaattcacagttcaaatggcagagtctctgtgagccagtttggtccatttctgacaggcgtttcttatctgtaacttcaattttgaatatgtgatttttttccctgccaaaataatgtcagtccacgtcatttttaaaaaagaacaggctgggtgtggtggctcatgcctgtaatcccagcattttgggaggccagggcgggaggatctcttgaggccaggagtttgagactagcctgagcaacaaagcaagacctcctcatctcaacagaaaatgtaataaaataaataaaaaagaatagtcccagtatcaaatgttcagactcatctcactttcttaggatcttaagattgaaagtgatgttcaagaaccaactgaaccagaggatgaccttgacattatgcttggcaataaaaagaagaaaaagaagaatgttaagttcccagatgaggatgaaatactagagaaagatgaaggtaatgctgaggactcagcagcacatttagaggttactcaagcctttggccctggtctccttgatgggggtggagggtgcttttaaaatttttttcttgccccttatttctactgactgataatggaagcgaaaggaaacagtgtttggcttgataatggcagttaaagaatttgttaactgtgattacattaaaaacatactgattcaggcttgggaaaattactataaccggattttttttttttttttgagacggagtctcactcttgtcgcccaggctgaagtgcaatgacacgatcttggctcaccacaatctctgcctaccgggttcaagcgattctcccgcctcagcctcccgagtagctgggattacaggcattcgccaccactctcggctaattttgtatttttagtagagatgggagtttctccatgttggtcaggcaggtctcgaactcccaacctcaggtgatccgtccgcctcggcctcccaaagtgctgggattacaggtgtgagccacagcgcccggccccgattttttaattaaaaaaattttttaaactcgtgtttacagttttattagtttctaaatgctatagggtctttagagaacttttgtcagtagatgagttttatggatgttgatgtttcttaagtgctcaaaacagttggactttttcctctaattattccaatgcattattttatctttgatttgttaaattaagaaacatttcagtatgttatcaactcctaattagagaggtctctattaagggccttttttgaaagtcataacatccctgtttctaaggaaaagggttgtgagctttggtttctttatgcttaaggctgttgtgaatgcagctgtggaagggaagacagatgtctttgaaactcttcatttctctagacccaccccacttttgtattgtagtagggcccacccctcattcttaaaatcttttttatctgtagctctagaagatgaagacaacaaaaaagatgatggtatctcattcagtaatcagacaggccctgcttgggcaggctcagaaagagactacacatacgaggaggtaagacaaaatctgttgtgaaaaggggctaagctattcactagtgctcaaagaagagcaagataaatcttattggaacggccgttgaagtaatgactgatggtggaacagatgcagagaggtcacacagccagtgcacagcaattcctggtgcgcacccgtggggcagcctgcccagagtgcagcagtcattgtagtactactcactgtccccacctgaatttgtggactgctgagggcatgcagccctctaggaattaggagggcagtggtgaattagctaatttagggccagggtagtctggagtttgctagtttgggctttcctgaatcttacttttccatgtatcatgtactttgccatagaaacaacagaatgagtggttgttcattcatttcactttggacaaggagttgctgagcatctataatgaaccaaatgctggttggggatgaacctctgccctcaaggagctcccagacttgtagtaatgcatgtgtatatttaatcagaagtgaagtatttgctgttaagcaacatgactcaaaggggaactttatacccctgcagttactaagcgtattcatgaataccactttatttttatagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactgtaagttggttaatggagtaccttcatcccaaatgccagattctcattgcagttttaagaatgttaaatgtccttattgtcgactttattatagatggaaagaacacacaggtgtaggggttgagggagttcaccgttcaagcctgtcatttttttcaattcataagtctcagggctgttttattttattaaagataacggtcttgctttgtcgcccaggctggaatgcagtggagtggtcatggctcactgcagcctcaatctcctgggcttcagcagttctcctgcttcagcctcctaagtagctgagactacaggtgcacaccaccatgcccgaccaatttaaaaaaatttttttttttttttgtagaaacgtgggtcttgctgtgttgcccaggagggcttgttttattagtgcattcagaggtgagagaaatcaactcatgctgacccactgaggatggatcctaactagatgtagtgaagagtgaggaggctcaatgtagttctcaggagccttgggagcccagggagtggaaaggctcatcagttgctctaggataggcctgccaagcaagcagtgagctcagggaaagtgcctgaatttgggtgcctcttccttggatgatcattgccaggacacaattgatgagattgtatctttcttaattaccatcacattctatgccagagtcagccctgggttactgtctgggaatggcttttctctgagctcctcagctgcatgttttctggcagtttccttaggaccactgagtttatccactctttgttctttaatttcctaagtgctacatgcttgttgtagaaaatatggtaaacacaaaagagataatattcactcaaaattttaccacccagagataaccacttgttttcattacttacatatatttaaatagtttagatttttttggctaatgacaatagtagtatatactcattgtagaaaaattagaagataaagacatgctaaagaaaatggaaaatcatctgcaaagtccaccattaagaggtagataactgctgggcgcagtagctcacgcctgtaatcccaccactttgggaggccgaggtgggcggatcacaaggtcaggagttcgagaccaggctggccaacatagtgaaaccccggctctactaaaaaatacaaaaaataagtcaggcgtggtggcacgtgcctgtaatcccgctactcgggaggctgaggcaggagaatcacttgaacctgggaggcagaggttgcagtgagctgagattgtgccattgcacactacagcctgggcaatagtgtgagactctgtcaaaaaaaaaaaaaaaaaagaggtagctaacttatcatagtttaatatttttctgtttagccagttttatgtacatattttaaaaataaattgctatcatactggtttttaacctattttctcaatatattgtgaaagttttactcatgtcattagtctgagtaagtgttttaaatagctacacaacatattttaacagttccataagttggacgtggctgctcccaggtttttattatcagaggcaaaacttcaccgaacatctttatacatgtatctttccagtagctcagaatagaatcttaaggcaagatgaaattgctgagttaaaaggaatggatatttttatggcaaacattagcacattgctttctagcaaggtcgtgccagttcatactcccgctagcaatgtaggagcttacctattttattatatttttaccagttctcacctattgcattttggggaaaaaagcttaaaaattgttgtagttagcacctgcttgttggaacaagttcagtgccacagtatagatttaaaaaatgaaatgaaaatattgaatggcattgctctatatttgtgttttttattttatatgtgtatgtacatttttttttttttgtatattgagatatttctaaaagtagaatacacccttgaatggatttatttaaccactcctctagttggtgaatatttaagatgtttccatttttctgttgtgctaccatggaacccttctagacatacactttcttttaatgaaaattttacacatgaaatatatatggattaacatatatatttataagcctgtttgataacatccaagtatccatcacctaggtttggtatatgttgaacttttgacacatttgcttcagatttttttacttctttaaaaagaaggttttatgctattttatgatagtctcaaaaacaaaagaaaaaggtggttttatagttataattaaggccacctttgtatcttttcctggcccctttttccttcccagaggaagttgttattctctgaagtcggtgttgatgttttccatccttgtttctagatgcttacgcacatgtatgtagtcataaaatgtaatatggtcttatgggcattgaagtgtaaacaagtgctatctggctcagttcacatctgtaatcctggcactttgggaagctgagacaggaggatcatttgagaccatgagttccataccagtctgggcaacatagtgagaccccatctctacacaaaaactaaagaattagacaggcatggtggcacacacctgtagtcctagctacttgggaggctgagatgggaggatggcttgagctcaggagtttgaggttacagtgagctatgatcatcactgcactccagcctgggcaataaaacaagaccctgtctcttaacaataaaaaaagtggtgtcatatactgtatctttatttcaaagtttaaataaatggtgcagtgaaattcacttaatagctaaataatcacagatcaaaacaatgaacagattttttagaagtttggtgagatttccatgagagataaggtttatatattttgattttctttttagattacatcgtcagcccaaacatctccttgcatttttgttggctgaattgggtacaaggtaagaaactgtatacatttacatacagtactgctggacatttcataagaacctttcttgaaaaggatatgtaacacacttagagaaaatgttcacctgattattagagaaacttttaggccagtggaggagtgaaatcacttcatttctgtgggagagcttggctgcttaggaatagggcacagagttgacatctgaacaggcctgctggtgtaccaaccagaggaccacagaactgccatgtttagactttcctgttactaactgaaactcttgagtctttttatggagcaaatattagatttttagaggaattggttttcttaaagtcagacttttttttcctaaattggtaacaggctgttgaagaaatacagctagtaagttgatgagtggcactggagaaaccattgaaaccaggatctgtgatgaaataggtacttacctgtcttcagggctcaccttttgaaggcactgagcaagtcattcccattcaggaaggccaagatctcatggaccccatgccaatgagtttgactactatctggaagcctaatgtccctttaaaaataagtaatgtagagtaggtcatgataatgatgactaatgcatattgagcacctcttttgtgccaagtgcttttttgggtgccatctcaattaatcttcacaatagttctatgaagtagaaagtaatattcctatcttcacgttcggaaacaggttcagtaaagtgaagttgtagttggtcacatagctagttagtggcacagtcaagatagatacaatcaggtctatctgtccctgcagcttgatcacctaacaggcttgacacctgtgcgtcactggcagtacagagataattaaggtgttctcttcctactctctttaaactgttgggatttgctacacttggtgtggggttaaggggtaatttacttgaccgtggtggatacgtaggctctgttgtagaagaattgtgggttttgttgttttgttttgtttttttgagatggagtctcgctctgtcacccaggctggagtgcagtggcacagtctcggctcactgcaagcctgcttcccgggttcatgccattctcctgcctcagcctcctgagtagctgggactacaggcgcccgccaccacgcccagctaattttttgtatttttagtagacgaggtttcaccgtgttagccaggatggtctcgatttcctgaccttgtgatccgcctgccttggtctcccaaagtgctgggattacaggcgtgagccaccgcacccagcatgttttaaatataaatttgttaccatcgttatttgtaacttgcacaaactaatgagggagcaaaagctagcattgttttttctattgttagaataatctagaggttttgttagaggtgggataaactattataacaagttgtggccagtaaacttatggtcaatgggttaaatgggttttcgagaaaattccatttattttgacagtgaatgaaaaagaatttctacatcaagcattgcaatcactgtagcctggagattaagggttacaatctgtggaggaggaaatttaaccctgcttgactgaattttgttgtttcactttatgatttataattttgaatgaatgataatatctagcctagagctttgctttctcaaaagtgcctgtcaacagtttcctatcagtttatcattaagtaccattgacagtttgtggcttgtgattcaactatcctttttttttcttcaaacagctttattgagataacagcttacaaatttaaagtgtataatccaggagagtcccactcggacgtccgtctctctcgcaagacagagctattctttctcttttgcctattaaacctccacccttggaccccccccccccaaaaaaataaatatatataaataatatatacaatccaatggggtttttttttttttttgagatggagttgtgctctgtcgcccaggctggagtgcagtggcgtggatcttggctcactgcaacctctgcctcccaggttcaagcaattctcctgtctcagcctccccagtagctgggactataggcgcccaccaccacgcctggctaatttttttgtatttgtagtagagacggggttccaccatattggtcaggctggtctcgaacacctgacctcaggtgatcaactcgcctcagcctcccaaagtgctgggattacaggcgtgagccaccacacctggccccaatggtttttagtatgatcacatattaaacttaatatgtataactgctaccacaatcaattttagtatatttttatcaactatacttctaaccatgcctgaatcaaaatatttggtgcttagaattttaaaaaacaaacgtagcccctttcctgtttttatatttctaggtctctcctttgccttgctttgtacatggtatgatgcagtaaaagattttttcctttgttggatggactgtcacatacaatgaaggaatcagtttgttttagacttaaaatcaattataaatctgattgttatcactggagatttaattggatttgatgttagtatgggtacatcattagacgcaaactatttaattaaaaataaattttgaggctgggtgtggtggcctacacctgtaatcccagcagtttgggaggccatagtgggaggatcacttgagtccagtagtttgagaccagcctgggcaacatagggagacccctccatctctaccaaaaaaaaaaaattagcagggcacagtggggagtgcctgtagtcctagctacttgctaggcttaggtgggaggattgcttgagcctgggagattgaaggtgcagtgagccatgatcacgccactgcactccagtctgggcgacagagtgtgagaccctgtctcataaataaataaattttgggaaaccaagtagtatagcaccagtcctagagtttatcctatgctactgaatatattttaagttcattaagtttaaaggtgctggaatttggttcctttaggaaaaaacaataataatggagatatttttgttttctttcatagtggttctatagatggtaataaccaacttgtaatcaaaggaagattccaacagaaacagatagaaaatgtcttgagaagatatatcagtaagtgtataattcatttcattagatcaccctgaaatgttctcatgaggctgcagtgttagaggaagagccatttgattgcagtgagctgggaaaagctggccttaaaaagatcagagacaaaatgatagtgaaagggaggtggctcttgcctactaactaggggtatagatagaaaaggatttggatttttaaagaaagcccagctgattgaagctgctggttgattgtagggctgaaggccaagtcagagaaacttgcctgtgattcaggcctggctttggcccccttttgttcctagttatttaaaattggcatgtctgtcaacatgtttgagtggctctcctctagacagaaacgagaataagcaagctggcaggcttccttgcatcctggggcattgagtatcagcccatgtttagtgccggaagcgccacagcagacagcttgtgttttcttacccctcgaatagctgcgcttccctggtctgggtgcccagctaaattctcagcctgggcttgtggagttctttgtagatgtatttaagaaggcagaaacttctctacctcactgcagccaccaggtaattctgtgtgttgctttatttgcagaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacaccggccagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaattaacgctccattgcttttgtgtatgtatgtgtgtttgggttattctttacttagcgggaccctttaggagaaggaatgatactcttcagtttggtgacaggttgacaaatagactggtgatttcaacccgtttttaacttcattcttgaagcagattctcaggactgatgcagcccctgtaagagtccagttgagataactgactaaattggattgaaaacccatgaaaaataatgggttgccctatgttactcagacacagtagcatcaacctcttctgtctctactgtctctcaccaaacacagctcagctgaaggaaccttgcaatgtggtgacaaagcaaaggcaatcaagagcccctttctagttttggaagggaaccagaccatcatttccaaagtgtcttaggaaacaacgttgaggacccttcctaattatgaaaaggaaaaggaggggggttccatggtaaagaaaaggcagagtaggctgggcgtggtggggaggccgaggtgggcggatcacaaggtcagcagttcacgaccagcctggccaacatggtgaaaccctgtctctactaaaaaaaaaaaaaaaaaattagctgggcatggtggctggcgcctataatctcagctacttgggaggctgaggcgggagaattgcttgaacccaggaggcggaggttgcagtgaggcgagaccctgccactgcactccagcctgggcaacagaacaagtctgtctcaaagaaaaaaaaagtcaagagtaagtaagtgggtttcataactgcctgacaagtctttaatatggtgatgtgcattttcttttgttttttgagatggagtctcactttgtcacccaggctggagtgcagtggcaagatctcgggtcactgcaacctccgc

SEQ ID NO: 16009 - DNA, 66247 bp, Human
tctttttcattagtcaggtgtggtggctcccatctgtggtccacagctagtcactaggaccacagatgcgagccaccacacctggctaatcaaaattttttttttgtagaggcaggtcttgctgtgttgcccaggtgggtctcgaattcctggactcaagtgatcctcctacctcagcctcccaaaagctctgggattacagactgagccaccattcctggctgcatatgctaagtctgtggtgtaaatactcccatcatggccaaaatcaagctaccaatactaccttgggaagagatgttcaatggcatactgtcatatatttccaccacacagttacaacagatataagcaaccacaaaagcacacaaaacgtaaaatgtagtgaaataattagaaaataatgagttttgttttcaatatactttatttcatcctaaattgatataattttctaaatggctgtatttaaccaatttgcaaaattactgcaaatttaacaatggactctcaagatagtatgagacagctccagcacaccactggttggttgtcttattcttgagctgggagaattctttatatattctacatcagcactgcccaatggaactttctgcaataatgaagatgtcctataattttgagtggtccaatctgatatccactagttatctgtggctactgagcacttgaaatgtggctagtacaaatgagagactgaattttaaattttacttaattttaatccatttaaattcaaatttaaatatccacataaggctagtggctatcataacagacacagaaagaactgactctctcccatgcgggataacatttgggacaataataacgttaataagagttatattgtgcatactttatatgttcataaaactgtagttaaaagcacagattctggagtcagctgcctaggttcaaatctgtttccttctctttaaaatgggattagcctgtaatctcagcactttgggaggctaaggccgaaggatcctttgagcccgagttccagaccagcctgggcaacaaagcgagacgcggtatctaccaaaaataattttaaagattagctgggcgtggtgtcgcaaggcagcagtcccagctactccggaggctgaggcgggagggaagattgcttgagcccaggatgtcgaggctgcagtaagctgtgatcgcaccactgcactccagcctgggcgacagagcaagatcccgtatcaataaaaaaggaaagaaaagaaataatgcttgtagagcgttcggcacagtgtcgggttatactgtaaacattcagtagttggcgctagttattagagcggtgttcctggatgagccacctccatgttgagcctgtaaaactggcctaatatgttctctatgagtcactgcattgctctgcaaatcagataaaacgtcactcgtaggtcagttattaacaaccccactgataatctttggaaaaaactgacataattttctttttcttttttttttggtgagacggagatttactcgttgcccaggctggagtgcaatggcgcgatcttggctcaccgcatcctccgcctcccaggtccaagcgattctcctgcctcaggctcccgagtagctgggattacaggcatgtgtgaccacgcccggctaattttgtatttttagtagagacggggtttcaccgtgttgcccaggctgatctcgaactcctcacctcaggtaatccgcccgcctcggcctcccaaagttctgggattacaggcgtgagccactgcgcccggccagaaactgccacaattttctaaagaggaaaaaaaaatcccttctaagctatcccctcccgacgagacccttcctgttcctttaaaatgggccgggcagcagaaagacgagtgagtgacagcagacaggccaatcagaagcggccccgtctcgggcccaccccgaggcctggcccaaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggtgaggagttgcgcgtggctttggggagagggctgtcgcccgcgggaggttactagtcgccgctcgagagccggccaggcgggatccccttcccctgcgggacaggggcatgggcacaagctctggctggggcgctctcggatcgagggtccgaaggagggctgcgagctggtgggagtgcccgcgacctggcggggttggtgcctgggggaggggtgcagcgcggagctacgggtcgccccgaggctcagccgtggggaccgcggacgcgcttagcctaggtctggcctcattcatttcactcgcgcgggcttctgggccaggcggcctaaggttctggtcccggcgctgccccttactccgtgtgaggttttgggcagattgtccttctttgtgctgtagtttcccattcagtgaaaggggcaaagaaaaccctcacttctctctgggagcctggagcataagttctcaagtgacactctaggtgcaaacttgcagtcggccacgtattcattgtgtaacccaaagcaggttacttaacccctctacacctcagtttctcatctgtaaaataagttagtcaaattagtcacgttatctgcctcgttgagttgctttattaagtgaaataatcttcgtgcttagtttagaacagtgcatggccctaggtaagaactaagttaactgcattggaagttactgagtagacgctgtgcagggtggaatttcatgtagcctcatcgtaactttggaagcatgtactcttgttactaccatttgacagatgagaagttggaatcccacggaagggaacttacttgcccagggtgacacatgaatgagtcagtggctcaccgtttcattatttgagaagttcaggatagtaaagtggttaaaagcagactttggattcaaattgcctgaagtttgattttcagtgatgtgtcctagggcaggtaactacttctgagccttactttcctggtctgtgaaatgcagaaaatagccaccttgcttagatgttgtgaggatttaatgatttggtgtgtgcaaagcacagcatagcgtgggcatacctaacatattaagtgctcaacttttagtcagaaaagttactgctctcgttaacatggagtgagaagattaggattctgacacaggtgctgttttaggggaatttacggtctaggtgggaaaatgctagtcgcagccattcactagatcttcatatattgggtacccgcctgtgcacaaggcattggggattcagcattagtatcttgactccgctctctcttaggtctttctgtccattagcagtttctgataggctttgactttgaattctagccagactaactctcatcacttctcatcatgttcactgctgttgccctggtttgggccaccatcatcttctggcttggattatggcggtagtctcccaactggtgtcccctgctctgtccttgcacctgcatggtctgttctccacacagtattgtttattctcaacacagtaataccattagagtgtaagtcaaatcactcctctgcttagaactttccagtggtctccagccgggtgcggtagctcacgcctgtaatcccagcactttgggaggctgaggcgggcggatcacgaggtcaagagatcaagaccatcctggccaacatggtgaaaccccgtctctactaaaaagacaaaaattagctgggcatggtggcacgtgcctgtagtcctagctacttgggaggctgaggcaggagaatcgcttgaacccgggaggcggaggctgcagtgagccgagatcgcgccactgcactccagcctggcaacagagcgagactctgtctaaaaaaaaaaaaaagaactttccagtggcttccactacggtggtatacaaggccctctggatttgtcctctgctacctctgttacctcatctacttcttaccctttgcttattccactcaagctgtactgtccttgctgatctcaaaaaacactgtatgtgtacatactcctgattcagaatgtttgcatttggtttttcttttcttttttttttttttttttgagacagagccccaggctggagtgcagtggcacgatctcagctcactgcccactctgcttcccagatcaagtgattctcgtgcttcagcctccctagtagctgggattacaggccaagtcaccatgtccggctcatgttttgtatttttagtagacatggggtttcaccatgttggccaggtttgtcttgaactcccgacctcaggtgatccccctgccttggcctcccaaagtgctggggttagaggtgtgagccactgcgcctggccatattgggtttttcttcttagcatagtttcccaccagatatctttatgacttgcttcttcttcagatctgtactcaatatgtttatttcttagtccttcatagactaccgtatttaaaatgcagcccttcccaaatatctcttctgtactttatttttttccatagcacttactttgtaatgtgataaataatgttcttatttcatgtgatgtcttttgtcactagactagaagctctttgagggtgggagttttgtttcttttgtttcctgctgtatttttaacacctaaagtagtgtgtggcacatagtagctcagtatacatttgatgaatacaccacgtgatagattttttctttttttaatttaattttatttatttatttttatttttttgagatggagtctcactctgtcacccaggctggagtgcagtggtgcgatctcggctcactgcaacttccgcctcctgggtttaagtgattctcctgcctcagcctcccaagtagtttggattacaggcacccaccatcacacctggctaatttttgtctttttagtagagacagggtttcaccatgttggccaggctggtcttgaactcctgacttcaagtgatccgcccacctcggcctcccaaagtgctgggattacaggcgtgagctactgtgcccagctgtcttttatttttttgagacagggtctctctttctcacccagggtggagtgccatggtgtgatctcagctcactgcagtctcaacctcctgggctcaagtgatcctcctacctccgcctcccgagtagctgggactacaggcacacgccaccatgcctggctaatttttgtattttcttttttgtagagaaagggtttcgccatgtcgcctggtctagtcttgaactcctgggctcaagcatccgcctgcctcagcctccccaagtgttgggattacagaagtgagccagtgccgctggccaatagtgccttttttcaaggattctagttcaagcttaatttaacactaaaggcaaaggatttagggccactcatgttagcctagtgattatttgttactgctgttacttgggtgccagacaatgcactttatcaagaagcagcccattcaaaagtgttttttgttttgtttttttaaataaatgaagtagaaatgtaccactcctgcagcttcctgtcccctggggcatcatagatggggattaatttttcttttcatttattcagcaaatatttattcagtaactatgtgccaggcagtgtgcaagacttggaaatactgggatgaacaaaagaagcagtctttatcctcatggaacttacagtttagcagagaaatcagacattacactgttaaagttgtagaaaatcccacagagaagtacagattgctatgagtggatataagcacaacaataataatagtagtagaagtagtagctaacattgatatagcatttgttatgtgccagtcattattctaagatttttttttttttgagacggagttttgctcttgtcactcaggttggcaacaatggcgcattctcagctctctgcaacctcttgtctcccaggttcaagcgattctcctgcctcagcctcccaagtagctgggattacaggcacctgccaccacacccagctaatttttttgtatttttagtagaggcggggtttcaccatgttggccaggctggcctcaaattcctgacctcaggtgatccacctgcctcggcctcccaaagtgctggcctggccagatctttctgtattaactcgtgtaattgtacctgaggtagatactattatcactttacacttgaggaaactgaggcaccagctggttgaataactgccaagggcacattgctaataaatggcagaggtgtgatttaagcctggccccagagtctgggttcttccttacattattgtactggggaactaatcctagggagagctgcttaaggaagaggtgcttgagctgaattctgaaagtaaaaattaagccaagttgaggtaaaaacatggaaaaatgctgagcaggaaagaacctggcttcttagaggacagagaagaagccagagagcaacagatagcgggaagcgcgagggaggagatctggttgagaggctggcaaggtgtgaggattcaggattgggtttgtccttagaggcagaggacttacagacatctttcagatgggaatagtaggataaggcctgtgctttagatgcttggaggctgctgggaggactgtccttccaccagttgaagagcaggctccctgccttcccaaggcttctcctcaggttaaacccctggattccctcgcccttccccatgtgatttggttcccagatcttggtgtgcatcatcattgggactgtgtatagcaccttggaagagtgtagagtgtactgaatggttgtttccccccaaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaaggtaaggctgcttttgtcctggtggtcagggtggttcaggagaaccttcatcccctcactatattcctttggggtagttcaaaactaactcttgctcatttgaggataaccaaggttaatccaatataagaaatatttggccaggcgtggtgactcacgcctgtaatgccagcactttgggaggtctaggcaggtggatcacgaggtcaggagttcgagaccagcctggccagtgcagtgaaaccctgactctgctaaaaatagaaaaaattagctgggtgtggtggtgcatgcctgtaatcccagctactcaggaggctgaggcaggagaatcgtgtgaacccaggaggcagaggttgcagtgagctgagatcccgccattgcactccagcccaggcaacagtgtgagactcagtctcaaaaaaagaagtttatttcagtttgacagatctgtttttgtttttgtttttttgcctaatgtatgttaaggatcataccagatcagttatttttagtgggatgtcaagaagagcaagcatagatcatctagaaacttttacttcagctctgggagtgagactgtccaataacacatgtacttactaagtgcccccctatgtgtgtggctaataataagggaattcaaggtggaaggcactcacatgtattaaataatggtagtcactacatcaggcaattttgatacatgtttttggacttctggtgaggaaaatgcatcatgattaaaacctttcctggattcgggacagtctttttttttttttttttgagacagagtctggctcacccaggctagagtgcagtggcatgatcatggctcactgcagtctctgtctcctgggctcaagccatccacctcagcttccctagtagctgggactacaggtgtgcaccaccatgcctggcaatttttgtattttttcgttagagatggggttttgccatgttgcccaggctggtcttaaactcctgggctcaagtgatccacctgcctcagcctcccaaagtgttgagattacaggtgtgagccaccacctgaccaggaacagtcttaaagtgaatttacattttattcattatagtagtatggacaactagactaaacaattttcctttgccaagtttctcatatctgccttagttttctttgactgaagaacaaattaccataaatgtaggggcttaaaacaccaccgacttattggcttatatggcttatagttctttattttattttatttaagagagggtctcactgtgttgcccaggctggagtgcagtggctattcacaggcatgattatagcacactataacctcgaactcctgggctcaagtgatcctcctgtctcagcttcctgagtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtgttgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatggtgagtccttactcttcaattctctctgacttcctcttcagccaccagccagagaaaactgctattaaagggttcacctgtttgggtcagcccacctggataatctctgaattgtaaggtcagctgacttggggctttaattatacctgcaaaatcactttataacagttcctaaatttgtgtttaaatgaataatcagtggatggaaatccagggggaggagtatgaatgtctttagaattctgcctaccatttcttgtattagcatggaaatgactccaaatctgtagggactttaggcatacactactgcacctggcttgctggatggagtgtcttcaagcaaatatcagacatattgttgtacttgtatctcttattctatttatttatttattttgtagagatgaggtctcgctatgttgcctaggctggtgtcatgaactgacctcaagcaatcctcctgccacggcctctcaaagtgttgggattacaggcatgagccattgtgcctgaccaacagtaattctttaatgtcatttaattctcagtctatgttcagttatcttgagttatctcaaaagtgttttttacagttagttggcttaaatcaggatctaaagaaggtctacacattccattttttgctggtatctcttaagactcttttcaccgataatagttcccattccctcttttctccccataccatttatttgtggaataagtcaggtcatttgtcctggaatattttccacattctgcctttgattaattgtatcttcatgatgtttttgaacatatttccctatcctttgtatccctgtaaactgatagttagctcttgaggctaaattatattcagggttggttttcttggtgaaaatatttcacaggtggtgctgtggacttcctattaatagatacataatatctggttatttcacttttagtgatgatgaagttgtaaattaaggtgttgtcagactaatctatcgcttataaatagtatatagtagggatttgttttttcatccagtctgataatttctaccttttgattggggagtttattccatttatttttttattttgattctttttttatgtttaagatcaatcatttatgtttaattatattgttgggtttacatctgtcatcttgttatttgtttcctattggcttacctgtttttccctctcttttcctgtcttatttttatattttattttgttttattttatttttttgagacagggtctcactcttgtcacccaggctggagtgcagtggtgtgatctctgctcactgtgacctctgcctcccgggttcaagtgatcctcccatctcagcctcctaagtagctgggattacagacgcgcaccaccatgcctggctaattttttgtattttttggtagagatggggtttcaccatgttggccaggctggtcttgaactcctgacctcaagtgatttgccctcctcggcctcccaaaatgctgggattacacgcgtgagccactgcgcccagccccttgattatttttaaatattctgttttatatcttctattgactgttcagatctaatttttttttagtgtttgtctagttttgtttagagattttaatatgcatccttaatttctcacggtatatcttgaattattattttgccatgtcacaaatagtaaaagaaccctataactgtatttgcatttaaactctcatcatttctgctatcattgtcatactttttgtttgtttgtttttgtttttgagatgaaggcttactctgtcgccaagctggagtgcagtggcgcgatcttggcccactgcaacctccgcctgctgggttcaagcgattcccctgcctcagcctcctataggtgcacgccaccacacccagctaattttttgtattttggtagagacgaggtttcactatgttggccaggatagtctccatctcctgaccttgtgatctgcccgtcttggcctcccaaagtgctgggattacaggtgtgagccaccgcgcccggcccattgtcgtactttttaaccttctttcaaggatcccagcctttgctgtctgttgttcagtgtctcaatttcatatatttcatacagttttatagttatttttggtaggaagggaagttcaatatatttaattctgtcaagggcagaattgatagtcccaattggtgtcttttttttttttttctgagacaaggcctcgctctgttgcccaggttggagtgcagtggtgcgatcatggttcactgcagcctcaaacttctggactcaggtgatccttcacctctgcccctcgagtagctgggactacagtcacctgtcaccatgcctagctaatttttttttttttttaatatttgtagagacggtgttgccatgttgcccagggttgtctcaaactcctcgggtcaagccatcctcctgcctctgcctcccaaagtgctgggattatggacatgaaccactgtgcccagcctccaattgatgtctttttttgttgtttgtttgacatggagtcttactgtcatccgggctggagtgcagttttgtagtcttagctcactgcaacctccgcctcctaggttcaagtgatcctccagcctcagcctcccaagtagctgggactacaggcattctccaccacgcctggctaatttttgtgttttttggtagtgacaggattttgccatgttggccaggctggtcctgaactcttgacctcaggtgatccacccgccttggcctcccaaagtgctgggattataggtgtgagccacccctctcagcaattgatatctttcaatccatttcaattgttatcctttttggtgctcaaaatgttccatttttgccaatgggccaaactgtgtgtgtgtgtgtgtgtgtgtgtgtgtgtgtgtgtgtgtgtgaacatccattcatttacacattgggtacaactggttttcagtttaactgtagagttaaatagttactagactggccagaaagcctaaagtatttaccaactggtcctttacagaaaaagtttgctaatcgcagctatatgagatccagcttactcaaattttttcctgacaaccagctctccgtttctgcccaatgttttcttcctgtgtgtgactctattaaagatacagacgtttcctcatgattacactcttataaaccctaaaggtgaatgtacctcctgataaaattagttctgctcaaaagtaagagtatacccatcagagtcagttaactcaagcttttaattctggctccacctctctgcaaagggagttatgaagcctacctcactgaatcattgtaagaagaaagtgaaattacagtatgcccctcaaaggaaatggtagctattatcgttcttacattgaaaaggtttgcttctatttatactttgtttaggtgagttcagacaatgcctggcacagacactgtattcgcagtgccttttgtagtgatgcttcgtacttctgctctggtttttggtgatgtctttagaggccctggggagagagaaagagcaaattgactagaggttttgtactgtgaggtataggagataacattgaaatagtaatgttaacctctggcaggatttgaatgcaggatgaaaagtttctcctgaaggttttcaaacttttgtggaaccacaggattcggtgtagggggtcacggaggaatgaggtgctcccacttcatccagagcatgtcttttgatctgtgtcgtgatttggagttctataggagatttaggttgaacacatacccccaaagctattctctgccatcatcacaagtttgcgggatgttggttagggctgaagatgtagattgagaggcatccggccagctgccatgcagtgtgacttgggataattacatgattgggctggctgtggctttatgtttacaatacagacgctgaagtcagagtggttgccttcaaggtgttaacttcaaaacttcacacctgagtcacctgtgcagcttatttaacctttcaaaattgttgttctgtcatcggtaagatggagataataatactcagctcacagataatgtgtgcagggtagttagcacgttgatggcatgtggtaatacgtagtattacccttatgagtagtatgactatatataaatagtagtagcagttggtacacattgattgacatttttttttcagactgtcatcctcactgcttagcatacatctgacacacgggtgtctaacaaatatttgaactgtagactttagctcaatcaaaatgggagctctctaaatgtgcctgctaatcagaaaataaataggttaatcacatactccattctaattgcttatgaaatgtgctgtgttgattaggtggtgtgtgcattataagtaatggaagaaagggagttgtatgcatgtttcagagctgttgaatttcctcattagatgtgcaaactacataaatccattgagagatttatgtcattactgtcacttccgtgtagcggtgcatgtcctgctcagctgttgctgccttcagctcagtagagagaactccctgggctcccctagatacactgttgcctattctcacagatcgatatatttggagagattttggttattatctcgtaagaggttttagcagcaaaactgggagaaatggggtttaatgagaatagaaactatggagacagcagtgtggaatgagagttgattttaggtgttataaagtgtgagcatcggctgggtgcggtgtctcaggcctgtaatctcagcactttgggaggctgaggttggtggatcccttgaggtcaggagttcgagaccagcctggccaacacggcaaaaccctgtctttactaaaaatacagaagttagctgggcgtggtgggcatgcctgtaatcccagctactcgggaggccgaggcaggagaattgcttgaacccagaggcagaggttttgcagtgagctgagactgtgctgctacactctagcctgggtgacagagcgagaccctgtctcaaaaaaaaggccaggcgcggtggctcacacgtgtaatcccagtactttggggatgccgaggcaggcggatcacgaggtcaggcaatcaagaccatcctggctaatacagtgaaaccccgtctctactaaaaatacaaaaaaattagctgggcgtggtggcgggtgcctgtagtcccagctactttttttttttttgagactctgtctcaaaagaaagaaagagtgagcatttttcatttgagttatatttatataaaacataagcatgtcagaaaggtgattttacagatatcattatttagctttttacaagattaagaacatgctgggcacagtggcttatgcctgtaattccagcactttgggaggctggggtgggaggatcacttgaggtcaggagttggagactagcctgggcaacatagtgagacacccgccccccacccccgatttctgcaaaaagtaaaattagatgggcatggtggcatgcacctctagtcctagctatttaggtggctgaggcagaaaggcagggatattgcttgagcccaggagtttaaggctgcagttagctgtgatggcaccactgcagtccagcctgggcaacaaagcaagaccctgtctcaaagaaaccaaattactttaaaaaaatgcctcccttataaagcgttgtgagcattaaatgagataataagtgtaaagtgcttagtgtagtgcctggcacatgatgagtgcatatagtagtaagtatatttgtttgtgggtcaggcactagttcattcctggggatagcagagaatgaggcaatccttcatgcagtaatcatttatggagcatctgctgtgtgccagacattgtgctaagtgcagagaagacaagagagctcattatccattgagagtaccataatacagtgctaagtgccaagaggcagacaggctgtttgtggaaagtaccatgggagtccagcagagggagccggcactcaccctgtctgccaagaaagccacaatcttgcactggagtgctgccatctgtgctggctgctgcaggcttcatttggtcactcagcaaatatatagtgagtttctgctgtgcactagatatagtgctaggcactggggatttactcttgagccataaagagggagagggcccctgcactcttaagaatatgttgtctaatagctgagacaggcattaatcatgtaatcaaatacacgcacgaatatttgcaacaatggtaagttttatgaaggggagatatgtgctgttataaataggggattttataggggtagaataggggactttgatttgccaggaaaggctttcctgaggaaatctccgaatttaaatctcattgtgggctgagtgtgttggctcacacctataatcctagcactttggaaggctgaggcaggaggattgcctgaagccaggagtctgaaaccagcctgggcaacaaaatgagaccctgtctctacaaaaagtaaaaaaaaattatctggtgtagtggtgtgtgcctgtagtcccaactactcaggaggctgaggatggaggatcgctggagcccaggagttggaggctgcagtgagctacgatcatgccactgcactccagcctgtgtgagagggcaagaccctgtctcaaaacaaaaacaaaacaaaccccaaacccaaaactcaaacctctctgcatcaccctaatctcactctactccttaagggcagggactttgtctattttatttgttgtgtatccccagttcctagaacagcacctggcatgtggtaggcactgaagtgaaggaagatgtgattgatctgaattctaaagggagaggaggagttaactgtgagacgaaggagagaagggacttcaggcagaggaaacagcctgtgcggaggatagagagcaggttacatttgagattgaaaggaggaggtgtgtggaacagagtgggagggagggagaggagtgaggcaggctggggccaagccatagtgccttggcccacataggaagagttctgatctgtttccaatgagcaatatattttaaatagctagtatcgtgattcaccttgcattttggaaagacttctctcttgctttttggaagacagactatagcagggggctacagggcaagattgaatgcaggaggggtacaaaagataatgcctggactttctgcttctgctgcatggatgggtagttgggccattccatgagatagcaacacaggaagacaatgaggtttgtctgggaaagatcacgaatttggtctttaccatggtgagcttgaaatacctttgagtcatgtaagtggctgttgagagaagtctgggctggaggtacgggtctgagaattatctgcatagaattttgggatgaagccctgggcatggatgggatggcctagggaggcagggggtggtgggatgagagccaggcctaggagctgagaaacagcaggagagctcaaaactgagggaggagctgccagagaagtaggagacccagcagggtgcggtggcatcccagaaggctacgggcgcgcatgtttcccagtgaggacgtgatcggtctgtccattgttgaggagtgagcactggaaaatgtcctctgcttcgacaatttggaggttgccactggcctgctgggggcagaagccaaattggaatgagtggaggtgaggacatgaagactggagcagtgtggctgtgtgggaagagagaaggtggcactggaggggagagaagggttgagggaaattgttgttgttgttgttgttgtttgaaagtttcgctcttgtcacccaggctggagtgctgtggctcgatctcggctcactgcaacctccgcctcccaggttcaagcgattcttctacctcagcctcccaagtagctgggactacaggtgcacacccccacgcctggctaatttttgtatttttagtagagatggagtttcaccatgttggtcaggctggtctcgaactcctgacctcaggtgatccacccacctcagcctcccaaagtgctgggatcacaggcgtgagccatcacgcccagccaggaagttgtattttaaaataagtcttgagttttgttaatacattataggagaagttgaattgacgaggtaatgggcttccagatggagagacagggtgtacaaagcctggaggcttccaagtgcttgttgtgctttggggcagtgaggtgcttgtgcaactggagcagagatgggtggggaagtgcagtaggaagcacctggggaaaagcgggcctggttagaaagggtctggcgtggggccccagccagtgtgtgcctgggcagcacatcacagtaacaaagtctgaagagatgacaaagcacagtctgagaggcagccagagtagcagggagctgtttatggaggaaataggggaggggagggcagatgagagagatttgcggtcttttctataggcctccgtatttgattaggttcagggagttgtaggggaaaacctatgatggaagaaagcactggtgttctttgctcaagagggtgtttgattaattggggtattagcacagaaagttggaagcaagcagatcgggggtggacatttagggggcagttttcagccttcagtcgggaagatgagtctagaacgttggagggcagctggagtcagagtttccagtcccccgacagtagctggctgaagcctcagcactgggtgggctcactgagcaggctgagcatgttctgggaggtgtccctgcttctgctgctgtgtaaactccgccatcaacatcttgggctttgaagccactgaacgccggactggtttaccttgatttgtctttgcaaagtgtaggaatgatgcttgtcttactccagaatagattgtttttagtgggctcttgagaagtggaggttttatagctcagacaccagagccaggctcttctggagccagggaattctagttcccctagttaaaagctgagtgactttggacaagttactttgcctttataatgcctcagttttcttacctgtaaacttaaggtgataagagtgcctgatccatgagatagattggggattaaatgagaaatgcacataaagcacttagaacagcgtttgacacattttaagtgctcagaaagaggtaatgatagaggtagaagtagaggtagtcattgttttggggtctccagtgttgtcgttccattgttaaagcaccagatggcgacaaagcacacattttcagctgccttgcattcccctgcttggactccttgagtagctttacttattctcttcagatccctaattgatgcaaagtgaagtattttgtttgtttcctttctctctctggcttctttaaaacttctggttgaaactcatttgttttgagactcttatttaaatttcattcataaaattaaaaaaatgctttggttggagtagcatgtacacacagtaaaacattggacaatacaaaatagctgttagtgaaaggcagcgtgctgcccttgccctccaccctgtcctactctccaggagcaccccgcgctttttttttttggtgggagaggagtctcactctgtcgtccaggctggagtgcagtggcacgatctcggctcactgcaacctctgcctcccgggttcaagggattctcctgcttcagcctcctgggtagctggaactacaggtgagcgccaccgtgcctagtctcccccccacttttttttttttgagacggagtctcgctctgttgcccaggctggagtgcagtggcacgatcttggctcactgcaagctccgcctcccgggttcacatcagtctcccgcctcaagcctcccgagtagctgggactacaggtgcccaccaccacgcccagctaattttgtttttgtgtttttagtagagatggggtttcaccgtgttagccaggatggtctcgatctcctgaccttgtgatctgctcgcctcgacctcccaaagtgctggtattacaggtgtgagccaccgcgcccagcctttttcttttttttgagacaggatgttgccctgccacccatgccagactgcagtggtgtaatcacagctcactgcagcctcaaacgattctccaacctcaccttcataaagtgttaggattacaggcgtgagccactgtgcccagccagcacccacttttaactgttattattaccacatctttttgaatagctgaattttatattacttcagccaaaatattggcagtctattgatttgatactgtttcttggagtcgaggagagtcgtagtagcgggggcttggcgattttgtgatgtgtttcctttgtgccagtcactgtgatgggcatttggcaaagtccctgatcttgggccactagtcactgggggaactagtaagtgcagtgtggtacgtgctttgggggagcacttgagagggtggatacctggcctctcctgggaggactgtcaggaagaggtgaacatgtgagcagagttgaagataggacctggtttggcaggcaggaaggacaaggaaaaggtgctcccggcagggtgggtagcagggtcaaacacgtcaaatggcgagagcgtggtatagctgcaggaggctagagggtaagattttggagttggagttagggctatggtgatgcaggcagcatggagagggagggtcagtcttgagggcatttcatgctgtgtcagaagttggatcttgtctgagaaaaacagggaaccactgaagggttttaaaggtaaagcaacacggttacacttgtattttgtgaagatcagtcttgaagcagtgtgcagaatggattgcatggctttagaccgcttaggagatgactgactgggacaatgtaggtgagaaatggcaagggcctgctgtaaggcagtgacagaaaccagaggcgggactgggcctgagaaatgaaaaagaggtagacttgataggcttggagggtggggaaaagtcaaggatggttcccatgtttctggtttgggttgctggatgcatggtattacctgtgcatgagctgggaagtcctggtgaagaaatagaaggttttaagctcattttcttttttatttttatttttttgggggactgggtctcgctctgtctcccagactggagtgtagtggcatgaacatggctcactgcagcctcaacttcaagcagtcctcctacctcagcctcccaggtagctgggaccacaggcatgcgccacctgctctgctactttttgaattttttgtggagatggggtcttaccatgttacccaggctggtctcaactcctgagctcaagcagtcctgcctcagcctcccaaaggcctgggattacagatgtgagccactgcacccagcgttaagctcattttagatttgttgagcctgacttggccttggtgacatctaagtggagatgccagtaaagttggaatcagaagagactgccacttggtagctttgtcaccttcatcagattacttgccaatttgaagccccagtttctttttcaggtaaatggggatagtgataatctctaccaaaggatcatgttgttaaaaggaagagcttcctaaatacccagcacagtccatggccagacaggtgatccgggaagtggtttccttctttcctttctaaggttcggaaggactcaagcgccttcaggcttattgctctttgtacgaagtgagcaattttgggtaataccgtgtcctatggaaagtaactacttaactaaattcaggtagctcattccttaagccatctataatggctgagaatgttatctaaaaacgcctttgcttttcctggttcactacatgtgtcaccacttaacattgacttttccccactgtgtagaaagcatgtacctacatcagatctaaccttgatcccagcaatgtggattccctcttctacgctgcccaggccagccaggccctctcaggatgtgaggtgagtccgggttcctacgctgacaatgactttaactatttaaagtacatttttaaaggggaggagtcatgtcaaacatcctttttttaattatgagagtccattattgtgagtgggaattccattcctgtgattttttttttttccttaagaaagtatagtttatgtttctcctaagtttttacttttcaagggttttaaataacctttttgtacagtttttgcttttcttctggtaggtcttgattttttcctttccatctgcctttaacacgtaaaaatgttcaaagtgtacccccacacgaggtttctggaagtcattttgttgaacataggagaaccatataagtagaaaggtaacttgtcagcatcttttcacatgggagtgttgtaccgaagttttgcaaacatttcatcctggtgtctggggattagagggggatgagcatgtgcgaggcggaggtgactttggcagctgctccgcattctgtctttgccatgcctgccacaaattgccaagacctgttctaaaactctgtgtctgccaattctttcttagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatcctaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcgagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttcagggtgttttttgctaagctcttaagtgataatatgtgtagttttaaatttttatttatttagagacaggatctcactctgtcacccaggctgaagtgcaatggtatgatcaaactcactgcagccttgaactctgggctcaagtgattttcctacctcagcctcccgagtagctggactacaggtgcaaactaccacgcctagctaatttttttttttttttgagacgtggtcttactctgttacccaggctagagtgcagtgacgcgatctcagttcactgcaacctccgcctcccgggttcaagcagttctcctgcctcagcgtcttcagtggctgggattacaggcgcgccaccacgcctggccaatttttgtatttttagtagagacagggtttcaccatgttggccaggtcttgaactcctgacctcaagcaatctacctgccttggcctcccaaagtgctgggattacaggcgtgagccacagcgcccggctgcccggctaatttttttagtttttagtggagatggggcctgtctgtgttgtccaggccggttgtaatttttttttttaacacttaaactgctcctttaaaacaatattttttttgtcattttatttgtgttcaccgtttcactgcaaaccctgaaggagggtgtggagcaccgttctggaatcccgttcgttgtttagcaagaggttggtgataccaaatccccctttcaaaacagtgagattgtttcccaggtttttttgtttgttttttgtttttttgctgacaaccagattttctgtaaacttaaagctttgttaaggacagggttcacaggcaattgacattccctctctgtccctcctcacaccctccctatattcacatggtcaatcatcagtgactctagggctgacattttgtacacactttgtccagtgcttggaccttttgggcctttgatttcaggtgacatattttgatatctgcttttaatccctcatggggaatgcttctccagtcaccatcatctcatgccatgatgccactgttagtgcctgtgccttactttgatgctaccttctacaaaaaaaattcccatttccttccaagcagaagggaaaatccccttcctcaaaaccccagaaccccaggaagaagtacaagggaagtacgtccactttggagtcagacagacttaggtttgaacaccagctatttcattccttgtgtctgactttggccaaatttctaacttctctgagccttgcctttaaaatgaaacccataattcttacatcaaagcaactgacaggattaaatgagataataggtgtgaagaccctagcgcagtgcctggttcttggtgggcgtgtaggaaacggagttccttttctggaccatttgtttgttaggtccctaacaaacaggtcccccttcttagagagtttgttacttccttcgttgttgttatttgtatgttaggtcataagctttttttttttttttttttgagacagggtctcactgtgtcatctaggctgcagtgcaatgcgatcatatttaaagctcactacaacctcaaactcctgggcgtgagcgatcctcccaccttagccttctgagtagctgggactataatcacatgccaccacacccagccataagctttacttgcagtgcttagagagcctggcacatggtctgtacccaacggagttaataaaggatgaaactatacttttgtgtttctgctgtcttgtagaaagctcataggtaggaagaacatacgctttggagcagaaagaactgtgttcaaatccattcttctactcaacctctgtgaccatgagtgggttgtttagcccgcctaaacctcagtgttctcatatgcaaacctggagaatgtctcgtagggtcattgtgaaatccaactggtaggttgccttatattactactaatttgcgctattaaaggcaagctgatataaattagaactcttctgaatgggccttctatatttaaatgggctttttctaggaagtgtatatttgtaaacttgtcttgaatggaaaaaaagaaaatacttgtagatttgaatgaaccacctgagaagatctcattgtagtctgtcataaatcaatttctctgaatcatctgctatatattagcaagataagatctgctttcttagtgttcgaatacagtactatgctccagagaaaaagaaattgctggctggggaataagtaattaaagccagtgacaaaactttctaaaactcagtggattaatttcattctaaaacttctgaggttgttaccagcacggcactctctcattccaaagagaaaaaaatgatatcttaattgagaagttctttctaggctatcttaactgccttttctgagcacagcgtttatcacgggcagatgtgtgatttttgtcttgtttggaaattcaggtttcattttctcaagtgtatgataacagcaagcatcccataggtgtcgttgaatactctggggcttgtctctctgtaaattgcgactctgctgttttccaacttgtcatcttaatggaatgagtttcccatggagagaatctaaattgttatgttcttgacataagcagacagattcttgctctacattccctgacatattgacttgataagtggtggttttacacaagggcccagtcatctcttaggaattaggaaaccattcggggtggaagcagcaatctgtttaaccaccagggggcctctcctctcccagtttcacccagaaaagcaccatttatattttccaaattatctgtattaagataatagaatctaataagtcttacatgtatacatctatcatgttccatcttaaaaagcttatcttccagaattatagataaaaatatatgaataagccataaaaaagaatgaagtgcagatacgtgctacaacatggatgagccttgaaaacattctgttgagtgaaagaagccagacataaaaggacacagattgtatgattccatttctatgaaatagcagaataggcaaatccgtagagatagaacatagattgctggttgctgagggctaaggggagacacaatggggagaaactgctcggtgggttttatctattttttttggagacagggtctcactctgtcacttaggctgagtgcggtggtgcaatcacagctcactgaagcctcaacctccctagctcaagtgatcctcctacctcagcctcctgagtacctgggactataggcatgtgccaccatgcccagctaatatttaaattttttgtaaagatgaggtctcactgtattgcccaggctggtttcgaacccccaggcttaagtgatcctcctgcctcggcctcccaaagtattgggattacaggtgtgagccaccgtgctcaaccaatgggttttattttagactgatggaaatatttgggaactagacaggtggtagttgcacaacattgtgaatgtagtaagcacccctgaattgtttgctttttaaaatggttaattttatgtgaattttgcttcaatctttttttttttttctgagacagggtctcactctattgctcaggctggagtgcagtggctcactgcaacctctgcctcctgggcctcagcctcccaagtagttgggactacaagcacacgctaccatacctggctcatttttagtatttttagtagagatggggtttcaccatcttacccaggctggtcttgaactcctgggctcaaggaatttgcctgcttcagactcccaaaatgctgggattacgggcgtgagccactgcgcccagcccaatgcccacggttcttcttgccagttctgttgcctgggttgccttctcagctgtgatgatcttttccaggttttgtcacatctgtcctaactggattataagtaaactccttaaaggctgagaccaacttgtacttctaaagaacaagagtaggatatttgtgaaagtgtccaagtacgggaaggggtgagtggatgaaacaagacttgccattcattggggttctactctttaccttccagaacagtccaggctctgcagacagcatcccacctgtcccagcaggctgacctgaggagcatcgtggaggagattgaggtgtgaatcttttgccaaatgcatctcccagctcctgtctttgacactctgcagaagaatcttgcagatagccatgcatgatctgttactacaggttacattgcttcttatatccatggcacacttgtgttctttgtattaaggtattgtgtcctgaggaatatttgtgcctattacataataggtcctcaggacgtggtgactgtggtttttattattgctctatccttgcctttgcccagaatatcatgctcctctgggacctctgtcatggactgcctggcaggagtgacaagcagtcctgatggtgttctcactggatgcttcacaggcacgttggttgcctagtcatgttgcctaggagagcagtatgtctctctttgtcttttggagcattaagaaattctgggaaacgctgtgctttgtaggttgtattcaaatggatggccatggactccatctgtgtcatgatgcttcctgggtgcacagcagcctggcccactggctttccacccaaagcagctggcgtgttctgtgccatgactcctgggcttgggcctgcatacaaggggccaaggaaggagccctcccaaaactgcagaagatagtgctctcctcaaatgtctgtttgatatactttactctgcctaagcaccatttttgagaaagtatgaagtgactgagatggtcttcagatttagagtgagagatgtcacgaagctgtctgcagtggggttgacagtggttcgtgcatctcatttctgctgttacttgacatccagcatatttctgttttgttatggcaggaccttgttgctcgcctggatgaactcgggggcgtgtatctccagtttgaagaaggactggaaacaacagcgttatttgtggctgccacctacaagctcatggatcatgtggggactgagccatccattaaggaggtacctatctaacaattttcaggcatgaaacccaaaggggtcatcagctgtatctgctaaggatggcttttatcagagaggaatgttcagacagtaccttgggatgctgtcactcagtgtcctgggttagggattaagaatgagaaatagaaagatgtaatgcctgtcttcaggaaatgggttgctagtgaggtagacgtgtaaacaaaccatgcttgctttaaatggggtatgtacatgtcacgaggtagtatcaaggaagccacgtgtattactcctgtttcatctccctttcttcccagtacccttttctgcttgtcgcctgaatgctttccactctggtggctcattcagatccttctctgggctcacaattgcttctcctcccttcccccttatgctcagcaacggctaaatcttagctaatctttgctgatggacatagttcactgagaggcatgtgtgtctatcacacatccgccaagagttcattctttttctcaagaggaggttgttaacctgaaagaatctttagttggaatgcatgtgggaagcctttttgagtaggaccgtctttgtaccccttgtttgtgagaagttaccagcccttaatctaaagtacttaaaatacaagctgcttttatttaaattttaggaggagagatttgggttttaagtgagaattttcatttctttatgcattatgagttttgtgccaactttctttaagtaaatagttatctgtcttggataattggaattaatttcatattttctccatgtggtcaaataagttattcatgtgtttgcattctttttgtgtctcttcctttgtcctaagtgtaggaggtctagaaatatactcccttttaatttctgttatgggtgaaattgcaagagtgtggggtcttagggtacagattgtttgctgattgtcctatacacagtaaagtagatgaattaatgatattgtacttatacaacttaaacattttcttcctttatttccaagctgctgctaaccaggtacttggctggagtaatttcgctgtcactgcttttgacaaaacaattctggtgaacagtcacccattttaacgtgtcaacagagtagtgatggaaaattgtaattggtccaattaaagaaaattctttcatgttgactgtgaataacactgtcaggaacaagagagcccttttgttggatggtagattttaaaaaacaaaactgattgaaggggaaaatgtttcctcctaagcaaataacctccagaattttaataatgccttttaggttccacttttttaaaaaattgcttttagttttctcctctaagcagcccattagttcttaatggagagttattttagtttctttttaatgtacattttagctataaagtttggtcttataaataaaaactttgcctcaatgtactacttacaagtaggttgggaggaaaggtagcttagctgggaggataatgagaatcaggaaagaacagattttcttgtagaaggactttggagacaaacagtcctacatttgaatgttggtcttgctaatgttgtggtaacttgcagaagttatttagcctcctttagcctcagtttcattttttgggaaacattgataatagcaatcttttatagtttttgtcaaaatttgagttaatgcatgtaaagcacctatcatgatgcctggcatatatagacattaacaaataattactattatatatatttcataatatagtttcatatctcagtagttatctggaagtaccctgcatttgtgtagtaagcattattatgatttttttttcagacagagtctttctctgtcgcccaggttggagtgcagtggcgcgatcttggctcactgcaacctccacctcctgggttcaagcaattctcgtgcctcagcctcttgagtagatgggattacaggcgcatgccaccatgcctgactaatttttgtatttttagtagagttggggtttttctctatgttagtcaggctggtctcgaactcctgacctcaagggatctacctgccttggtctccaaaagtgctgggattacaggcgtgagccactgcacctggcctgtataataagcacttattaaataactgacaaatcatgaatttcagtttataaaggaagatggaaaaaaaaacaaccacatccaggttctaagtttaaatgcagaatatttgcgttttctccatctacgaatttggatcattgaccaaaagacctcccatgtgaacacccgaaacagataagggtgactttcctctacagcagtggccctcccaccttcccagcagaggaagagaaacagctgtatttcgcatttctttcaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcgggtaagacatccatgcccaaagtgtgcccctctgattatcattcctagtggaaggctttcagaaatctggactatggtcacagccaattacagcccctacaaggacatacccattaaatggagggcaaggctcatttccctgagccttgaaatggagacatgaccactcggtgaactagccacagaacccttcaaatctattaaaaaaatttttttcccctcgtggatttttaatttttgtttctttttttgagacagagtcttgctctgtcacccaggctggaaagcagtggcatgattttggttcactgctgcatccacctcctgggttcaagtgattcttgtgcctcagtctcccaagtagctgggatcacaggcgcacaccaccatgcctagctaatttttgcatttttagtagagatggggttttgccatgttggccaggctggtgttgaactcctagcctcccaaagtgctgagattacaggtatgagccactgtgcctggcctctccctagaggattttaaatagtacaggcttggctgggtactgtggctcacgcctgtaatcccagcactttgggagactgaagcaggcggatcatgaggtgaagagattgagaccatcctggccaacatggtgaaaccccatctctactaagaatacaaaaattagcagggcctggtggtgcgcacctgtagtcccagctactcaggaggctgaggcaggagaatcgcttgaacctgggaggcagaggttgcagtgagccgagactgcaccactgcactccaacctggtgacagagtgagaccctgtctaaaaaaaaaaaaaaaatacaggctttcagtaagtgcaggaatattgcatttctaggtctataactccagatgtatagagaagtcttgcatctaaaatgcacttcccaataccaaactttctttttcatatttttttggttttgttttggttttttttgagacgcggtctcgctatgttgcgcaggctggagtgccgtggtgcgatcatggcccactgcagcgtaggcttcctccagtacccaaattttctaaatatgttattttacgacagctgttttaattctcaattaattctggtgtttatggttgatcagttctctttttccctggtccttgatgggatatctttttgcctctttatagcacagtcctccctttcactcagcagtaagcatagacttctcctttgtgttaactccttgaacagagcacatgcacagatcttgaatatgcttagaacttttatctcaaatgaggcgttttgttgctgttgtttggaaccagtgataagctaagatcttcatgagaaattagcactttatttatgtctaagtgttgggtttccacttaggacagttctgtctgtcccattagttctactttggtggcccctgcagatatcctcctgagcgagtaccctgttcttcaaaattgcccattttctccctacatacaactcatataccctcaacaaagacttgggtagaaagtaacctgagtaacatggtttcctgtgagtcaagaggggctaagagaacaaagtggaaaaagaattgactctgaagttaaatagatggtttgagtcctggctcaactgcttaactggccatgtgacctttagcagtcccttaacctcttgtggcttgtttcttcacctgtgcaataaggattattctatctgtgtcgtacaattgataggagaatgtatgtaaagggcctagcctggtatatgcatatagttgactttcaacaaatgatagttattaatattatccatatttctttaattttcccattgctgataccattctaaagtatttttctggctgatttatttattaattttttagtagagacggggtctcactgtattgcccaggctggtcccaaactcctggccttaagtgatcctcccatctcggcctcccaaagtactgcaattacaggcatgagccactgcacccagtctagctgagacatttttttttttctttttcagagacagggtttccctctgttttccaggctggagtatagtggcgcaatcatagctcatgctaactcttgggctcaagcagtcctcctgcctcaacttcctgagtatctgggactacaagcacatgccaccatgcccagctaattttttaatttaaaaaactttttttttttttggtagaaacgaggtcttgccatgttgcccacgctgttcttgaactctttggcatcaagtgatcctcctgactcagcctcccaaagcactgcaattataggcatgagccatcatgcccagtctgataaattcttttaaagattctgtagtagagtggatagaatagggaatcagaaagaaggcaatatattggccaggtgtggtgactcatgcctgtaataattcactttaggattaggcagcaggcccaaggtcagccaagatttcccgaagcaggggatttgctctcctgcagagcttgcaacctaaagataaagcaccccagaaacaaaattctctgctcctgtagcctttgttgtaacaaataattttttatttatttccagttgcaagtcaccaatgttctgtctcagcctctgactcaggccactgttaaactagaacatgctaaatctgttgcttccagagccactgtcctccagaagacatccttcacccctgtagggtaagtcctgatcatattttggcggggcgctgacctctttgttttggaaagttagcctgcagccagtgtaacagattaatacattccagttaggtaaatttgatctactggtatcgaaagcctacagtcgaatgtaagaaaatgatttttaaaatgaagattatttggttttactgtttcattctctatttctagttggctctgtcttgtcattgtgacataagtagctattttgaaatttaatatttattgatttttttctgataaataataatgtttattataggaaaaatacagcaaagcacaaaaaaagaaaatataacttacccataatgctaccattcagagataacttttgctaactttttttttttttttttgaggcggagttttgctcttgttgcccaggctggagtgcaatggtgcaatctcagctcaccgcaacgtctgcctcctggattctagcgattctcctgcctcaatctcccaagtagctgggattacaggtgcccgccaccacgtccggctaattttttgtatttttagtagagacagggtttccccatgttggccaggctggtttcgaactcctgacctcaggtggtccacctgcctcggcctccctaagtgctgaggttacaggcatgagccactgtgcctggccttgctaacattttataatttttttttgacagtcttttttctatgtatgtaaataaattttaaaaattcagttaagggccaggcatggggctcatacctgtaaccccagcactttaggagactgaggcagatggattgcttgagcctaggagtttgagaccagcctgggcaacatagcaggaccccatctgtaatttttatttatttatctatttattttttgagatggagtcttcctctgtcacccaggctggagtgcagtggtgtgatctcggctcactgcaacctccacctcccggcttcaagcaattctcctgccttagcttcccgagtagctgggattacaggtgtgtgacactacgcctggctaatttttgtatttttggtagaggcagggtttcaccatgttgaccaggctggtcttgaactcctgacctcaagtgatccacccacctcggcctcccaaagtgctgggattacaggcgtgagccattgtgcccggcctttttttaaattagagatgggggccaggtgtggcagctcacgcctgtaatcccagcactttgggggggccaaggtgggcggatcacttgaggtcaggagctcgagaacagcctggccaacatggcgaaaccccatctctactaaaaatacaaaaaaattagccagacgtggtggtgcacgcctgtattcccagctactccggaggctgaggcaagagaatcacttgaacccaggcagcggaggttggcagtgagctgagaacgcgccattgcactccagcctgggcgacagagcgaggctccatctctattaaaaaaaaaaaaaaaaatcagggtatgctttatatgtaacaatgtgccacaaacttttttttataggattaaatattcttttacaatttttttttttcttttttgagatggagttttactcttgttgcccaggctggagtgcagtgtagtggcgtgatgtctgctcattgcaatctccacctcccagcttcaaatgattcttctgccccagcctcctaagtagctgggattacaggcacctgccaccatgcccggctaattttcgtattttcggtagagatggggttttaccatgttggccaggctggtcttgaactgcctcagcctccgagtggctgggattataggcgtgtgacctcaggtgatcctcccacctcagcctccaaagtgctgggattacagttgtaagtcaccatgcctggcctttacaatgatttttaatggctgcatattattgctatgtaattttttaaaaactaaggcccagtttactgggtgtgtggcttgcctatagttccagctacttgggaggctgaggtgggaggatcgcttgaggctgggaggtctaggctgtagtgagccatgatcataccatatcactccagcctgggtgacagagggagactctgtctcaaaaacaaaaacaaaaaactaagggtcaagctgggcacagtagcaggtacctgtagtccagctacttggaggttgaggcaggaagatcatttgaaccgaggagcttaagaccagtctgggcaacatagtaagacctgtttctaaaagaaaaaaattaagggtcaatttttatatgaattagtgtttttcccagctaattgtatagaattttttttttttttgagacagtttcgctctgttgcctgggctggaatgcagtggcgtgatcttggttcactgcaacttctgcttcccaggtacaaggaattctgcctcagcttcctaagtagctgggattacaggcacccgccaccatgcccagctaattttttttgtatttttagtaggaatggggtttcaccatgttggccaggctggtttcgaactcctgacctaaagtgacccgcctgccttggcctccgaaagtgccaggattacaggtgtgagccactggccttatatggaactttttgaagtgttaaattaggtaataagttattgagatcaggagttttcaattttagagagaaaatgcatttcttaatcataaggatacataggcaatatgtgaaattaaaaagcaaaatcatttttaggcgtgtcaatggagtggtaaaagacattgagattttactatatagttagagtaaggaattctctacctttttttccctttaaaataaaaataaatatttttaataaaagtaagatatgtcctttttgagaaattcacaaaacacggaaaggtagaaatcataccaaaaaattagccacaattatactatcgtacaccaacctctttgtacattttggagtattttcctctacatttttgttgtcattgtgaaacatatgtgggatcacattgtaaacttctcaattttacattacactgtggaaagctaccaggagtttgaattttaggagtggtgggagtaacaaaggaaaagaaaacgttggaaacctaggggtgttcatcttagatacttttctccacatgccaatctgtgattaagcacgagggtcaggcctggtgactcatgccccagcctgcactttgggaggctgaggcaggtggatcacttgatctcaggaccctgtctctacaaaaaactgcaaaattatctggacgtgatggtgcatgcctgctgtcccaactaccagggaggctgaggtgggaggatcagttgagcctacgagttttgagactgtggtgagctgtgatcgtgccactatactccagcctgggtgacagtgagaacctgtctcaaaataaaaaaaaaataagaagcacgagattgcccaagtggggtgggaagtcaaaaaggtaaggagttggctagccttggacagtctccaggagacattttgtagctcctgtttgttatatccatgactttcctacctgagttcttgctaagcccattgtcattcttaacagggatgtttttgaactaaatttcatgaacgtcaaattttccagtggttattatgacttccttgtcgaagttgaaggtgacaaccggtatattgcaaataccgtagaggtaggtgtttttctttccttcccattgccatgttagtatatccaaggatatggccaaattgacacagtattaattgtctggtgcattgacttttctctacaaccaagctaatgtgtttatgtggagggagggctgcattcagtctttgctgtttgacagacttagtagctaaggcagtaaatcaagaacttggtcatagtgaattttcttttatttgtaagtttttcattttccattataatttagcattactgtcttacatgaaatttagttagtagaaaaaataaaaatcacccataattccactgagccttaaactcttaaagtgttttgtgtgataggctttggtgggtttagaaaagtgcttgatgccaaataggtgacaaaaagcaccaagtgacacatacgtaacactataatgaagctatttgggtaaaggataaaagaaaatcagtaatctttcataatgaactttgttgatgtttagctaactctagctgggttgaagatcgaagtagctttaaggatagaaagccttatttacctgatgctttgtgggaaagagatagttcaccttagtatttttcccagctaattgaaatttaccccatctggcatggtggctttcattgtaatctttttagatagaagtttgtttaagatgagtgacacattttcctactttcttacttccaatttaagatggtttctttgtctttcatgaccttgacacttgaagaggatgggctctcaatctgtagaatgtctctccgtttgtgtttgtctgatgtttcttcatgatcaggttcaggtcatgcattttccgcagttctatcccaaaagtaatgctctgccctactcagaacaagaagtatatgatgtcgatatgtcttattacaggtcatgttaaccttgatcacttgagtaaggtgattgtgtgctaggtttctctgctgtaaagttgctgtttttctgcttgtatttaagtgtcttgtggggtggtactttgagactctgtaagtatcctaatgatgttgtctgtaatagttattactgtggtgtttgccaaagggtgattttctctttcattccttctacattttaaaaattggaattctgctgtaagaaaataactgtgttttataccattttatttataactatcataattctttatcataacatgtttataatgtaatatattttctataattcatatgtttacaataattgcatcatggacatttattttactatatacattgtggtccatgactcatttatcttgttgctcattttatcctaggtttggcctttggagagctcctcaaattggctcctgtgacacttgctttcttttaatgacagaattaatagctagaaagtttgaccttttcaaaaatgcggcattacttcccataggtagattcaacacttgcatttaaagtttggcagaaaggaagatgttttctggaactcgaatctcttcacctcatgtgttgacctttttagcatgagacatctgatcttagttcgttcactatggatagaagctattgtagcgtatgccttgatcctttcaaatccacattcttataatgttagtttcctatgttaagaggacttatttgcaactgaacatattaaaaggaaagttctttttttcttttctttttttttcttgaaacctcttcttccctgtacttcgagtccatcttaaatgccaggcttatacctcacagttcttaaccccttcctttcttttcacttctaccttctagtcagttaccaagtcctattgattccacctctgattgtcttttccatgagtcttttgctgttacagtcaccaaattgctctattctccatattcgtaccaatatttggtatttttaggttttagtaatctgatgcatatgaaaaggtatcttgttttaatgtctttccttggttactggtaaagttaaacatctttttatatatttattagccaattacatttcctttccagtgaattgttttatatctttgcctggttttcttttggtttgttagtcttattactgatttttaggagtgatatatgtttagttgtgagcatcagatatcttcccctagaattgctttatggcatctcttgaagcacaaaatttaattttaatgaagcctaatttaaatgtcttttcctagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaatacaagtttttttgctagactgtgttttttatatcttctttaaaacaatcctgtgctaccccaaagtcaaaaagatattctccaatgttttctttttttatttttatttttgtttttgagacagagtctcgctctgtcactcaggctggagtatagtggtgccatcttggctcactgcagcctctgcctccggggttcaagcgattctcctgcctcagcctcccgagtagctgggactacaggtgcatgccaccacacctggctgatttttgcatttttagtagatacagggttttgctatattagccaggctggtctccaacttttggcctcaaatgatcggcctgctttggcccaccgacgtgttgggattacagtcgtgagccactgcacctggccctccagtgtcttttgaacatttttaaagttgttttcccccttatatttaaggcttcggtctatctgaagttcatttttgttgctgtagtattttacacccttttctataattgtacttattgcattatattaccattgtttgtttatatgcattgctttttctttttctttttctttcttttttttttgagacaaggtctcattctaccacccaggctggagtgcagtggcgtgatcatggctcactacagccttgaccttctgggctcaggtgatcctcccacctcaacctctcaggtagctgggactacaggcatgcaccaccatgcccagctaatttttgtatttttttctagagactgggttttgccatgttgcccaggctgctctcgaactcctgggctcaagcgatctgcccacctttgcctcccaaagtagtgggattataggcgtgaaccaccacctgcattgctttttcactgggctgagaactcctatgggtgaaaactaaatattattattattattgttattattattattcttttttttttgaaacagagtctcgctctgtcaccaggctggaatgcagtggcgcaatcccggctcactggaacctccgcctcctgggttcaagcgatcttcctgcctcagcctcccgagtagctggggctacaggcacgcgccaccatgcccagctaatttttgtatatttagtagagacggggtttcactatgttggccaggatggtcttgatctcttgaccttgtgatccgcctgcctcggcctcccaaaatgctgggattacaggcgtgagccaccatgcccggcctaaatcttattttttcagtgcttggtttccatttaacattacttagaggaagaaaaggatagagtggtctaaagatgtttttccacattgcaggcccttcagaactctggcaattcatcttccagacttagcttttttttttcttttttctttttttgagatggaatcttgtcacccaggctggagtgcagtggcacgatcttggcttactgcaacctccgcctccacctcccgggttcaagtgattctcctgcctcagccttctgagtagctgagattacaggtacacgccaccatgcctggctaatttttttgtatttttagtagagacggggttttgccttgttggccaggctggtctcaaactcctgaccctcaggtgatctgcctcgcctcggcctcccaaagtgctgggattacagatgtgaaccactaggcctggccaagagttagcttttatttattgatttaataacagctttattgaggtataattctcataccataaagtttaccaattaaaagtatgtaattcaggctgggcatgagccaccacgcttgtaatcccagaactttgggaggctgaggtgggaggatcgcttgagcccaggagttagagacaagcttgggcaacacagggagatcccatctctaccaaaaatttaaaaataaattagccatgtatggtggcatgtacctgtcccagctacttaagaggctgaggcaagcggatcccttgagcccggggtttgaggctgcagtgaactatgatcacactactgcactctagcctgggcaacagagtgagaccttgtctcaaaaaaacaaaaagcctgggcgcagtggctcacacctataatcccagcactttgggaggccgaggtaggtggatcgcctgagatcaggagttcgagaccagcctggtcagcatggggaaaccccgtctctgctaaaaaaaaaaaacaaaaaaaacaaaactgtgcaatccagtgtttttagtattttcacagacttgtgcaacccttgccacaatgccattccagaatatatttatcaccctggagagcaatgctatatcttttagtgggcactcctcattctctcttcctactttctgctttctgtctctgtggttgcctatttgggacattttgtgtaaatgaaatcatacaataggttaccttttgtgtctggcttttttgttttttcacttaacataatacttctaaggttcatccatgttgtagcatgtattagtactttatttctttttatggcaaaataatattccattgtatggatatatcacattttgtttaccgacttatcagttaatgacatttgaggtatttctcttttttggctcttatgagtaatgctgctgtgaacatttgtatataactttttgtttgaacacttgtttttggttctttcaggtatatgcttaggaatagaattcctgcatcatatggtaactcggtgtttcacttttcaagaaactaacaagttttcaaagcagctgcaccattttacatttctaccagcaatgtgtgagggttccaattttactacatcctcaccaacacttgttattatctgactttttgattttcgccatcgtagtgggtataaagtggtgtctcattatggttttgatttccatttctctgataggtaataatgttgagtatctctttatgtgcttattggtctcttgcatatcttctttagaagaatgtctattcaaatccattgtccattgaaaaaaatgtttttggtctttttttcttccttctacaatctatacacctcttatttccttttatttatctttttatattattgagttgtaagggtttctctggttagaggttccttattaaatacatgatttgcaaatattttctcacagtctgaaggttgtattttcactttcatgatgttgtcttttgaggcacaaaaaatcttaattttgatgaagtccagttttaaaatgttttgttgttgttgtttgtgctttaggtgtcatgtctaagatgccattatgtaatccaaggttaagaagatttactactatgttttcttaaaagaattttatacttttggctcctacccttaggtttctgattcattgtgagttaatttttgtgtatggtgtgatgtagggggtccagtcttcttttgcagttgtcctagacccatttgttgaaaaggctgttctttccctaacgaattgccttggcacatacatccttgtaggaatcacttgacaataaatgtaagggttgatttctggactcataattctatttcattaatctgtattgtccttatgccagtgccacgctgtcttgattactgtaacagcttggcattttgtaacatcaaatctggtgtttgtccaagtgtttctgtgattgttggaaaaattatctaagtacaaaatagcagaaatggctaatagctcttgttcatgcaatgataataagcccccattgaggccatttactctccttttcctccctagtgatggagtaagcattacaaaatcttctctcttcctccttattacattagaggtgtgtgtgtttgtgtgtgtgtgtgtgtgtgtgagtgtgagagagagagagagtcggctttgacctttgccgtatatgcaacttttctttgtaatttcagtaataatcacacttagagcctcagagcaggtcattgggtcctgtttgtcctcccaagaaatgctcgacattggtcagagtgcattaacggtggtttggtgtggaagtcctgtaatagccctcattgacattggactggctgtcaggggaagcatcggttttggacgctctcattagcattaattgcccctaatgcaccatcatttttgacagtaataagctaaacaggggtgttattactcccagcagaaagactgcatttcctggcgttaaaacattttttgagatgtatatggcatgtggtgcaggcaaagaaaggaatagcatgatccagtgtaaagcaggcttagctgcatttaaagtggagaaataagtccctttcctattataaaaacgaatcctgcattgttagttggaaggaagaagcagctaatcaacagggatcctacactgaactctttaaaagagggctttggaaaaagttacgatttttatttctaaatttgctttaaaagagtagcataaaaatgctttgcttttgagtgtttccagagacccatttatagtgagattttaggagcagaaggatttgttttaaactgttccctatttaggaacagccctacgggtgtttatgtgcaacaatgaaagctgtaacttaggaaaccttttaaaattggggctgagagcaaaccaagaatgatgcaagttcactgcagtttgccctttgctcactccatgtatctgcattgtctggggatgctcaggatgtctttagaacacacacgaagctggatcctgattagctggccttggtggccagttagtgctgagagtttacagccaggattctaagtgaaaacctaaaagctgatagcttccttatcactatcattaggagacactgaagactttacacaattcttttttttttttttttttgaggcggagccttgccctattgcccaggctggagtgcagtggcatgatcttggctcactgcaacctctgcctcctgggttcaagccattttcctgtctcagcctcctgagtagctgggactacaggcatgcatcaccatgtctggctaatttttttgtatttttagtagagacagggttttgccatgttggtcatgctggtctcaaactcctgacctcaaatggtcctcctgcctcggcctcccaaagtgttgggattacaggcgtgagccaccacgcccggcctagtctgttctttttaattgctccatagtaattaataatatgcatgtatctttctttatttagctagtcttctgtttatggacatttcagtaggatgatgatttcaagatcacatttacagattaaatgaatgagttcttaagagaatgagttagagaaatagggaattacctagttaatcttgatgaagattgcagagtagttaactctgaagacagattatttttatagcatggagtattattgctaatcctcctacctctcccaaaattggagggctgctaagcccatcaagcctcctcctcagtcttcttgctatggaatgtttcctactccccatttggggccacccatgggcagacttgggtcacagttccttctgtgctttcataacactttgtacatccattaaagcagcaacctggtttattataattatggtttgtgtacgggacaggaaggatttcttgccatctctgtatattccctgaatggggaaagtgctcttagcaggtgtcaaatcaaagctctgtggctacttctttgcctgagccttccattccagtttgttttccagtggaaatgatgtcagtacttgtcgggttgtgttttttgcaagaaagcttgctctggttctgagccttgcgtgagttgtaacgctgttaactcagcagagagcccaaagagccaaagtgaggctcctagctcccttcttgggggtgtctattcaacctgatgggccatcgtccctcctcctccactgccataatttcacccagttgcctagactcaatgacaggcaatgatcctaaatatagttctgctatgaattcataggtggctgtgaattcaaaagtagatggtaatatccttacagcttctggtaataaacctttacagttttttttttaaagcaaaacaacacccctattcaacatgataattgaggctgttgtcataaaatagttattacagaggcaggaaagaaggccgttagaaggaattacttgataggtatctttatttttaatttttcttctttgcccttgatttgaggttgtcacacctcgatatggtatttcagaaaactgccaaagctatccttcaattatttgcccagcccgttatctctattccttgatcctgacttagactataaaccagtggatttggcaaggatttccttaagtgttacattcaaacctatcaaatatttggaaggcttacagatctgtttgcacataaaagcgccttgggtttgcataatttgcacattcaaacttgggttttaattcagaaatttaacatgttttctgtctcttttggatatttacattgattttaatctaattttaaaatttctcatttattggcattagcccctctttgtgaagatgtttaagggacatacagaattcaaacactttaagagtcaacatggattggtttgtgcttataacaaactcccaatctcagtggcttaaaacaatgagggtttattttttccccacgctagattctttaggtggtcaactggaggctctgcttcatgatatctttgctccaggaccctggctgaaggagcaagcatctggacattgtgtccatgtcagaggaaaagagagaatcacacattgattcttaaagctttcacttctgcccacatttcattggccagagcaaatcatgtggccacacttgactccatgggggcagggaagtagaattctaccacatgctcagaaggagaatgagaagtacttgggcaacagtacagataactaccatgactgtctaacaaggagctgaagtgcatggattctgagtcagagtgcctgagcttgacactggcctgatcacttcctcacagtctgattttgagcaaagcagcttcatctctctcatcttttatttccttatctgaaaagcagtaccttacagaattgtgaggattaaatgagatagtctttacaaagccagtgcctttcacatggtaagcactcaataaatcctagctatcattagaacccaattcttgctgatttgaatgaaaggtactgcttaaggatttttccccttatttattttaaaggacacatgaaaagatttactttttttcttttcctttttcttcttctttttttttttttgatgtttaccatccatccaaagccagaaaaagacattttaggcctcggaatgggagaggttggaaatattactgggctgggtcagtgttattatcatccttgaagactcttgttctaggattttttcatgcctttactcaccttaaagaatagaaaactttatatctgcatgtgaattcctgaacacccaccaattgacctggcaactgtcttctctattttcctctagctcagagtcaagatctccactgaagttggcatcacaaatgttgatctttccaccgtggataaggatcagagcattgcacccaaaactacccggtaggtgagatgccacctgatccctcagggagctgaggctcaagagctgagaggagtatgcctaggcactgagccctccaggcatcagttctgtgtcagcagccatccagcttacatcctaaattaaagagtctgtagttccactggtcctgcaccggggattctgcgaattatctaagtggatttggagattgtatataccagtgtttagtccatgcacaaactatttattaaccagtcctcaacgaggtaaagcgcttacctcaggatgttagtctgagtcagtcagctatgtcactaagcatattatttagttcagatgataatttttaaaataataagaccttctcaatgaaggaagcaaggtattaatttacattctggtgcgatctccttatcatcacagtcctgaatttgcttttagtgacctaatggcaagtctctctggcctatgatgggtctgaaattagttggaagcctcacacgtgcttaaaattgagatggcagatacccagcactagggctgccatttccccctcccaagtccatggaggcagtactaagaagtcatagaacatttgctcccactgaactcagacacagcctcagaatctttttttgaaacataatcttctaagtagacactaacaattgatcagagttgggccagaatgctgtaagaagcctgctcatcagccctcccccagatccttattggctcagcggggatctagatttctggggtatagtccagaccccaactttactcaactagggtagctatagaggccagaagacagtagggtgaaccatcaaggctctttgaagatgggatgttagccagaggctggaagccaagcagctactccttttaaatcacatagagttggcctttgtgtctctgggttggctatttttgtagtgatattggagataagagcactgtttaagaatccactgaagaaatgtctgtgcgagcgctttgctgtttaattctctgcctagatgaagagttggtcttacttacgagtaaatgtaaaatgtgagtataaaataaagccaggtctgagctctgtaaccatttggctggtttatcccctggccatcttaccctaaaatcccaggagatagctgtgaaaagaagttttcctcatcaagtctgccttttgggaaaatgactttttaaaacccagtttcagggcagaaaactaaattgaaacagtgtccaggaaaaaaatacagcattaaaaaaagacaaagctgaaagtacccttctttcttttgtgtctcctacctgccttgtctcgattttgctcacgtgtgctgctggcatcaatcctgtaattatttctccttgcggttctgccagcccggctctcctgtgtgcctgcagaggccacacgtgagctcctctggtgcctgactttgttggagttgagagccttaggtccttgaagtgaaagcccagaggtacaagcatctgtacacagcatttccccagatcctgctggaagtttattctgcacttttctcagtccaggctttatcagtccaatttgcccccaggttgcagacagttctccacatctgtctgtccacaacagaagtgttactatgggagagggtggttgaggcaatgaagtgaagtatatattttctgcctgttctcagagatatactgatcctctctgaagactaactctatatgcctctttcagggtgacatacccagccaaagccaagggcacattcatcgcagacagccaccagaacttcgccttgttcttccagctggtagatgtgaacactggtgctgaactcactcctcaccaggtcaggaagacacctagacagttctcttaacctgaaatgtgaatggatactagagtttacaatgtggtctataacatggactagagagaattccacgttcctgctttcaggttttgaccgaaccctgacagtccatcaggttctcccacatgacactctcacccttctactggttgtagtcctttacctgggatacacccttctttctaaaaagttagctggtattgaggagaggtacttaaggcagatttgcacttaattaaggtcattccttcctccctccctccctcagatggactcttgctctgtcacccaggatggagtgcagtggtgtgatctcagctcactgcaacctctgcctcctaggttcaagcgattctcctacctcagcctcccaagtagctgggatacaggcgtgcattaccatgcccagctaatttttgtatttttagcagagacagggtttcaccatgttggccaggctgttctcatctcctgacctcaggtgatccgcctgcctcagcctcccaaagtggtgggattataagcatggcactagactcgaggctttttctttctgatttaaaaaagggaatgtgctggccaggcatggtggctcacgcctgtaatcccaacactttggaggcagaggtaggaggatcacttgagcccaggagttggagaccagcttgggcaatatggtgagacctcatttgtgtgtatgtatgtatgtataaataaataagggaatatactgaaataatttcaaaagaagacccaaagcatttttttattctagccaaagcagattttgtattcgtgggactctgaagaatagcccttttaacttgtgcttactttgtattatgaaagcaataggctttatttttttcatagagtaatgaaaattattatttaaaagattttcaaaccatatactctttcccctgagaacctaatatggccccatgtccactcagatacccccactcccacactgcctgtcatcccccttgatggagaataacctgcctttagtgttacgtgaaggaagattcagataaatactttgaatgctgaaagacaggaatgcgggacctagtttggtatggggtaccctgtaccgatgctttagcaaggaccagcagacttgttgccttgaggcagcttcagggcagacctcagaggcaactggatttacttgagaaccttcttgctttctgtttcttgcagctgcagctgttggacttgtgccccaggagcacgttcctctatggccacagtcctgggagtcctctgctcctctctcctccctactcccaaactccagacagcttggttagggcccttagccaagcctaactgacctttgagtacttcagcctcttagcatttcccagcttcttcccagaatgacatttgccaaccaaatagcacaagggaaggaagagtacaaagagaagaaattaaaagactaaactagtaggattaggattagagcaaggagagttagtgaggaagtgtaactttcactgaatacttgtctcatccagaattctgctgtagaatcatggcttagagaccttccaggtggaggtggcattttggtgatgaacttggcagctgcctgcacttgattgtgataggaaggagatctggcatccggtctccccattccattcctggccaagactaattgctgtagttgggatgcttcatatctctgggcctctttccctaaatgctttggtggtggttctttgttgttcaggtatagattaacacatgagatgtagattttctgtagatacagtgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttactatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagcttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcaggtatatcccaaagggcctatccactaaacgtgggagaagagagggcaacaaagccctggacagtggctctgctccctttaacttgttttgtgatgttttatagtttgatcctcacaccctgtggattaggcagggtaaatggcagccccatccttgaactgagaaaacaggtttaaagagtccggtgactaacccccagaaagcagagagttgaagatgaaatcagaacctgagtctggttttcctgacatccggcaggttcaaccctcagaccacagcttattagctatgagcgcagatggttctagcgtttatcctccctgctcctgtgtaaatcagggctgatggggcgacaggtgggaaaactcacctgggagaacagggctctacttccttaggcaagtccttggataagcaagcctggtcctgtcctgcacgcaggactgttgtgagaatcaaagttgataacagatgagtgaagaaaggctttgaaatgtttctaaagccctttccaaaataaacacaataattgttaaacactttggatactggttaaggaaactgaggtggatccactcagtggactattttgcaatcttgagaaatgatcgtacttggaaacttgcatacgaattaatgttgaagtgtcaaaaacagactacctgctgtcattccactttaaaaaacaagtgctcaaagggtagagtagtaggattgttttcaaaactccttttcatattgatacagcattatttaagaatgtaaaatgcagctaactggtaggtgtaattgtgatgatgaagggtgctggctgaagtaggtggcagcagctgctatagtgttagaaatcctttaatggcagcggcagcaaagaagagcagaggtcaaaatttaggaacaggaggctcaagtggggctgtgtcatcatggagctggtttggctgggcattgacaagcagaaaaggcaggcacaagttgatacgttggaggaaaaatcttttttaaaaagttctatttgcataatgagttacagcttacaaagcataatcaaatgcactatttcatttggtctttagagtatctttacaagcctagcagggtggtcatggccctccccacccccaattttccagctggaaagtgaggtgaagagtgggaaagtgacttcccttctggtcacacagccatacgtttcagtttgggcctaaacggaggtctccagaatcccacaccattgctgcttctgctaggtcacactatctaggtgagcttcgtaaagagaattcatgtagaattgctcaggaaaaaacaaaaaacaaaaaaaaaaccaagaaatatcatcagaatgcttgtcgagccttctggtttaactctggaaatcaaagttgggccaggcatggtggctcacgcgaatcttgctttgcagggccaaggagggaggatcacttgaggtcaggagttggagatctagtgagactctgtctctacaaagaatttaaaaattaagctgggtgtggtggcgcgtacctgtagtcccaactactcaggaggctaaggcaggaggatcttttgagcccaggtgtatgaggttacagcaagctatgatggtgctactgcacttcaacctgggtgacacagtgaggtcctgtctctttaaaaaaaaaaaaaaagaaaaagaaatgagagcgggaagttcgtttagggcttccttagagccatggctcagggagagagggatgaattatggttggaaagatctgtagtgaggctctgttaccttttaaaaaggtatagtgttaccaccattagccaattaagtggggcagcagcatatgccagggccaccctaggaacccagaaacattgcgagtccagcgtcctgcctcagtcctgtcactcaagccatccatatacctgggcaccctctttggcactagccaaatgccacttgatggattgcattctctggcctctaaatggcagtgagtctttgaagggaataaagggttggccaagcagtgagctggggttaatgtagtctctgtggaagggagacctctgggatcaaaagccagcattgagaagaggcaaaaggccccatgcccacttgttgccaagaggttttagcctctgggcggcatatcctcttcatgactgacattgatgctttggtccccggtatacatggctgcccctactgggaagggcacattcttaagtcttcttggtgtgtctttcggcagcacctgttccgcgagcctgagaagaggccccccaccgtggtgtccaatacattcactgccctgatcctctcgccgttgcttctgctcttcgctctggtgagtggctgtaattagcgtgggcagcatgcgtctggcgccagacccagcagatgcattccttccaaaggaggctgtgttgtctggcctcagtaaagctccagaggggtccagcagctgtgacctgaattgatgctcaagacattttagaatgaccaaaagttcccactgtggaggagtggccaaataaactgccgcattaacaagtgggcatgagaaagtacctaacagccactaagaatgacaaaagtggatggactgtgatgccgtaggagggttcagatgagatctagtgtgaacagagcgagatccgatgctggtagctataaaaaacagcacaaaggctgtggatttcagcactgcttggggcagaaaaccagaaacaacctaaagttcataagatggaataatatgcagcttttcaaagaatggatagatttatatgctgataggacaagattgccaagatgtgttactgagtgaaaaaggcaaggggtagggtagtgtgtttagtatgatcctctgtaaagttttaaaaggtggctgggtgtggtggctcatgcctgtaatcccagcactttgggaggccgaggtgggaggattgcttgaagctcaggtgtttgagatcagcctgggcaacatagcaagaccccatctctactaaaatcagaaaattagaaaaaaaaaaattaatggtgacgtatgcctgtagtcccggctacttgaggagctgaggtgggaagatcacatgagcccaggaagtcaagtctgcagtgagccatgcattctaacctgggtgacagagtgagaccctgtctaaaaaaaaaataaaaataagttttaaaaggcgatatgtgttagtgttggtcatctctgaggagaggacattctggagaatgtagaggaagtaacttttaccttttctccttttcagtaccatttgaatttttttttttagccaattgtgtttttctcttttttcaaattataaacaaacatgaatgcatatcctcaaagctcagagaattttgagaaaacactcattagatcttacttttggaaagttgcctgtgttcctaattgttgcttttaacaaaagaattactgtttaaatctagataaatctagaagccttgctacaggttttcagaaaccagacctagggtatgggcacctgtccttacatttcagtgatgagaatttcaaatgacatggaacccacggcaagagcgtgaatgccaccagctgccggtgggtttatcttaccaattcttagagaacttagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcagtggatccggattggtgccaatgtctccaacttcacttttgctcctagcacgattatatttcacctgggacatgctggtaagtgccccaggctgctaattacctgtaacgtcctctgacatttagcctgcccacgcaaaagccctgttaagtagacccacaacctattacctataatgacttaatagcattacatttccctcttcctcctggccttttaggacagttaatacgaagataaacctgtttggtccatcacttagaacagctgtcattatattgggcttcgttgtactgtgccactgttggcagaccatttaccctcagttaataaccctgtttatttccagagattactcacttatcgtatctttacattgagcaatcttcctggatgaagagcattaatgcagtttccaaaggttatctttccccacgctatcgatcttcacatttgctgccggctctgtctgtgtagtaatagaaaacagtcctttccacagtcagacatgctatcctgcatcgttctctggagaccttaggacttcaacagcctaaacataacaagacagtaaattcacaaatcacttaagcatttctgaggcttttgatgctattggatcaggggtgccttgcatttcactgtgactttaattttttgttcgttgtttttttttttttttgagacagggtcttactctgtcacccaggctggagtgcagtggtgcattcatggctcactgcagccttgacctcccagactcaggtgatcctcccacctcagcctccagagcagctgggactccaggcttgtgtcaccacatttagctagtatttgtattttttgtagagacggggtcttgctgtgttcagagctggtcttgaactcctaggctcaagcagtcttcccgcctttggcctcccagagtgctaggattataggtgtgagccaccacgcctggcctgaccttaatatttttaaaattctttgcctctttcaggagtcactatctgtgcgcccatagtaaacagattctgtaggggtgcatagataagtctcttgaaattctaggcaaatgtctgtatttttctggggaaagagagagttgtgactttgatcagattattatggtgcagtggtccgtgacctcagaagtggttaagagccccgctgtagttcatccgtcatctgtctgggcaaaactgacaggatgacctttctctctggctcagttcctggatatgtatgatagccctctggggtcagaccgagaagaaaacctgaatataaatctgttgagagccgtggcttttcctgccattgtgctttttgtgcacgttttctcatttgattatcatcatagccctgatgagggtgactggggcaggaattatgatcccttttgacaaggtgggagaatctgggctcagagaagttaagtggctggtaagggcagggcctggaccaggccccagggctctccgttcccagctctgagcccttttcactcagccttcttcctgagtcctccttgctcccttcctagtcacagtggcaaattatccttacagtttgtttccccccataaaaaaagaaattattcatttatttatatcctgtttattttttatttttatttttaatttttttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacccggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaataggtgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcagtcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgcagctatgctgggactcatgtatgtctactggactcagctcaacatgttccagaccttgaagtacctggccatcttgggcagtgtgacgtttctggctggcaatcggatgctggcccagcaggcagtcaagaggtaaggccagacatgagccagggatctagagtagggttagaaatactcagctctgccggcctagctctttgaagggtaggtggcaaaatgatttgtgttcttaggggcaagtctgacaccctaatctagcccagtacagaagccagaagcactttgaagtcagaaaagagccttagtggtcagctttgaatgtattacaaccattgtaattgatgccccaatacaatagaatgagagaggaaaattattgctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtcagacagaccttgacatgagggcagcttgctggcagcttgactttctaaacagaattggaggcaaatttaaatgtcacaaaggtgtttctcattgatttgactttattagaacctgagtgatttcagacacacaaaggccagtaagaacagaattgctttcacctctggaaatcgttttcagatgtgccgctttcttctatccaggacgtttgctggaagaatgtaactcaatagtgtaccctcaacgtggctgccagttagggtgctgggatcagagagaggctttttcagggagaccatcagtgggtgggagaagatgtctcatctccacccgagtctccattgtgagctttctgagcatttcaccatggagactcggcacagacgtgttccttggctttcctgtaggaatccagggcccaccagagcttcccttagcaccagcagtggcagctggttcattttgccaccctccagtagccttttcctggtggttctgcattgtacctgagaaagagccaggactcagttgcttttgcaaagcagaaccctgttcccttgcagcacctgcctgggcccccagggagccaaaagactgctctgctgagttctctcttttctggaagttgctcactcgagaagaatgaaatctgcccgccatggtggcttatgcctataatcccagcactttgggaggctaaggcgggaggatcgcttgagctcaggagttggagaccagcctgggcaacatagtgagacctcgtctctcaaaaaattaataaaaattaagaaaaaaatcaagacaagaattgagtagaaaccatttggtttatgttctgcttagcaggagttcctaatctggaatcctaaagttgtatgcattttatggggagagagactatggtttttatcagaatcccagaaggatcagtaactcctccctctcccctgctcatgtattcgattcaaaaacttaaagcccactcttctgtggccctctttgtgagtcctagaatgaactctaccctggaaaaatcagtgaccctaatggaagctctggttgggtgtttgtcatttctttcctcagctgatttctcccctcactgtcctttcttgattctcaaaccctctttcctttggcaggatcgctgcagagcagagcagtagattggcaaaatataggacactacggtaaagatgaagggcggactcatcccagaagcagggtcccttccccgtcttgcccgcctcatgcatgtcagttatctctctagttttcagcccacttgctcctcccacccctccctaagccacagctgaattctgaggctgcttttcaacttgctagatgaggttgtgactggaccagggcaaaagcttcctgagttagcccagctgatgggataactttgcagtgagcagctttggcctggctttgactgtataagacttcattctcccttatatcccgtggggtacttacttatttatagacaagcctctctctctgtttccaggacagctgagatgaggataagacaaatccaaaattcattaaatgacggtcccatggcaaatcctggcacaccttgtcactgtttctagacttttctgtaacaccgatctctagttgggctaaacattgtggtctggggagactgtaatttatgaaggactgatggccacagatcaaagccagcatcagaatccaggttcctagcactcagggtatgttaaaagggctgctccccatgtgactaaaatgtgaagtgagattccactcattctccttctgcatatcagtcctaggatgggagggaagtggagggaaggagaaggagagtctgatgcttcactgatctgctccgctagaccagggtctggcaaaagttttctgtaaagagccagacagtattttaggcttaactggccatatggtctcttggcaccaactactcaactctgtcactgtcatgtgaaagcagccatagactgtataaacaaatgggtgtggctgtgttccaacaaaactttattcaccaagacaggtggtgggctggatttggcctgagtggcacagtttgctgacccctgccctagaccaacaaagggaggggaggtatttgaattttcaagtcatgttctcctttatcctttgccttggaaatggctttccctgccaaagccacaaaaccatctaatttctaatcctctgaaaataggagagatcaacaaaagcatagtatttggagcctttccatggatgtgtgagcataagctgggtcacctagtcctcaacacagaagggaactgcatttgtttgtttgtttgtttgtttgtttgtttccaggtttaatggagttgtaatttatctgcagaagaatgtaccctttttagtgtacaattctgtgaatcctgaaaaacctctgtagtcatgtagccaccacctcagtcaagatataggtattgccactctccagagagctccccggtgccccttttagagtccgacccttctcccacccccactccctggctatgcccgtttggttttatcctacattatagtcactctgtctgagatttgctttcagcaactgtccttgctgctacatgttgagttctttaattctttaaataagtcgatttcttttcttgattaaaaagaactttttttatagagatggggtctcattatgttgcccaagctggtctcaagctcctgggctcaagcaatcctcctgctttggcccctaaaagtgctgggattatagacgtgagccaccttactcagtctcttgagttttaaagtccgttcccaccctgctatccccaaatcattgcttgaggaagaggaaagtcacttgatcatttggacatttggcatttcctagcatttgaaaggaaaccccctggtagcaaagtgttcttgatctgagggcagacattgatttgagcagacataatgtgggacgtaagttctagccgcagtcaagagttgtgggccactacccttcggctgttcttatttcatactcatgccatcctttctgcatgaacatttctgaatgcccacatattagtgtacctaagaacctctgaatactggcaaggaattaggggtgcacaccccagccctcaagattaattccatgcctgtgcatgtcttttggaactgctttattaatgggtttggagtctgccattctgcaagactggatcattatcaccttagtcctcacccctgggaagagctgccactgaaggatggtgtgtgtgtgtcagcaaccctgcctctgcttgctggagcctgctgggatcagttactcactgcagtcacctcctcagcttcacagtctgtctagattgtcattttcattcattgtgcttccccatccctccttagagtctagggaaaggcagcggaggggaaacaaagagtacaggagataggttcttatcccctttaacactttctgtgagctgagtcccatttttgagaatctttctgtgttaggttagatgctgagtgtgacttggcaagaacacggccacacggcaggaatgtgcaggtttctgtaatgaatggtcaggatgtcatgttctaagctacagaagggccaagtgttggttggcagagctggagtctgggagattgatgatgagcattatttaagctttgctctttgttcatctaattgaaatttacactgtgtttttggccttgcactgtgagaggtgtgcctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtactttagtctctctgttgtcaccagttaggaactgtaactgtgaactgaaaccttcagtaattctgtgtttgtctccattttctttcagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaacaaaggcctgattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttggtatctgaaggccccatttggacctctaggggtccaaggggataggtttttatcccctttaacattttctgtgagctgagtcccatttttgagaatctttctgtgttaggttagatactgagtgtgacttggcaagaacacagctaaacaacaggaatgtgcaggtggactgcagctaggacctctgctcaaggctcttgtcttggggccaggcatggaggctcacgtccgtaatcccagcactttggaaggccgaggcagggggatcacttgaagtcaggagttttgagaccagcctggccaacatggtgaaaccctgtctctactaaaaaaccaaaattagccaaggggtgggcatggtggtgcatgcctgtaatcccagctacttgggaggctgaggcaggagaacagcttgaacttgggaggcggaggttgcggtgagccattgcactccagcctgggccacagagccagactccatctccaaaaaaaaaaaaaaaaaaaaaagacttgcatggagatttgttgcaacatgaattttcaagggacacaaattcaaaccatagcactgaccacttgagtgactttagtctagaaggccacatctcaagaatgccccctctgaagttgtgcccattacatgaggttatataatagcacagagagaagtaatactgcatagcatggttgactgcgtagactttggttccaggcaaacctagtgttgccacttactagggtgagggaccttgggcaagtagtttaacctccgtaaacctccttttgtgtttctgtaaaagagagatgataactacctacctcataggattaaaggagttgaatgctgacgcagcttagcacttggcatctttcctgattgacctccggttatgtgccttggcccattgcctctagttctagaatggcaaaaactgcaattacttttgcaccaacctaatattaattgaaacataataagtttagttaacttgtgaaatatggtaatcctcatagtatttattgaattgggggtctggaagttgttttattttaatcagattgcttcccaactagctggaccttactacagtgaagaaattgggattttgattgggaaaaagggaaagaagattctagaactctatgccgttctgaatgggatcctataggtaagaggatgatgtgggcagttacagggatgcctctaagatgggaaggaggcttctccttcccagaggttgcaaacttgtgatctgtagtgtttttttaaaaattgagtaagttgccaacatttgaagacagattttatataaaaatcttggttttggattctggattctcctgaaagagaaaactagagctgtccacggcgggcctgattcctgaacggcagcagtcagctgacactgaatagcagctcgtccctttggatggagcctgcaagctccagcttgtcagcccctccccgcacaggtgtccacatacaggacacttgcgccagtccacctggcgactgtgcttctctgatacctgcctggctcccataggcatatacctttgggatcctccactttttagtttcttatcccactcggaggggaaggggtgatggtggtttcctgttgctcttgggcggctcctagtgttcctacttaggtgtgctgggacctcagccgctcagactggagaggaaagagagccccagcagcgtgtgggatgagagcagggacacttgccacctatcaccagacctgtgcgggcctggaagacagactgg

SEQ ID NO: 16010 - DNA, 5164 bp, Human
gagtctcctgcctcagcctcctgagtagctggggtattacaggtgcgcgccaccacacctggctaatttttcatttttagtagagacgggatttcaccatgttggtcaggctggtctcgaactcctgacctcgtgatctgcccaccacggcctcccaaagtgctgggattacaggcgtgagccactgcgcccggccccctgtatccttttttttttttttttttttgagacgagtctcactctgtcgccaggcttgagtgcagtggtgcgatctcggctcactgcaacctccgcctcccaggttcaagcaattctcctgtctcagcctcccgagtagctgggattacaggcgaacgctaccatgcccggctaatttttgtatttttagtagagatggggtttcaccatattggtcaggctggtctcgaactcctgacctcaggcaatccacccgcctcggccttccaaattgttgggattacaggcgtgagccaccgcgcagcccttcattttttaaaataagaaataaatgaaaaaagatgatcaagacaaactcttcatacagtgcccgctgtacaaagtaagaaattaataatggtcacgtttgtgattattatttaaacaccaagcagatattaaatattagggctcagagagggcatgcgacccgcctgaattcactcagctgcagagctggaaagagaactcaggcctttttccccacgctggaaggggtagctggggcggagaggtggggggagcggtgaagaaaccccaagcggcccaagctgtgggtctgggttgggagactcgcaggtgtggggcggggaggtaaggtgacccttgctcagcgaccgcgcccgcaagaaacgcattcccaggcctcccgcccggggtctgcaggtgacgggctggggggagcacgggaactagctagaccagtttgtcgtctccatggcgaccgcccgcgcggcgccagcctgacagtccgtccgggttttatgaatgggtgacgtcacaggcctggcgtctaacggtctgagccgctggttcagacgctgacacagaccggcccgggaagggaggggggagactgtagctccgcagctgccgcgccgtgggagggagaccctgctctgaggtctttgagaagaaaatttaaaaagcagccaaaaatgggaaaaaacattaaaaaatcacgaactgttgcaggttcaggaaatttttgcaaggagctgcaaattcaaggtggaatcgaatgcagcctcactccactgcgctctatctagttcacttcccagccacccagccccaaacttactagactttcccgaattaattgctcccacccgggagggatctgggtaggccctccgggtctcaggaacacgaacagcaacattatttaggaattgagaaagcccaggggagcagatgtaaaggagcgcccgctttaaatttcggtcctgatatttgtagatcagggtccgagaagcatcttccaagagggtccggaaacccaggctctctgggctatccagagccagccgcttctccgttcgggcctcaatttctctcatctgtgaaatggagctggagaagtgagaaagtgaatatgggaaaaactgattcctgaggtcttttcattataaggcaatgcctgcttagcttccttgcctccttccagaggagcccagtgcggccctcgcctctacccgctgccctgcccggtgccctgccaccgacccacccttgctgttctgaaacccgggtcgtctttccacactgcgagcaggcactagacgagcaggaggctggacctaggagcgcgggtcacgcccccatgccgcccattggctgcttttgaacgttctgagcccgcccctccgggggccgtggcgtgtttataaaagacaagctgtggctccgcactctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctgggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaaagttgtagtgacttcttgggttgaggggaggggcctgggctgggggttgacccctgaccctcttcacagctggttctgggaggagaattggagggctacatctggattgttgctcttaccggcctgaatgagtgtttccggtgtctttaaagtctattcttcccccaccatccctgcccatttccctgctccccagtgttataaaactaaatactccagacctctggggtttctcacagtgatcattgggccatctagatcacctggggaggttgttaaaatgcagatgaacctgccagggccccctctgtattgggagtattgagcaagccatttaagttggagaacctggccgctggaccacccacttccttgccaagatgtggataaagtgagacccagtggaaagggacttgcttagggccatagcttgtgagaggcagtgattctatcaccccattccccagttggaggtgcctcccccaacagcctacctctgggttccagcaggcagccctggggctcctggctcatccaagtgggtgagcaagttggcagggccaggctgggcacagctgccgagacacctgctctgggtccagactcggcctcctcactctggcctggctctgtcggcagttcaaacaaatctcccccaccaaccccggggctcctgcgtaggatctgaggagtggacgagtctcattacccagctcctgagcaggaaaaatatgtcattggcaagggtctaagaatcttcctggacatgtatgtggatttctactcaggggagcatgtatgagtgtctacgcctgtgtatgtaacaggagtaagctgatcttcccccactactcccacagtggggatgggccaactgttcacatataggcttgggggagggggtgtaagtaggagtatgcttgggggtgtgtgcagaagggcaaatgagagcacatgtgttctgcagataagtgtggaacctccagctgtttgggcttgtgtgttctgcctaaatgcattgtaggcatctctgcatgggtctggcatgatggatgggtttgtgtgtctgggggccacagaaccacactgtgggtttctgtgtgtataactgttctatagattggttggcattcctgggcctctgcgggtctggagtgaaggtggggacagctgtgtttgggcaaacccttcctcaaaagttcacgtggcaactccctgggctatcgttaggtcctgggggcaccaaccctcaaggattgctgccaggtaaacccccctgtattacatatggagaaactgagtcccaggaatgacaaagaacttgtcccagacaggtaagggctattaatatattttgtcaataaacaatagaataaaatcaatagcccttagcaccagaagcctggctctgctcaactgaaccctttacaaaaacgatttcatggatccctgtggggctaaaggcaagactgtgatcccagttttacagcagaaggaacaagctcagagaggggatgaacaaaaaatcaaatgaaagattatgatttgagcactaacattaagccaggtacaccccctccacagtttatggattttatcgaagaacccagtacttgcaggcgaattatgttctttgctacctcctccccaccggctgctgtattacagtactaacctcacggaatgtagtacagaataaatgaaataaagtaagtgtgtaaaacgtttagcacagtgcttggcacagaatgtttcatagttataaattattattgtcgcctgtgagtccttggagtgtcctcggaggcacacgtgtgcacgcacgcactctcacgtgtgggcccccgcctgcaagcccacccacggggtctgagcgggttccccctcgcgtactccgacatgcagggcctttttccaggggaggaaggggctgcggcgggggcctgggccacctcccccgccattcaggcacactctggattccacgtttccctctgttcc

SEQ ID NO: 16011 - DNA, 40091 bp, Human
gcagggctaacgcctgtggaaacacagcctttgttctgcagaactgactgtccccatgcctcccgtctctccttgaggtcccgaaatagccaggtgctgggatacttgatatttccatgccaaatctcagggccccagttattgcatgctcaccacgtataaggcacccaaacttggtcatttagattgagtcttactcaggcctgtgagggagggattctttcccccattttgcagaggaggaaactgaggcaaaatcctgcccatggccacacagctggtcaggggcagagtgggaacttgaaccccggcctcttgaccgacttccctctcggtcgggtgattctcctcacgctgctctttcctccaagctttcaccagctgcagggagcagtttctgcaacaatctctataaaatggggcaattacgggtcagctgggcccaacactctttgtgggtttgttcactgagactccagccagagcccgtttgacccagggagaaatatccactgaagcaacacgggttgttttccctgagccatatgtcacctaggaatggagacgggggctacttctatcttccaaattcatcaatagatgtagagcttgttccggaatgtacagcttgttctggaatgtagagcttgctccggaatgtagagcttgttttggaaaaagtgccagggaagccccgtgggcctctgtctctccgggaacccttcccgctcagggctcacagtggatccggaagcacaggagaccaagagaccagagataccaggatgagagataggacccctggttgccaggttcgagaagtcctaggctgagtccctggaaagttagtcttgctcctttctggcacacagtggggcctcaagaaagctcagtggatggatggattgagggagggagggaagagaaggccgagggagggatggatgaagggatgagtggatggataggtgggggggtaggtgatgcatgggtgagtggatggatgggtagatggatggctgattagatggatggctgattagacagatacaaggatgggtgagatcggaggattatctgggttttgctacaggaagggacatgggtgtgtctgtttttgcaggtgtgtctgcatgtctgtacctgagtccatgcctgcatgtgtgtctacctctgagtagccacatctttgtgtgtctgtgggtgccctctctgattttgcgtccacatctgacagtggcattggtgtctaggaggtctgtgtgtgtgccaggtgcctctggacacctgctcatctgtgtccacagctgtgtgtggctcgcggtcaaggctacctggctgtgtcaggctgtatctatgtcctggtgtgtgtctgccattcgaatctgaatttgtatccatgtcactgtgtctgcgtggccagccgtgtttggtgtatctgtgggagtgtatctgtgtttgtgtgtgtatctccacagccctgtcttggtgtgtctgcgtctgctctctgtgtatgtatatctgagtatgtgtgtgagtgtgtgcgtgtgtgtgtgtgtgtgtgtgtgtgtgtgtgtgtgttgggggtggggaggtgttcttgatcccagatctgacctaagagtccacatctgtgtgtccaggtgcaccccggttccgttgtgtgtttctgtgagggtgctgcgtgtatctgtatctgagtgtgtgtgtccaggtgtctgttctccaaggtctgagtctgtgggtccaggtgtgtctgtttcctgggctagttgtgtgtccctgtccgctcccccagggggcgccctcgtccggccgccgtccctccctcgggctccggtcccctgggtgagccccagcgctggcggcgtgggcccgggactgggcaatgggtggcctcccaggtcgccgccttcccgcggggccccgcccccggcccgccccaaagcgggctataagttagcgccgctctccgcctcggcagtgccagccgccagtggtcgcacttggagggtctcgccgccagtggaaggagccaccgcccccgcccgaccatggccgagggtgagtatcagagtcaccgcagccgccactcaggggccccggggcattgggggtcaggacccggtgggagctgaatccctaagtcctgacttggagagcaacaggcagaccgggctgggtgaggaggcgtctcaatgctgcttggagcctcagtttccccatccacactgcataaccattaacccttgcctccctggatcaggtgaggcaatggaacgcgacggggtgttgtaaactgtaaagtactgtcctggcggaccactggcacgtgtcctcagtcagtcagtgggggctggctctctgatgtgtgcctggagctgtgcagggggtgctggcctggcctcagaacacttaggtttgggtggttcttgccagccaggaccaggtggtgtgcatgccacgccggtggtgtgcaagccaagcctggctgagtccttggctccagcggccagagaggagctttcggcatcctatccaggagccttcggaaatcaggcttgttcttcccgccctcacgttctgcaaccctagaccttggccaattgttgagtctcacctataaaataaggacaacagtgtccttattttataggacaaggtttatgagatttgttttcccccaagacccccacccatctgtcaccctgaccgtgccctggtcctctgctccagcctttggtgcatctgtgaggaacgagaggagtggaacagaggcttaactaatttcatactggtgcccctgactccctccccacacacaagcagcactctcgtaggtcccagctggagggatttctacaatggaggatgtcactgctggacccagaatcccagctggctcttgggtcaagttcatctggggatggcttctgcacccattgcaacccccaggaaggggtgtgggacagggacatggggcaggtggagcaggaatgggtggcaggaactgtggacccacctgaccctgctgtgtgatctcagccacctgcctccctcgggcccagctcccaacacactgtgatgtgtcgcctcggtggccgcttgtcctcaatgcatcttctcacccccatgctcaaaagcagggctcagtggggctgggagatcctggagatgccagttatgatgagcctccagccccatgtcacagtggccacttctgacagaggtctcactggcctagaaggcctaggccctttctaagtgcagaaatcctataaatcctacaattctagacctgcatctttggagctgggcgtgatttctggaaacccttcttcggacaacagatggagaaaatgccccagctcccacagcccagggactggccgtatctccagggtcttccatgggaacaacaatggcctctttcctgctcaagctccctgggtctgaagtttccaaaaacatttcctcgccgcaataggccagcaggaagtttttccttctggccactgaggtctcttctgttgtgattacacggggaccgacatccctgatacttcagtggcgcagaactatctgcccccaggtttgagaacaacacaggacatggtggcgaaggggtggtcataagaggggctggagaaaaaactgagctgtagtgaggtggttcccagggcagaatcctacagaatcctacagctctggattccaatcccaaagcagccacttgctctgggacctggagccacctggtgtctttgtctacaaaatgggaatcatgatagcatctatgtaagcggagttgttttgggatttaagtcgagataattcacatacaaggcactttgcatctcatttttggaatagtcgatggtgagcaggagacctgggctctcccactgcaaggaccaacttgcggcgtgactttgaacaaattcctgcccctgggcctcacttggaccacatgctgtccagtggctccacactcagaagtctgtcttgcccactcctcccaccttaagggcttcccaatcctgaccttgagcttgccaaggtttatgagatttgttttcccccaagacccccacccatctgtcaccctgaccatgccctggtcctctgctccatctgaaactgtaaatggaactttcacatatcaagcttctgtcctgggctgggccgtggggaagggggttcccaacacatcttctagactcacagcagccccttgagacttcagaggaggagtcacagagagggagagacacttatccaggctcacacagcaacacagcagaactaaaacctacctctggaagtctccaaagcacctattgtgttaaaaatgttttgttttggagaatattgaacatacacaaaaatagacagaattgtttaataaattcctatgtcctcatcacccagcactgaccaccgtggtgtctactgcccctgcgcaccttcatctcagacatcacatcatgtcatctgtcaatgtttcagtatatgcctttaaaggataaggactctcttttttttaacacaaacaaattaacaaaaattctttgatatcaccattatgccatcagtatttaaatttccagttgtctcatacatgtaataaatgttttaaaatacttttttgaaatcaagatccaaatagatcaatacatcacaacgggtttaagtttctctttataggttctctcttcaatgtttttttcattttctttcttgcaatctatttattaaagaaaccggaccctttgtcaataatttcccagtatatgaagtttgtcaactgcatcctggttctgtgtttaacttgttcctcagccctgggtatttcctgtaaattgaacattggatctaaaggcaaaggccatgtaattgacctgtaccaaatactgcccctgcttaaaccaaaagaaccctctgatagcaatagaatagctcgtgtttattgagtatttattacacaacagacattgtactaagtgttttacatgcattaattcatttcttgctcacaccagccctgggaggtagatactgctggtcccatggctgctggaggtcacacagctaggaagtgccacagggggtcacgaccttgtgattaaaagatttaggcaaagctgggcactgtggctcgcacctgcactttggtaggtcaaggcaggagccatcacttggcccaggagttcgagagcagcctgggcaacatggcaaaaccaaaaatgaagaaattagctgggcacatacctatagtcccagctcactgataaatgaaaaaattagtggtgcacgcctgtcctctcagctactcaggaggctggggtgggacgatcccttgagcccaggaattcaaggctacagtgagctatgatcacaccactgcactccagcctgggcaacaaagcaagaccttttctcaattaaattaaaaagaaaaaaaagagttagggagattgggccccacctagcccccgtgtgaccagggctggggagacaggtcagtcgaaacaatggctgtgctttgtggggagtaagagggcacaaggcccccatgtctagggagggcaggtgcatcactggaggtctgaaggatgcccccgaggctcatgcgtctccttctgtttccatagagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggtgagtacctgcaaccccactccaccaccaccaccaccaccaccacttcctctccaccccgacatgccccagaaccctgacagagaacaggacaaataactttaccttctttgttccctgggagattgccacctgtcatcagccccattttagagatgagggaactgaggcccggaaaggaaggagatgtcatggcagaccaccagctttgtgagcaagtctgtgcctctggaaccctgagcttctgaaagcctattatcaccagggttgcaggtcagccttcaaccaggaaagttgatcaggatcccatccacaggctgggcgtggtggctcacacctgtaatcccagcactttgggaggctgaggagggcggatcacctgaggttgggagttcaagaccagcctgaccaacgtggagaaaccctgtctgtagtaaaaaaattcctatccacaagccaggcatggtggtacatgtctgtaatcccagctatttgggaggctgaggtgagaggatcatttgagcctaggactttgaatccagcctggacaacatagcaagacaccaccttaaaagaaaaaagaaaaagatcctgtctgccctttcccatatcaaaacaactttctaatctctctgctgcctgaaatccacgcaacccagccaggcactgggatcaggcccaaatcaggcctgggtggcagagaaaaagcccagctagcttcagccttccatgtgggcagttctgggtcccagcagttcattctccaagcattaggaggctgcctcaatctccggggctggacagaaagactaggattctagcgcaggctgggctgcctacctgctgtgtgaccttaggcaaattacttaacctctctgagcctctgaggtttcatcatctgaaagccctcacattggaaggttgttaagtgtctgctatgggggagggcctgcagatatttgcagctgttacttatctttgtactggggccccagggataggtaaagggacaccaagtccccaggcgtctcatccccagatgcgtgatgcgcaattttctttgttggccattcctgggaaaatggcctcaaatgccaaatcagtgggtctggtttctggtggcagccattcccttgaggtcagtgaggggccacctggctaggactcgggttgggaaaggccagctctttctgaagtctctgagggcagagatggcagcaagcattccttggctgaggcctgcattgaactagaaggctgttgataaggcttatcatggggactgcagcctagcctcggatagctcctccatccttctcctccctgcccctgccctcctggtggagacacacccactgcccaggggctcccccacaagcacactggcccccaaagttctcttgctaacagagccaaggagcccccagcaagtctctgaccctccagtctcagtttccccctttacgaagtgaaaagttagggtacatggcagttaagggctgggtctggtggcctgagaagagtcagacttgtgatagtgaaaatcacaacatctgtggggcacccactgaacgcatgcttgtcttgaatcctcgcagcttagaagttataaaggactccattttgcagatgggaaagctgaggctcagaaaggtcaagtcactggctcaggaaggtcagtcacacagtgagtcagggacacagaaggcttcaaaccccgactgcagagtgaggcttttcatccctatgtccctgcagcaggcgcatttatcacaagtgcctgccagggctcagtgtgttcctctgtgaaatggaatggtagatgagctgctggcttgggcagcctgtgatttctactttcttttttatttatttttctttctttctttctttcttttttaaaacttttattttaggttcatgggtacacgtgcaggtttgttatataggtaaactcgtgtcacgggggtttgtggtaccgattattttgtcacccaggtgctaagtctagtacccaagcgttattttttctgctcctctccctcctctcaccctccaccctcaaggaggccccagtgtgtgttgtttccctctatgcgtccatatgttctcgtcatttctctcccacttataagtgagaacatgggggatttgcttttctgctcctgcgttcgttcgctgaggataaggctgccttctttcctcttctttcactccagatgtcccctttcttatttctccttctccaattgtctgggcagcgtagtgttaggtaattagggccctgagtttggggttgggtgaagggctgctgctgaccttcccacctcagcaagctaatctctgtcctccagtctccaccaacttatctcaaaccataaccaacctgccccggtcacttccgcagcccctgtaggcagccacggaagagcccagatctctgagtacagagtgcacacagcttccctgtccaagcaaccaagaaattcccggggcccggagaagcctgagggacaataccaggaaaccaggccctcccccaactccaggcctggcctgggtcagcgcccggctcaaggcctggccagctgactctgctcctgtgtgggaacattgtagcttgtgatgggaaactgaggcccagagaagcaggagagctggctaaggtcactcagcgaatggagcatgtggcctgaccccacacattcttagatgttgtgtgttttcacccagacagtttgagacccgacagactccgttatggggtccaggccacactagacaaatgccatccttgtcagagggataaagttccctccaaggtggggtcggggtttgagggggtgtggcagtcacaatgggagtgaagtcagcctggaggagtgaagggaacccttatgaggctgatagaaggctttactctggaaggtcctgcccacccaccccatcccagcccggccaccatggtctgggatagtggccaggacccccaggctccctgtggtcatttgggcccagagtggccctcatggtgcctctggtctcacaaagaggatggtgtagaaccgcagccaaggaatttgtgaagtcagcttacgtgagcagcgggtggaccgtgggacagcctgtccttctcctgttcccccaggatctgggaagaaaggggtgtgtgagtgtgtgtgcatggctgccccaagatagagagaaagggaaatgcgtttcctgacttgtccccaagggtgacatgtcaacagcgacagtgatgatgggatctggcccaggcctgttgccacagagaccagatcattgatcctccgagcagggacatttctgagattggaaagagcacccttaagaattatgatgggaccacaggcgtaaactgaggctgtcctgagcaaactgtgatgcttggtcaccccagcaccacccctctcaacctcagtttccaaatctgtgaagttcttcaatcgaactagacaatttctacattccactccagtcctcacgatctgctatttggcctgagaattcagacttttaatggccccttttaataacactgacgatagctcacatttcctgcatgattactgtgagctggtcactgttcaaaatgctttctatgaactctctcacggaaccctctaaacagagccaggaggcgttcatgaaaactgaacaagactaactattgtttcctgagcacttactatacaccaggtgccttgtgggatgctttgtatgcctgtcctctttaagcttcacaacaaccttatagggaggtactgctactggcctcattttacagatgagaaaactgtggcatagagaagctaagtaacttgtcgaagttcagagagccagtttcgaacctgagattggactctcccaggcatgtggcctaagcctgttttcttcttggataagaaagcagatcagagaggcctggtgatgtggcccaggtcacacagtgctcaggggcagagtcagggagccagacgtagggtgggtctgggaccccaggcctgcatggctcctccccaaatgccagctctggaagtcagggagcattcaaaggcttccagtcggcccctggcacttggacagggcctgagaggcctgtgtcatgcctgttagttcatggttacatttgagctgggtgtgggtggggctggctggcagggaggagggggctgggggctgggagggagcccctgggtgagcaggccccaataatgtccacggtgggtgggcagagctgcaaggagggagatggaagaataaaaataaactttcctgggcacccgcccagccaggcagagaacgtcctctgtcttctctccaccacccatgtccagaaagtgaccagcccctcctcgccctgcccatgactcagacctgcctgtgggggcgggccctcccctccacctggaaaagcagctgctttgagagtgtgcccatcactgtgcctttgagaacccggctggggagtgtcctctttgggaagaagaggcaccgtagaagacaactgagagctaaagacccacttcagatgcgacctttgccacaaactcctaggatatccttgggagaccgctttgctctgagcctcagttttctcacctgggcaaggggtctcaaaggaagcaggtgcttcatgaagtgtaaaaggctgtaggaaggtgaggggtcgttatgaccagcatctcggaactgcctatggagatgtgggggacagcagatggggggcctggggagacagacaccttgaggctgtgtgggccagccagcatcctccgctggcctacagcaaggggctctcagaggaccgaggtcccttcctgctcagcgtctgggcttccttctctgagagaaaaagcgggacgctagcaggtagaggatgtaggcaggaaaggagggccctagggcatgttgcctaatccttgtctatgctacacaaatggggccaggtgatcccagagagagggatgggcttgtcccgagtcacatcattgcagagcagtggaactgagccttggctctgggccgcatggcccctctctcaggaggactctttagttgaggacatgctgtatgcctgtggctttttatgcattcccacaaaaccaccctaaaaggctggggttctgagcccccctttacagatgaggaaactgaggctcagggagacaaacttcttgccaaacttatttcagtggttagtggcagaactaggcctggagcccaagctgggggaccccacgtaggtgccctgccctgccagccctgctacccctagctcacggctactgcttctccctccacaggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccaggtgagccacacgccatccactcacagcgttggggtgggcagggctggatccgcccatggaggaggctactggaggtgagaagaacaggggataagagacacacatcaaagtggactgagtgaggcccactgtgctccagcctcacaaaaccctcaagacatgagtactcctgttatccctgtttatagaaacaaaatgaggccgggctcagtgatccatgcctgtaatctcggttctttgggaggctgaggagggagaatcacttgagcgagccaggagttaaagaccagcctgggcaacagagcaagaccctgtctctacaaaaaaaaattttaacagtagctgggtgtggtagtgcacgcctgtggtcccagctaattgggaggttgaggtgggaggatcacttgtgtccaggaagtcgaggctgcagtgagctatgattataccactgcactccaggctggttatcagggtgagaccctgtctctaaaaaaataaaaataaaaagaagcagaatgatatgcccaattccacatatttaccaagggacttcactcgctgtttgaggcctgtatattcccagaccactatgaactggggcttagcggtgacttggtttcaaaagccccacatcaggaatagggtgcccagctgatgcctaggcccaggcactgtgtcctggttctgtttcatggggccctgttttttgtgtgttttttgttttgttttgttttgtttttgagacggagttttgctcttgttgcctgggctggagtgcaatggtacaatctcagctcactgcaacctctgcccaccaggttcaagcaatcctcctgcctcagcctccccagtagctgggattacaggcatgtgccaccacgcctggctaatttttgtatttttagtagaaacggagtttcaccacattggccaggctggtcccgagctaccgtcctcaggtgatccacccgcctcggcctgccaaagtgctgggattacaggcgtgagccaccgtgcccggctgaggtgggaggccctgttttaaatctcacccagactggtttggggaagggaaacccggaggtgaggttggggggagggctgggggaggggggtgagtaggagcagttagaccgtccagctgcctccttatacactatctcagtcgggcctctcaacaatcccaagggggagatgacacttccccacttcacacacaggaaactgaggctcagagtggtgaagtggcctttggaatctctttgaataaataagtggacaaccttggacaaaactagaaagtcagaggggagagcttggaacaaaggaaactgacttgagcaagggggaggaggcaggggttgccagtcacctccccaggcctcgattttcccatctaactagcaaggcagtcagatctaatgatctgtttccttcctattctaatgaaacaaagcagggaaagaagcatcatgggccaggcccctcctgggaatcgggtgtccctcttcaaaagggcagaaattctggcctcctggctgttagacaaccaccttcttgctggcccactgctttatcttttttcttctctattttgaggcattttatatttgagcagaaagcttttaaaatttttcacctttccatattttgatttttatttcccagtataacagtaaaccatgacagcattctctttagaaaagcttcaagcccaggtgcagtgtaatcccacacctgtaatcccacacctgtaatcccggcactttgagaggctgaggcagggggatcacttgaggcaggagttcaagaccagcctggccaacatggcgaaacccaccgtctctataaaaaatacaaaaattagaccgatgtgatgacacacatctgtagtcccaactactcaggaggttaaggtgggaggatcgcttgagtccaggaggttgaggctgcagttagctgggattgtgccactgcactccagcctgggtgacagagcaagactctgtctccaaaaaaggggagagaaggggagggcttcaagactacagagaaatggcctccccctttgacccctcctccttgggggacaccattgttagatattttgcgggggctcacctccttaggtcagtctgtatgtgcctggagaaattgctgtattttataggtctctgtctctctatcacaaacataaaaggatcccactgtatacattaacctacaacttggttttttcccctcacaatacaccgtgaggctctgtccacattggtctgcatacatctgctcattcattctttttttttttttctttttttttttttgagaccaaggctctctctgtcacccaggctggagtgcagtggtgcaatctcgcctcactccaacctctgcctcccgggttgaaatgattctcatgcctcagcctcccgagtacctgggattacaggcatgcaccaccacgccgggctaatttttgtatttttagtagagacagagtttcaccatgttggccaggctggtctcaaactcctgatctcaggtgatccgcccacctcggcctcccaaagtgctaggattacaggcgtgagccaccacgcccggccacatctgctcattctttctaagggcgttgagtgtcctgtttcttgcccatgtggatggtccagcccccactgatggacatgaggttgtgcctggaggctcatggcacgcagggaccatgcgtcaacgagcacccttgcttcataccctgtggccaatggaatgatttctcgggacagaagtggccttactggatccccccccccgccccataggtttgttttgaattttagtcaatctgcagagggtagcaactagttggcagctctgccaacaggacaggaacacgccggtgtccccaccctcgtccacaccacaaggtttcagagttcagggaatgggaagcgtggttctgggggatggcccccttcctcctgcttggcctcacccggcggcgggttggagtggcggtcagccaagcggcacagtgactaaagtgacccacatcccggggcgggaactgtggagctggtgatgcagaggcaggaagttgggctggggtgagcgcaggggcgctgcgggaggaaatcagtctgatgggtgggaaagggccgggtctgcctggaaaatgggaccctcctgtatgtcagttccaagaccaatatgatcgagtgccagttatatgcaaggcttcacgtccccagtgcccccacctttaccagatggggacctgagctggggatgtcacagtcttggcatcctgagctggggtggggacaattcaacaagtgctgacactcattctaatgttgaaacactgtgggttcttctttctctttcattcttatcccacaccccccggctgctgcagagccattatagttcattgacttcaaggttaatttttatagaagtttccagagccaaagatcagaatacacaagagacttggcctctttcccatttttcctcactacgatgaaagtcagggctgctggttgctgcagacgggcatgacaaagcccaggggtctgaggggccggcagctgcttccttcccaggccagcttctccattagacccggcaggcactgtgcctggggcctgagaaactcttaggggcccgtgaacatgttttaatgtaatttaaaatcaggagaaaaaaatgaacatttaagttgaacaataggttttaatatgtaatattgagatagctgtaattaaccaaggcagtcataacattcaattaccttttttctaatggaggaaggaatgcatgaagtcaagagtgcctggggctcaccaaagtcataatggggctccagattgccccttcttggcctcagtttcttcaccggttaagtggagtcagtaaagccagcctgacctttgggctcctaccatcttgccccaacttcctcagctccttcttctcccctcactggccacagacaactaaatgccctgcattttccagcagccaaagctttgtgctttctggtcctctgcttagaatgctaccctccaggttccaactctctaaaacttaatcattttttaagacaacattcagatgccacctcctccagggagccctctgtaactctctcaagctggacaggaccccacctctcctgagctgcaggaaccctttcttggccttcccctctgctactgagttctctctgccttgaatcatgcgcctccctcacgctacctcagggctttcgtttccaaagcacctttcagatctgcattttgggctgacacagtgaggtgttaaggtgggcagagaaggcaaagtagcctacccagggtcacacagcaagtgagaatcaggagtttcctgactcccggtccagtgctcctgtgtccttagtctcagttttcctagctataaaatattcctgagccttagttttctggtctttaaaatggggctttcaaggatcccttcctcataaggctcttctggagattaaatttattaatacaggtcatacatttatcacaggtcctggcacacagtgagtgttgaagaaatggcagcctttgttgtcactaaccgataacaccttatctcattgacgtgggattattcattaatggttactttttctaattaaaagaaggatggatccctgagacgctggcttggcctagggaattggcacccttgactccagatttgcagggaccctgggcctccgcagacccagagctgaggtccctttcttcctgcctgcagcggatgctgtgtacctggactcggaagaggagcggcaggagtatgtcctcacccagcagggctttatctaccagggctcggccaagttcatcaagaacataccttggaattttgggcaggtaagggccacaccctgtctctcccaaccatctcaggcccttctgtgtgcccggccctgtgtctgggggcagccaaagctgcacaggtgggagtgagtcacagagtcacccacttcatgctgtcagggatgcaaaggccctgaaacagctgaaggttcagagagggccaaggctgccctgaggtcacacagcaaaggcggcagccttggattcaaggtggagaaagaactaggagagcctttgggaactgtgaagctggttggtatcctgggagggggaagagggaacagtaaagctcatgtattgaaacaataggcagtacttggagttgtgctggggtgagccctgtgtgctaggcatgtgctaagaagaggctttaaaccctcacccagatcagtggttctcaggatcactgagagtcttaaaacactaggggttgagaatttgctcttcaaacaagttcccaggtgatgctgatgctgcttgtctaataaccatactttgggaactgctgatctggttgtatctgctagctgctgctgcataacaagcctgaaatttaggggctaaaaacaacaatcacttattatttctcacaagtctgtgggtcagccatgcatggctgtctaggctgggcttggctggagtcagtaaagccagcctgacctttaggctcctaccatctggctcagccaatggctcatctgtttcacgtggtttctcactccccagtgggccagcctgggctggttctctaaactggtgatgataaatttcatttatcatccagccacctgtacaaattcttgagactctgctgggaaaactcacaaagcaagaaccattgcacccctggcccctcaacctcctggtgtgttaggaggtattggcctcctggggtggggttcaccctgaggcttcccccagcagcctctgggtcaggtttcaatgttcaatgaccctctagggagggtcctaccctgaaaccatagggaaatcttccctgtatgatctcaggctttgaccaaagttttctcatctgaatatcatgatgataattgcaaaactaactgctcagcaaccccgtagcctgctgtgggatataaatgaaatggtggtatgaccgtgatgcataaaatacatcagaaaatgaattggctctgatttttcatggctttttattctctcctgagaaggagaacaaagtcaagttcttcctttatttcccagggtcctgtttttttttttttttttttttttgaggcggagtctcgctctgttgcccaggctggagtgcagtggtgcaatctcggctcactacaagatctgcctcctgggttcacgccattctcctgcttcagcctcccgagtagctgggactacagacgcccaccaccacacccggctaattttttgtatttttttagtagagacggggtttcaccgtgttaaccaggatggtctcgatctcctgacctcgtgatccgcctgcctcagcctcccaaagtgctgggattacaggcgtgagccaccgcgcccggcccacagggtcttgttttgtatccggtcttgtgctgggctgtgggacatggcctttgcaaagcttctggaggtgatcacagtccaggaagatgagacctagaggaaggaaggaataacagcctatggggatcagggggtacttcttgaagtagggaatatttgagctgggctttgaagaacaaataggagtttgccatgcaaggaggtgtgtgcacgacatactaggccaagggaactatgcaagtgaaagctcagaggttggaaagtttatgtcgtgcctgagaggtatattgtagcttggggcataccttgtgtgtgaaggagccccaagagatgaggtgggagaagccagcagtgtccagtttgtggaacagccctgaacattaggccgatggcaatagggagccacagagggttcacaccgtggaaggctgttgtgcagcttggagggagatctggcccaggaaaggaccacagaagtggggggaaaagagcagacagaagggcccctggaggtgggtggtccagtggaaggtggcaagaaggggtcctgcttttgagaaagatgacgtttgaatggcaaggatgaggaggtgtgagccctgcagagagcagcgggaagagcattctgagcagagaaatagcacatgcaagggccctggggcagtgagcctgggcagagtgagtgtgggtgtgagtggtgagagatgaggtcaaaaaggggatgggagcagatcatgaagggccttgaagtttgcacggtgaagtctaggttttactgtggatacggttgaaacagaagagtgatgggactggatttctgtatttagaatctgtctcagttcccatcagagcagcgtgtgtgggctgggttggagggggacgagggggctgacatcagctctgcagggtgggtcacgccttggggaagtgggagatttggctgagcaagaggagaaagggacagtgacagggcccaaggtgactctgagggggagccccagggacaccgggctgcccactccatgggctcctgctccagatttccaggttcccccaaccaggccctggatgaaaattgttaccctcttcgtcacacactcatggctcacccagtcattgtcccactccattccctcctgtgccaagagaagctgccaccagagagatttggtagactcggccggagtgtcccagtctgctgtgtgggacagagtgggaaacagctgctggaggcttcaacgcaggcttcctggaggaggtgccttcccagctccctctttctcctcttgtttcctctgacacagtttgaagatgggatcctagacatctgcctgatccttctagatgtcaaccccaagttcctgaagaacgccggccgtgactgctcccgccgcagcagccccgtctacgtgggccgggtggtgagtggcatggtgagtgagtggcatggcccatccaggggcggggcctacagggggctcccgcaggcctctccctcgcagtggagacacaggctaggcgcggtgggggacccgggagatgggtaagtcttggggaaaagaccttatattggaaagataagatttgcacagatgagggtgatgctatggggtcccccagagcaattaatttattcatttcttcagtaaatatttatcaagtaccacttatgtcctaagcactggggagacagctgtgtgcaagtcctgtgtgatctctagctttatggagactgtgttatagaggggaggggaggggaggggagacagacactaaccaaactaccatatgaacgagcaggcagttcacatggttcataaatgatggtgcacgctctgaaggaacccgaggtgtgagagcgttggactgcagggccaggctcagggaggggctgaggggctccctaaggtggtacccaggagaagggcattccaggcagagggcacagctgtgcaaaggccctgagaagggagcgactttggcaggtttgaggaaggaagagaggccagtgtgcctggagtggagtgagcagggcccgtgggtgcagaggaagctgcagaggtgggcaggggtgagaccagaagggcctcttggatcatggtcaggaggctgattttattctcgaggtaatgggagtttagggggaacgacacaatctggggtggggggcccaagcgggtctttgtaaaacttagatcacaccatgtcactcccgagcaatcctgtgttcataggacagagtcacatccccagtatcgcgttcaagtccttgaccctgccccacctccttcttccccatctccctcctgtcccccggctccagcccccaccatctgccgcacaccagtctgtcacacgatggcccctttgcacctgctctttcctcaccctggagctcccctccccagctttcaccccctgctgtactcaggctcacccaggcggcacagccgacaccccatcccaggctcagtccccgtgctgccccactggttgcaggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacaggtgagctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtggttgttaggatcaagggctatcattggagagactgcatgggctcagggctgagaacttgggcactggagcccacgttctcaaaaactcaggatttttaacttgagttaaaaaccccctccctcccaccacttgctctgtgaccttgagcaaatgacttctttctgaacctcagtttcctcgtctggaaaatggggacaacatcaagaccttcctcctagagtgggtgtgacatgaagctactcagcacagaacctagcccagtgtcactctcggcaaatattagccagtaataactggatcctaacagtaatatcagtgtcaagaaagaaagcatgttctaaaatgtagagggggaatatcgagcaatttaaaaccaaaaaagtaaaataaatctaaaacaaaaatcttcaaaatttaaggccagaaaatgtcgatgattgttgccaggctgatgatggtgcttatgagaatgggttagcatcacatgctggctaagaacgtagactcaagacatgaggattgcttgaggccgggagtttgagaccagcctgggcaatatagtgagaccttgtctctacaaaaaaataaaataaaataaaaattagcaggcatggttgtgtgtctggagtcttggctactcagaaggctgaggcaggaagatcgcttgacccctggaggttggctgcaatgagctatgattgcaccattgcactccagcctgggcaacggagcaagatcctctctcaaaaaaaaaaaaaaaaaaaaaaaaagagagagagcacaaattctgaagtcaaggcctgggttcaaatcctagctctgcttcttaccagctgtgtgtccttaggtaaatcacttaactcctctgaaccacagttccattgtatgtaaaatgggcacaacggtagtacctttatactgggatggttgtgaggattaaatgagttaatatgtgtgaggtagctgagcgtggtggtggtgcacctgtagtcttagctgtttgggaggctgaggcagggggatcacttgagcccaggaggtcgaggctgcggtgagtcatgattgcaccactgtactccagcctgggtgacagagcgagacctcatctctaaataaataaatgaatgtgggaagtgcttaaaatgattttgggtgcataatagaaaatacttatgtgatgatactatttattgtcacgactattattattaccaggctcaatctaaaaggctggtctggggcttccagcttttctgattccaaaaccagtgctaaggcccaggaaagggtgcctggcagggcccccagcacatcctccacaccagcaggctgggtcagggcagcctaacctaggttctcagctcggctgtccttgccttctgactcctgcctctctgcctgggactgcctgttccccgtgacctctgaattcctttttcttgtggaaactccttcatgccagacacttccctctgagagccctaaaacacctcttttcaaagaagcccatgggttttcctggaaaaaccccgaaatccaagacctggatccccaggctcaccggcagaaaccctggtcatcctggtcaccctgggctgtggccgcctgaagattgagcagcagatcctgcccctcagctgcccactgcagggctgtgttctggtccccgcagcctcttcccaggctgtgtaggatggagccagggaaaacttggccaagaaaagggctgtctgaccactgtggccgtggagttcacgtggggagccaatggtgaattggcccatgaactctggagctggactgcctgggtttgaatccagctctgccactaacccctgggtggacttgggcaagagaattgatgcctccaagcctcaatttcctcatctataaaatggagacaatggtgactgatctcattcataggaagctcttaataccagggagagatcacttagcacagtctctggctccggttaggcttgggtttggggatttccaggggagcctggcattccagctttcttagccggatccctcactgtacttcctcaatgtccatgaatcagccagcactgatggacgacgtttgccgtaacgggcaccatgacacactgtgctgttcccgagcaccccctcaatgcttgctctgggaatgggcagacaaggctgtgcccacacccgcggcctctctctgaatcaccacaaatccccacaagctgctattattagcttgtcttactgaggaggaaatggaggctcagagaggggagtggcttgcccaaggtcatacagctggtgagcagcagggtcagtctctgatccaggtgtgcacggtgctggggcagcctcctgttagactgatgaggaggcctcccgggacaccacccctggggcaagagtggcacttggctccctggaaagcagagacagacctcccccgtcctccggtctgtcctcaggcccactgcatggtgggataagacctgtggttaggacaccagccttcactgagggcagccttagggctgagccctgcccaggcctcagggggacagaaaccaggcaagagggggaggtcatagctgttccttcctccttcctcgaagctcctacaaatctcctggcaggaatccagggccaaccagtaagctcttaccctggcctatcgatggtggccccagggcaaaggtcgcatcccttctcccccactcccaaactcaacttcaatcaaaactaaaagtaaaacaaaagtcccacagattaccttattacgcctaatcttgtttctcttcattttttagatatttttttctgggaatctgttacttttacaatacacataaaaagcacatttttaaaatgagagagtaaaagcacccataattccgtctgccaggagcacccagtgggccgtgtgggtgagatccacaccgggattttcctccctcccctgtgctcctcgcctctctgagctgagctcagcttgcagatgccagtcaatgtcctgttgctgtttaacctgtcattgcaacatcagcccctttcccagcaaacagggcgttggcaggtatgcagggccctccctccggacaagtctgaggaccctgatctgtgctgcgacctatttatagggccacgtgcatccgtgttcttgtacattgggaatgatgatgagtcctcagtggcatcactaatgcacaaagagatggaaccaaggcccagagacatgaagggactggtcccaggtcacacagctgaaagcagctgggtctcccgacctctgtgccctcctctgcctgttctgctgtttgagtctttaagtccctatcttggggagagtcagtcattcaatcactccttccctccctccctctttcctctcctctctccttcctccactccttcatcccatttgacaaaatagtcaatgacaggcctgtgctgggctccaggatctaacataagacagatccctcactggccttggaggactaattaaagaatccctcacatgcctgtacactggaaggatgaaggatctccagccgtgctatgaatgcaaatgatggggcaacctgaacctggcaggcagccttccaggcagagggaattgcagacaccgatgccttgaagctggcagaggcagagcatgctggaggccagtgtggaggagcacagcgtgcgaggaggggttcaggggccagaccctgcagggccaagggccatggccagggcactggccttgacctcaagggccatggggaaccaaggacaattgatcacaggagtggtgacatcagatttgtactttatttcattttgagatggagtctcactctgtcgcccaggctggagtgcagtggtgcaatcttggctcaccacaacctccgcctcccaggttcaagcaattctcctgcctcagcctcctcctgagtagctgggattacaggcgtgcaccaccatgcctggctaatttttgtatttttagtagagacggggtttcaccatattggccaggctggtctcaaactcttgacctcaggcccccctcggcctctcaaagtgctgggattataggcgtgagccaccacgcctggccggggtttgtattttagagtctccttctggcaactgtgatgtgaggggcatagaatggacatggggtgaccagagaggtgggcgccattgtcccggcaggaagggctggctcatgttctcagcacttggacagcaggtacagtgttccctggaatgcagatgggcaggtggaggcccagagcagggcggatgtctccaggacctcaccccgctttccactcctctccaacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggtgaggtgggggccagggtgggatcggagcccagtagggagggccccatggagaggaaaccttggagggcttcttggaggaggtcacatttgaattgggccttaaaagttcagcagtatttgagcaggcttggggaaggcctagagggaaagtcaaccacatacatgatggggcctcaggaagaatcatgctgcaaatgttgtcgggagtctggaatgccacattagggggcccaggcttgattccaaaagcaataggttgtcactcaaggattcagagtgggagagggcggggctgacaactgccaggagggctagaggggaagagatgggcggggggctggggcgtggtccaggtggggagtgataagccctgaacggacagaaaagaagggatggagccaagaaattaggaggtcaaaggggccactgagaggggcaaggaggggagaggagttgagaagggctctgaggtgtaggagtgggcgccttggctagagagggtgctgtgagatgggcccccgtggggggaagaacaaggcagtggggagacaccctgggctcagtttgggacgaggcgagcttgcatctggggacatgaatgcatggtctgcccgtgggaggtggcgatgaatgttgctcatgttctgcttcattcccgcccccctatccccctcaggaacttccactgctgggtggagtcgtggatgaccaggccggacctgcagccggggtacgagggctggcaggccctggacccaacgccccaggagaagagcgaaggtgcgtgggcgggcactgtcgcgtcaaacagatggggaagacgaggcttggagagttaaagtgactcagctggagggcggcagaactaggagctcacccggagaccactgatgggtccacagaagggtgggggacctcacttacatcttaataacacacttcttgataaatctcaaaaataattcacgtgcattgcggaaagcaggaaatacagagaagctcaaagaaaaaaatcaaatagcatctttgtctcctccctctaaaataagcagcattaacattcacacgagcttccactgatttcaaatcgtgtatttgtatgcgggtgtatatgtgtgtgtttatatatgtatgtatataaacacacatatatatatgtagtacctgtgtgtttgaaagagagagtacactaaggcacaattttgtgatgcatatggacactttctaggaatatttttaaatgtataaaatataatacatagcgttacaaagaaaaccaattacattaaaatacagttgtcacaagttttaaaaaatgaatttatgatataataacatatgcttctttatagaacaagatctagcggtagagtcagtaagttccataatatagttgtagagataatttatgagcataaattaatttcctgccatctgggacagctgtaaggttgtaatgaccacgcctgtggttcttatgagtgacaagtcctaagtgctcctcaggctgctatggtcatttcctgcttttgcaattgaagaaagtgctatggtgaaaacaaagatacccttttttccccatcatagggttcatagacccctgaattctgttggtagtgccttggggggatccgtgggccctggtttaagacctccagcggcatggaacattttttcccagctctgtccacttctggataaagcattggcatttctccagcagatagttttctgtgatttgaatttttatttaatgtgaccgtggtccatcacatggatgtgctagactgtatctatccagcctctagtcctcagcattggaagtctgcggacagtgtggggcggttatcaaccacacttacgtaaacatcaggcacccgtattcacttggagaacacacacgccctggggctggccccatgcggggcactgagctccactctcagtatgagcaggaaacgagacagatgtcctccttgctaacatgttgcctgtccttggctccataatttcctcaggatgtctgggatacatttccattttatttatcaaatacttgcatagcatttagtataggctatgagctttacatctataattcaggaatgctcattaggtggtccagatcttatctccacatgaaactgccgcttcgagaagttagtgactggcccaaagtcaccagctaataacaggctgagctgggatttgaaccttaaaagttgtgctccagagcccctattctgaacccttgccctgtggtgccctcctggaagtggagtccttccgtcagagggccgcgtggtcttgaggtttttggctacatgtgattgaattgtggagcgttttagaggacaccacccaaccttcacccaggcccatcccttcccctttctacctctgccagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagagggtatgtgccctcagagtctttaatgcagccttgaagataagcatccagttttcccagcccggcaggctcgtgtatgtgtgtgcgtgtgttttaattggtagcctacgtacagcaatggccccgtaggctatactccatcttcagcaatgccttagaaacaggagcaaacatgttgagggacagtggtagaggattattcatttagggaaagagttctctgctactgatgttaaatcagttgcaggggaaaggacttgatttatttttaaaaattggatttgagcacatcgaacagccaattcaatatggtatctaatttctaagcaaatactaagcatagcaaagcatacagaggggactaagaaaccatagttcctgccttggcctgaccctcactgactttccagggttgcctggccatactctagctgaaagggataacacagaatgaaatgatgctctccccatcccctgaaaggtctagagctgatagtttcatagaataaatagatatgcacccaacaacactgggagaaaaaaatcaaaggagcacaggagagaggcaaatggaatataaggaagggagcaatcagagacagggagggaaaggattttaggtagaagtaatccctgtgtaattgcttgaaggtaagaaagattgcactgtattcgtgcctagtatgcaccaagcactgttgtaggcactggataagtaaaacacagccttagccctcgagcagctcaagaaggtaagtttgaaacagaaaacaacacaggggaaggagtggtcagagagggcttcctggaggaggggtcatttggggttgagtcttgagggatgtataggagttcactagtggaaaattaatgaaatgctgtgtccttctggcccagaaatgtagagaaggggctccttcatggctgccctgagtcatcaggcctctgcgaagacagctcgccctgttgcagcccccttcctgtgatctattccagctgtgattgaggctctcttctcaacccctacagggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagagtgagggggtggattctaacatggctccgttttccagatgagtagactgaggcacagagaggttaagtaattttcttaaggttgcacagttggggagttaacctgtcctcacagcagctatactgtttggtttcacctcatcttcgtgtgacccctgactgctttcacagaccctctgctgccctctcccagtgaattccactgtctccagcccctcatgcctcagcagcctctctccatgggcccttcgagaacctctcctgtgcctctggttgctctcggcctcaaagaaaagtctctaacccagcgccttggaaagtgcctgttgcactttccacagtgatggagacgtgctgagtctgcaccgcctatccagcatggctgccaccagctgcacgtggctgctaagcgcttgaaatgtggctggtgcaaccgtagaactaaagtttgtttgtttgtttgcttgtttttttattttttttgagatggagtcttactctgttgcccagtctgcagtgcagtggcacgatctcagctcactgcaatctcagcctcccaagtagctgggattacaggcgtgcaccaccatgcccagctaatttttgtgtttttagtagagatgggatttcaccatgttggccaggctggtctcggactcctggcctcaagtgatctacctgcctcggcctcccaaagtgctgggattataggtgtgagccaccgcacctggccaaaactaaagttttaattgtgttgaaagttagacagccacatgtggccagaagctgctatgttgggcagagcagatcggcgagccaaaggtgggagcgtccaggcctctgcagggagaagtgctttcttcctggacttgattgtccctctccagtgtccccagcaccagcctagttgcctttttaggcagatccccttcgcagtgacatggtgtcattagaccacccaacccagccccgagccaagactttgtcaccaggcttcctgcacagtggttgtcctctgggtcccttccactgtctggctttgtcactgtgcctggttatcttcctaaatataagcttgaggccctcagaggagccgtggccactgaggtcacatagcgaggcagtgagggaccaggaatcaagcccagggctccgcccagcagccccaccaccacccagcagccccatcccactttctgccatttggagccctgcaggtgtgaggagggcagaggggtttccaggctaggagaggacctgggagctgcagaatgagacattggccatcctctgaggggcagtggaatcaagtaggacatcgtctttgggcagcatctcgctgtgtcaccagagcaaatggccactcccctgcaccttagcgtccccatcaggctcctgggggtcatgatccaacagtgcaggaccatcgggggtaagagagtgtgcacacagtaggcactcatgcctgggattcagtgtggccacacctggagatgctggagagccctcgggtggggcatggtttgtgtttacagagtttgtttccccgtctgttttccccggactcctgcctgtcaaaccagtggtcgtccctctcctctatgacagtgcctggacccttggtgcccatgggctggcgtctggggcacagctttcaccctcctaagaaagcaggtctgtgttgcgggcggggcgtctgcagtgttgacagttgctgcctcctggtttttctatcttgggcccaccgtgggcactcctggagctgcacgccctgggcacacccactgtccggcccggggcagactcctcagcaggggccaggccctcagagggcagatcctcttggtaccaggacagggcccaacactgaagctgttgaaagacatttcccgaggccaggaagacctggctttgaatctcagctctgctgccctctgaatgcaccaccttgggcgcggtgaacatgctctctgagtcttaggtcatgctcgcctgttacatggggtgatgacatgcctgcctgatgcgcccgcagccgtgaggactgagggagaggatgcgtgctcaggaggtatctggaaagggcacagcagcaccagcacacggtggggccctcactcctccctgagtgcgagtgctaagaggcgtggggaggcgagaagcccgggacctttcctgaacaccttctgtcccaggcagtggtgtcagccctgggctcgggggttcctgtgtccctgacacctcggtggtgtagaaaggacccggccctcgctgctcatccaggccccgagagtccgagacaggatccatctctacaggcgtgtgggggttcaggacacaaggacacccaagttctagttcctgctgcctgctgcctgctgcctggctgtgggctcctgggtattcctctcctccagcaaggctatgggttccccattcacacaaaggggaaggtgctttcctcttttaagagcccttccagccctgttttgtgtgtgtgtatgtgtgtgtgtgtgtgtgtgtgtgtgtgtatacatttaggaggtccaagtgcggttttgttacacggatatattgagcagtggtgaagtcttgggcttgacattggagacccagtcccatcgtttcagtgcacacccaccagctccttctcgtgctcagagctgctccaaggggagaaagtgtctgtcctagaatgagtggcatgaggtgaactccaggcctgggccagacacaccaaaatcacttcctcccaggcctctgtggagtcagccctcacctctaagtcaccatcgggaccctgagagcattgttccgcactggcatcagccaagcatgctgacttttctcatcctcccaggaacatgctcaccacagagggtgagcagcaggtccctcctgttggggatccactggagacatagccttcagggagaggaaggggaggacagaaggtcctgggcattggcctctggctggaaagtgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccctccaggtgggtcacaggaatgcagccaatgtggcctcggtgactgtccccagagtaaccttctagaacagggcaaattgtctaaagaatggttgagactgaccatacaggtttcctcttcccagccagcatctggcccaagaccaaggccgtggccactggcttgtggacggagactttcaaaggtccagccctgccctggcctccacctcctagaatagtcgacagttgggccacatcctccaagcccccggaggataatgtttttcttctttcctgtggagctagctagaatttccactctgcaccaccaggtcttgacctagtaattttcaccctcttttgtcctttttggcacaaaagtttggttttcttccccagatcacatcatctgatgagaggttggagcagatccacccagggaatgaaaggccaaagaggtgggcaggtcggggcagcattttccaaagaggaggacgcagaccaccagtgttcacggtcaaaggttcaaggtcaaagcctgaaccttgaatcccacagtgagaaagtgactgtctcctcgggtctcaatccgtccttctggtgacctcctggggaaagtctctgagggtgctgatttgcctctggcctcctaagccttgccaatctccctctttagcagtagactcaggtctgaaactcagagtccacagcacatcactgtatctggccagaattgaatatgcatgactttgtttgtattttctctctttttttcccccttgagacagggtctcactctgttgcccaggctggagtgcagtggtgcaatcacggctcactgcagcctcgaccttccaggcccaagcgatcctcccacctcagcctcccaagtagctggaactataggctcaccccaccactcccggcttgaatttttgtattttttatagagacggggtctcactatgttgctcaggctggtctcaaactcctgggctcaagcaatcctcctgcctcagcctcccaaagtgctgggattacaggcgcgagccactacacccaactacttgtatttatttactgctcctccctgcctcctacaaacagaccccaggtctgttttcttaaatgctaaactacatgaatccttaaaatgctaaactgctaaggtcctccagcctcagtgttcttttcagaaacatggggctaagaaccacacttcagtgggtagctttgttcctgccatcttctttctcatccccatatcactgtgcggcttttgctctgcaacgacccttggtcttacctctgcccagcaggtgataagatctgggaacagagaggaaacagaggggaaacagagaggggaggtcatctccccgggctcacacagccagtgagtggccagacagggcctgaggcaagtctcccaatctgagcacttactggcagaggtgattcttcatctgtgcaacgggtacagcatcacgagcctcgtggagggaaatgaccttatgtccatgagaggcattcttcagtgagtgtggaccatattgttggactctaagatctggattattagtccagatgcctgcacagtacatatcagctgtgtgacctaggacaacgttatttcacctgctggagactcagttttctcatctgtaagttgggtggtaatacacgtacaagccttttagggttgtcatgtaggtgaagtaggagcccgccgtgggaagtgcagtgcctggtgcagcaagcagatgtcggctctgatcctccccaggatgaagggcccgcggctcacacaccctgagtcccgagcgcaccaggctcttccgggacactcgctcagctcatcctcccacagccttaggagtgcctgtgccacgcagatccaaacatcgaggacctgggaggtggagtggctcacgcggggtcacccattagaagaggcaaaggcaggattagaaccaaggcccgtgggagtccaagtgcgtcctctacccgctgctcagtgtccactctccagctcctcgctgggaaccctggagccacagtggggagttcagggatccgcccagccattcccccgctgtgtgaccccaagcacattccttcccctctctgtgcctcttggagttgcaagagagttgggaggggtgattctgcatcatgagcaccctcctttctccccttctgcagagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccgggtaagggcaggctgggcaaggggcagggtcccagggcagctcagcgctggggagagggcagatccctacccccaccccacacacctgcatccctgcaagctccagacctttggtgccttagcgatcctcaaatcctagcctcatcgaagaaaagcatcatgaagcctagagaattggggactcgtagcctctaggaatgaatctgaaaatcccagagtgttagggtcatggaatttggggatcttagagtcatgaatccttcaaatgctatactactaaggctggaacccccaggcactgggcactggtggggcagggtggggtgggggagtgaagggcacagactagagtctcactgcctgaatttgtaccagggcagccctgggcatgtgagtttgcccctctgtgcctcagtttattcatctgtaacatggggttaataatagcactgaggggtgttgtaagaattaaaagcatatccacaggaaacacatagagccatcctcagcacatgataagggctcactgaaagctaactatccttatcatcgccatcatcatcattatagcccttcacttagaggagccgcagcccacaacccctaagggcaacaattacacttaaatggtaaacagcagagggagcggcagtgagcagtgtgtcagacattctgctggaagcttgcacatattagctcagttaatcctcacaagaaccctcagtcaggcatttctctcccatgaagaatccaaggtgtacagagtggggagtaacttccccaggtcacacagtgaagaagaggcagagatcagcctggctcaaaagcctgtgatctttcccctccagaccctgggacaagggaggcactttggacatcccctgggtcacgtggagcctcattgcagctccatgcaggagacctgggccggtagcacaatcggtgttttcccgatgaagaaactgaggcacagaggtggggggagggggggtgatcgtggcagacctgggtacagctttgttcagcaaatattgggccaaattgcagtgaatgcagacagcccagcctggatcccacctgcccttgacatctgccccatgccctcttccagatccttggggagcccaagcagaaacgcaagctggtggctgaggtgtccctgcagaacccgctccctgtggccctggaaggctgcaccttcactgtggagggggccggcctgactgaggagcagaagacggtggagatgtaagtgctggctgctctagctttggggcctgggggaagcgggcagatgccggtgggggtagagactgtccttaggtaccaagccctggctgaaaatcccctcctctcatctcccacacagctgtgcccactcccagacaccctggggctagagttcccaccgtcacattctctgtcaatgctgacaccacccatgcacagatctgccacagacctccacagtgacatcatccgtcaataggcgctcacctgcagacacgtgcatcctcacatagacaggtatctgccctccgaatgtccacacatgagcatgcacacacatatgcatgcgtgggtgtttccacatagatacgtagctgcacacatacatacgagcacacacttcttttttacttttttactgtaatgtaacttatatacagtaaaaagcacagatcacctatgtacagctcaatacattttcacacacacggctacctgagcctatccccttgtgcccctaaatgcaccatctgcttttatgcacacggacacacatgcgtgcacaggcactgttcactctaggagggcagattgtccaggccccgcagagggccgagaatgaggcccattcatggacacgctgtgctgatcctcggaggtcacgtgacttcctggctggaccccagcatgcgggagccaggccttgggcccctttcctcaccaccccctctctccctgcagcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaactaggtctggtctgttcctttatgagtttggagggagatgggtaggtgagctcgctcacacctggacccccacttcctgcctaggagtctttcctgagcctcagccctgtccctgcgtttaaactttactggcattcaaggtcctacacaggctggctccatctccggccccttccaccaacagtctgtttttgggccacaattaacttcctgtatccccagaacaccctgcgtagttgtctacctcttggcttttgtgtatgtagttccctgagcctggagtgcccctccttttctttccctgcttggcaaactcctactcatcctataatgcttaacaccaaagtcacctcttctgtgaaaccttccttgatatcttttcgggtccccagagtcctggaatatggaccaattcaaacatttatcacagtaaattttacttccacgttggcctatctgtccccttctccatcctatctgaagccctcgaggcagggaccacgtatctcttaaatacactaataaatgctgaattggtaaatgaatgtttcctaactcaactcccacaagacctgtgctgtcccatagaaataatacatgagccacaaatgcaagccacatatgtaatttagaattttctagtgaccacattgaaaacagtaaaaaagccataggtggaattagctttaataatgtattttatttaatccaatatatccaaaacattatttcaacatgtaatcaatataagaattagtaaggtatttgaccttcttatttttgtactcaatctttgaaatgtggtgtgtgttttatactgacagcaggtctcaatttgaactagctgcatttcaagtgctcggtagccagtctggctagtactggatgaagcaggtctagactgcgattccgtggatgtgcagacttggtcattcatctcattccccaccatcgaagcactcatgagtatctgttgaatgaatagatgatggggacagtccccacccttgggaagtcatgtagaaagacatgacatgcacataaaaaataaatcaaaataaaaacatgacatcacgtgttctgggtgccgaatccttctgttccttggacgctacaacctggtgctggctgggtggcttgataattgtatcagtgagtcaccagctggaaaacagaaaccgcactactatttcaggcagagagggagttcatagaggaagttcattccagaagtatccaaaggggcagaggagcagatgggagaaggagtgtgacctagaaattgggaagcag

SEQ ID NO: 16012 - DNA, 41393 bp, Human
ctatccagctgagtgggttgcctgagcacacgctcttacaaactctagtctagtcctactatctcacaattcccaggaagcctggctctttctctggcatcagctggaagctctgttgggcttctcacctctgaaatgcagtaagttgtcctgctgtgcctggcagccgacccactgcctggctcaacatgtcagacaggctccaccgcgaccgtgggtgtcctcaattttggcggtgctgacaagggtagatagattgcaggggtgagtttcaagaatggcttcagaaagacaaagagtatgaattatattccataaccagaaaaaggccttgtggctggagaatggagagtgaaggatcacttgtgagagatgaaactggtgagatgggcaggtcatatagaacctgctaggccaagcagggagtgtggattttaggtgcaatgggaattcacggagggttttagcctggatgtaggggatcatgatttaatttcattttaaagatttaaagcatgataaatccaggcaaaaccaaactgatagatccaggcaaaaccaaacaaggtgagtagtctgggtgacaggagatggggccttcagcttgtgggctgagtgacaaggtcttgatggattggaggtgaggcaaagggaggaatcaaagttagctgcaaggtttttgaccttccaacttagagaagtttagcgccgcgttctgagaaagtgaagactgtggaaggaatcgtttggggagggaaggcgagctgtctaagggggggggatgtggaacatgcagtgggatgctggggcctggaacgtaggggagatgcaggtttggagtcaccggtgcctgtgttgttgggcaaagccaggggaaaggtcaggtcgccttgggatctggcctagcactgagtgcagaggaagagaagcttctgagatcgagaggcagcggctacaggaggaggaagaaagcaaggcggggaaaaccaaagttcaggagagcatttgcaggagggcgctgcggggtagggtctgagtcggagccccgaatcggactcgagtcctgtcgcgtggggacggagcgtgcagaggcccatgcgagggacagacacaaaggccctgggagctgcaggtcagaccactggacagcgcggccgcggacctaacgcccctgtaaggggtgctcacgcttggggggaactctccgaaagagaggaccactgaaagccaccctggcagcaggggcggaacagacagacgtgggtctggccgtcgccagaactgcctgcggaccagccccgcgctgccgggggggcgggacatgtcggctgtccatcagtgcccgcgaccaatccgcaggcagccccgcccccgcccctcccgggagagggcgcgcggaggacccgccgccgccggtgtgaggcggcccgtcctggctcccttgtccgggaagcccgcccaggtaactgagtttggccgggcattcccggaggacgcgccatcccctcacgtcccgtcccggtcgctgcatgggcggtgttcgggacgcgggggctgcgtctgtgcgggaccgcggggtagcggccgcccgtgcgagtacgcctgactgacgcgccggccgccgggcctgcggcctgtgggcggggctgccgtgcgtgacagggccgctcgtggccgccgggctgtgtccggggccgcgtgagaaagctctgcgggactgagggctgggtgggtcgaccgggaacggcgcgcgctcccgccgccatcgcgcctccgtccccgcctgcggcctgtctgggggtcgcggggcgcaggcgcggcgggccgacgggcgggggtcctccccacgggtgcgcgggcgcctttgttcccggcgccgaagcggggtggggcctcagggcagccccgccccgccgcgctgaggccccgccccgtgtccgcctgcaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccagtaagtgcgcccacttcctgcctgggcccgccccgcgcgggggtcgtgggagcccggcccgactgcttgcaccccggccggccgccccagcgacttgggcaaactttcgggccctcccagactccctccgggccccgcccccgcttcgtctcgggtggtcactgggggcggggggcatccgggtcctcggtcacctgacaggacaccccccctcccccagctggggggagtgttccaggcgctttgccctgaggcctaaaaatcctcgcgggctggagacctgcggtgcaggcatcgggccccccagaccctgggagtggtggcggcgtcggcgaggggagctaaggcagtggcccccaccctgcacgggaacctggggcctgaccagacggtccccgcccactctttatccagaaagagcagtctgtgaaactctccgggcccccaggctgggctcttatttgcaaaggaatctttgggttccctaagtagaacttaggcagatgttgggtagggctggtcttggagcagagctgggcctactcatctccctctgggggagagggaggaaggtggtcttgtttggtttggagaagcctgagagaagccagtggctggaatttttttttttttttttctgctacttttgtcccaaagctgggttttggaggcctatgtgggtgggcagacactcaatgccagggcagggactccccttgccctgggaagcacgttcccaggagatgggccccataaaggcctgccccagcgccttggagtcaggtattcttctcaggagtgcagctagtttgtgagtctagccctttgtcctctgtccggtggcttcagggagcgggagcggcttctcttagtttcctgccttttcgccttcccaggcctgagcttggctgcttttgcgctggtctctagtgggaggagggagttgggggattttgaaaaaccccagatctttgagagttgttccacttagcgcgtgcctgtgctgtggtcggatgggcactctgctctgccctccattcccccgcctctcagtgtgaagagatggtgtgtctgcaactctagactgggttgcttcttgcagggacccccggagactagggttagagagacccaggctcagaaccaggtctgtgtgaaggagggagatcaggaagtgacaccccaagggggggtcccacaaaccttcttgggtatggtgtgcatgtgtgtagatagttgaggagattgggaggaaggaaggtcttgtggtgaggcagccaaccatcctcagctacaaactccagatctgacacagatctaatgcagctgctcaacttagaaatggcagcccccttcctcagtgcccccactgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtggttgatggcaagtctggatttgaagcccatatattcattgtgtgtttcccggccagttacttaccttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcaggaagggaggaggacggtgaccaaattcacatttcacttagattgctactcagagaaaggcaggaaacagttttgttttgccccaacccatgtgcccactcacccacccaccatgtagaacagtgtttctgtagagaaagtgtttgcagttgtgcacatttgactcctgggtgtgacctttcttgtttgtaagttggggcctgaacagaaaagaggggtgcagagaggggatgatttatcatgcctcatgtatttgggggatggaggcaggcatacagaggacctgataaccccctacccaggggtgagcaggtgggtcagccagaggtgtacaaattcagtgatctcatcagttagctgggatttaacaggcctggagagtaggcagaggatgtaggaggaccctggcttttggattttgggggctcagattgaaaagagcctggatgaaaagtctggtcgatgcttgtgtgttcagacttaactaatggaggcttccactgaagccgtgccctgcttctacccattcgtgggctctccttgttggtgggttctgatccctgcggcctctgaggaggttggactgccagccgggttttctgccacctggactcttgcccaagcacctcaggtatctggcctttcctgctgaccctaccagggtaccagcagtgcctgaagcctggcctaagagagagacactgtgctaccttcagggtgttggtagacctgagggagagacagtgtggtttaaggagcactcatactgatatgtaagaccttcttctgccctgactctgtgccctctcttgtcagcagttgtgaaatggagctgacacctcctgatttctagggtggtcatttggctcaaaagcggggtggggaagtgcttaggtgttgacaagtttggttgtcctggtggtatgacaggaaccaggttggtgtttggccttttatgttgcagatactgacataaatgaataaaatgcagttatgtagagttccagctgagtgctattgagacctttcgtcccattttacagatgagcaaatggaaatggagaatcgtttgtgcccaaggtgttgtgtcagtgtgtgccagggcctcagctggggccagctcactagtcagaggctgactagcaaccccaagcccatgttccctgtggtccacgtggctcctctgtgagacacctttgtgctcagaccatgcattacagggcaaagaccactttggcttttgtatcccaagacagcctcagcctctctaggctctggctccacactttttcttctggtgttttctgagttgagatggttcagactcgtgtttaatgaggttgtccatttgagggtctttgtgggcccagtaaacactggtgtagacactgtggaggtactctgaatactggctgagcatgtccatggggacttctgaggccccaggcttctgtctttggctgatccttcactagatacttttctagatgccaggccctctgaggtgaaggagtatgggtgcttgcttttagggaaatgaaaacaggcaatgacaattgtgagcagtacctttgatgaagagggtgagggtggcggaagaaaacagctaactgccttgatgaggcaggcgggctcagaagggaggtagtagtggaaccagctggctggggcttgacccctgtggctggggagcagaccacaccaggaggcctgctccgagggctaggcccacagcacgggagagggcaaggcccaggccggtgtcatcaagggttttctttgtactggctgttactcccagtgggagaggggcaggagcacatgtccggatctccagagctagccatccctgcctgtgtatttcctgtctgatgtagttttttccaagggaagtcagaccttttagtgtttcctcagcaccccaggcttgccccgatgtgtgggtttccaggcccccccgcccagctgggatcctctgtttcctgtgaacctaggaaaagggcctgcttcacagataactggaggagctgagcacacccagtcctgggacccacaacacctccagcttctctccagactcttgtgtgtgtgtgtacacagatgcacaggattcagttggagtttagagatcttggctaccagctttgctctgggtagcttcttggaatgaggcacatttattaatatttgcaataagtattattatacctccccatttgcccagtgctaggcaccaaggattcaaaagtttattgagacatggtttgtgccattgatgaactcttggaaaagacagatgtagaggcatatgattataaccctgtgtgttacataccataatataaaggcctctaccaagaactgtgaggagctctgccaggaaggcattaaaggagaggtgacctttgaggtaggccttgaattactgaggcacctgtctgtgccgaggctaaggaactgggaatcactctgtgcaggggtagggaacagatatggtgtggtagagaggaagctgggactggttggagacagctatagccctagtgtgccatgtccagcagattacactcagtcctggaggcgacgggagtcagcggaggctgttgtgggactgacttgcctctgcctgggagaccacagtggcagtggtttgtcaggcaggtgttggggagggaggccagtgagctcctacggtttgcacagtttgcaggagagagctgctgagggcccagacaagaccttcttgctgaggcagggtggggatgccatggtggtagatgggagaagggctgggtcttgaggggtgagacagagcttagtagttaagcatttgggccctagactctgcttgaattaaaatcctgttgtgcagcttacttgctctgtgaccttaaagcatatgactacctctctgggctgcttatctgtaaaaaggatagtattaaatggcatttattttataaggtttttgtgaggatttgatgagaacctgtataaagtgcttagcacctgtataaagtgcttagcatggagtgtggcacagtgtaagtgcttactacgtaggatccctgacaggacagagatgaggattaagttctcaggaggacctggtggggaggagttcgaatgcacctgctgtcctaaggggctggtgcctggccaccaagccctttgattcagaggcaaggaggcccgcccatcctctcttgcagctctcagcagtccctctattgtcagggctctttcccactgctggttttgcagggagacagggcagttggctggaagcagctgctttgggtggtaaccccttctgtagagtgaaggtatgatattgtcctatttctaagtgcctagcccaggacgctatctggagagatcttgtctttgaggaagtgctctaatgccacagcctcgatgtggtagggcctgcctctgctgtcactgttctgtgtcagtctccgttaactcacagcatctcttcttactctgtgccttttcctgtgggatgtggcttcaaggagaccacagatgataagttggaggaagggagtgaggcctgagattgcaaaggtgtgatattaggagactgatttttccccctttccacttgctttgttagaactagagaagtcactgcagactgtgaggagagtcctaggagagatgggtgtgggataggaggatgggaatgttctggtgccccttgtagagtgccttgttgagaggagcatgggaacagtgcgtccttggagggaatctctgagagcagcatgtttacaggtggcaagactcaaggtggagccacgggtgaggagtggcttcaggctaccattgaccagatagtcccaccttgctggtaattgagctgaagtgcctggagatttgtggctagagctggtcagatttgggttcaggtctcagctcttactgtgaccttgggcagattacttttccctgtctgaaattgatctttagctgtaaaagtaatttctcctcacagagctgtatattaataataagggagattatatataagagtaagagattttatgtgaaaactacccagcacaacatttgtcacttagtggccacttaacagtattcatttcctttactctcacctttgttaaccacagagctccaatcttttccaccactaagctcggccacaagtggctgctccaacaacctgggctaggagtctgtttcctacttgctttctgtgttccttccctgagtctgtacacagaggactggggcatcaaaaaactctggaattggaatagcatattgggagttcatggaacattttctcacctgttgtattgtttgaacttcacagcagctccatgaatccatggagggcaggagttactatccctctcttacagaggagaaaaccaagccctaagggtaaggtcacatagcaagttcatggcagatcctaggatttcagattcctgctatagtattcagtttattctcccattctggggaaaatgataataggatggaccgttctataggaacagagggttattttgttttgttttgtttttcttccctctggccacatgtgtttgaccagcctagacttccatctgtggacaagctggactcattgcctcaatttcaaaacccgtcctgcactcatccttgccacaacaccggtgtcgagatgcttggcccacccagacctttcccacactcctacatgggggtgaatgtagccgctgattgggggtgggacacagaagagcctcaccctcttgactttctggtttgtggtgacacttccgcctaagcttctacagaacatgggaacctggggctccatgccccaaatatcctgagaagggcttttccaggattctctatgacaactcaagagcatgcattcattcatgtgctctttaatttgtcatacatttgttgtgggccttgctactgtgtgttgggcacactgagctggatgtgattactccagcctctgacttgttcatggtggcagtagatctctagcgtggtttgtgttccatctcaccatacctactctccttaaaaaaaaacaaaaaactagctttcttgggcctcagtggctcattgaataagtgagagacgacttgtgcttccctggctttagactctggcatttgctaactgtgccaagcactgtggagaccagtagtggacataaggttagggtagatacagccagaaaggagataaataggcagacagataaaattcttataggatttggtgagttctatgaaggaaataaggcaagaggctgctctgtcagggtaggtgagggtgtgctgtgataacaaatgatgcccacatatcaatggctggcaacaaggaaggttaatttcccctgtttgctatgtgtgctaacctacaccaccgtccctggagagtggcctcagtggttctgggtgaggcctctagtacagaacctgaacaccctgggcaaactaggctggagagggatttggagtatggaggtttagaaggaattaatttctatgacttaggatgcatgtggtgagtgtggctttgctgttgtggtagagtagagtgctgcctgtgtgggtcaagagactgtcttggctgacatctttgaaataggtatatttgtgtggcccttgcctaattgtcatctctgccatagctgcccccgccttccccaccaacccatggccctacttgagctgcctgctgagcctactctgttgtggccacagtatcctcctgctgcccagagtttgagtttctcgctacttctgccactcatcacacttgcttcccagagctttgctgggtgtgctgaagtctccagagaaagtggggaatatgggtgcctagagacttctagggggtgttttcagcccctagagagtagagaagtgtgagaaggggttggtccccgaatattctgtagttttggggaagaagcaatggggacagtggagttggttgccttaagagaggctatggtcccaagagatgggacttggagagtctctacttgcattcctggctaagcccttaatattctcgcacccctccttgcaagactagttccttttgaggtggttcttggctagcttttgagaggctgcagtggctgtgtgcccaggcttaagtcctagctttctccccactctttacctcctaggaaccgggcccatcctgggggaggcagggaggagctcctttttatagtccacatgtaggctttgtgtataggctctgctgcttccttccggccctggcccttcctggtgttggccggtggccctggcttcagcaagactcaggatgcagagtaaacggggcagggcgttctcctacagaagactggcatccctttttactgagcccaggcctggcacagaggaggctggagttaggaagcaagaaaacgaggtgacccagtccttgatcctgagaagcttgtgatctggaccatgcagaaaaccgctaatgcccagggctggcaggagacagctgtgcctaaagtgctgtaggctgggcctgagggccaagatggaatcgcttttctccctgtagcagcccatcctaccccctggggtccctccacctgccagctggcacacaggtgttgggtaaagcatctgtacaaaggctgtgaggggcctgggcgcaaggcagcaaggcttgggtacggaggagagtgggtggtcttactgatgttctgggccctgacagtgaacagctggccaaactggtgaggagttgggccatggcgagtttggccacttgtttgtgtgtgtttagttcttcctgggcacaggtggggagttcactttggggttggcttcctgttttcttggacacctggggatatggttgagttaaaatgttctgagggaaatgattgttgagggcatgggcttgggtcatagtgtccttggcttggccttgcccatggtaggagtcgggtattgaccacactgggttctggctgtgtaggtgtggatgtgtggtgggagaattccaaccccaccttgacttcagcctaaggcccagagagtgtgggcctgagttcacagggtgactaaccctaggaaggagtgaaggagagctccagttggccataggtcccacaggtttctcagcttacttgggggcaggaggtgagctaaggaatacaactccattccctcagttgggaggttgggcagcgatgggggcaggggtgatggtccttctctgaggcactgaagacccactttatggtcaccctattctgcctgatagtccaccacctgtttggaggcagctcccctcttcctgccctagtcacttcctccaccttcaacagtaattgagtataatgtgcctgtgttagcttgtccatcctaactgggactgtggccttttcttgggcgttcttagcatatctaccaaggaggttggaaaaggtaacatatgtcactttgttaaggattttgctgagggccttttgaggccagcagtgaaacacagagcattccctccagtgagaacagaatgtctgttgccagactgatcacaagaggatggcctggttctggcctgagaactggtctacaccggaagcatgaagctccatacaatcatgtgtgctagtaaagtttgggcaagcagctgtcctaagcaggtaaaacgataggttattcaacttcaacttcagagaaagaaatccaaggtagccatctctctcagtaggggaggtgagttcaaagaatttaagctgggctgggcacggtggctcacgcctgtaatcccagcactttgggaggccaaggtagggggatcacgaggtcaggagttcaagaccagcctggctaagatggtgaaatcccatctctactaaaaatacaaaaattaaccaggcgtggtgtcaggcgcctgtaacccagctactcaggaagctgaggcaggataattgcttgaacccgggaggcagaggttgcagtgagccaagatcgcgccattgcactccagcctgggtgacagagcaagactctgtctctttaaaaaaaaaaaaaaatttaagctgggctttctgggcaggcagtgagtgaatgagatccctggcaccttggagtgagatcagagtctagatcactcactggggccctgtttcccaggaagcaaaaagggaacaggagagtggcttggcttgggctggcatggcgcaaagggagtgcagccagatgctgtggcggctgggtcaagtagctctaaaacaggagagcctagtgggttctgctgaagcaggatgtctcagcaagcaggcctctgacctgacgacttccggtcattatttagaacgtctccagccccacagatttactctgttggaggcttaaggactaaaccaacatttactgtccaagaggtggcagtaacacagaaaccaaagaggcaggaaccaaggttggggtggtgagatgtcatggggttcagggagtggcagaggggaaggcctctattctccctttcccacttgtctccctacctcagcccctgttgctctgacgcttcccccaccactatgagtcctaggcccctgttgtttccttgtaggagggagaccccagatttttatttcttctcccaacccattccatttcctctcccttgtgagagggctctgcagagacagggcagcagagagagacttggagatatgctgggctgtggtcaggagggcctcatttatctagtgagcaggaacaggttatatagcagtgatgctttcatagtatttttcttgaataaggtccccaaaaccttattaagttcctggtaggcatggagcattgaagatggcagacatggtgcagtctctcaaggagtttacgctctagtggagaaaacaatcagacagccttaaaatacatgtatggctactataataaatactgtgaagcaggagtgcaccacgaaacctggagtcctctccatcctccccttctgtctgtgctggccctgcttggccacttccaacaaggattctgaggcattacagagcacacgtctagggtacaggcagtcttggctttgaagtattgttggctttgccactcaccaactgccaccttaggtaagttaattaacctctttgtgctcaatttcctcactcgggaattggggaccctaatacttacttcatagtgttatttgcaagtataaaatataaggcagtttttatcgttgtaaggcagtcttatcaagagctttatgcaatgtctatgcaaagtaaatatgcaagaaattagtgttaggatgccagatgctgctgttgctcatcgtctcttcccacccagcagaggtagtaactacttcatcctctacttctcagcttcttatagtatttgtctgtggactctaacgtaagctatctagcataatactcatatctaatttttccttccacattcaagctccttgaggtacttgtattccaagtatctagtttaatgtctctcatgtaggtgctcagaacgtatggttaattttgaataataaagccagtgggacttctcagagggctggattgggggctggtgagagaaaaggagatgcgaaggatcattctgaagtttggagtttgggtacctgtttgaatggtgatgctcttagctgacccagggggtatggcaagaggccttggttctggtgagagagagaagacagtgtttggttttgaggagttgtctttgagacgttttgagatgaagagtggggatagcaagtaggcagctgaattgaaggatctgaagcttaagaggagaggactaggctagagacctgtttgtgaattatctgtacataggaggtaattaagggtgtgggcatggctgacactgatgaggaagaaggcagagcaccggaagagaggaccttgacctgagccttgaccaaggccattgctaaatgcaggtaggcctgtagcgcacaaagaagcatgaaaaccaggcaaggttgtgcaggagaaatcaagggcagagcttcaaggagagagggcgtgatcaaccatgttgattgctctgaggtgtcaggaaggaggaccatagataagtgatttatgggtcaggcacggtgattcatgcctgtaatcccagctctttgggaggccaagactggcgagtcatttgagcccaggagttcaagaacagcctgggcaacatggcaaaacaccatctctgcaaaaaatataatcagcctggcgttgtggtttgcctgtagtcccagctacctgaaaggccaaggtgggaggatcacctgcacctggggaggtagaggctacagtgagccctgttggtgccactgcactccagcctggacaacagagtgacttatgggccaggcatggtggctcacacctgtaatcccagcactttgggaggccgaagtgagaggatcacttgaggccaggagtttgagacaagcttgggcaacatagtgagaccccatctctataaaatataaagaaaaattttaaaagtgacttatacccattgctctggttctccaagtagcctgagtgtactatgtgggggagcattttatgagggacttttgaggtcctgggcatccctgagacatggccctggtgggtccccagtctctctcctgtagctaggagcctggcatacacaggccatctagaaagaacttaggcagcatcagtctgcaagggaggcagagtttggagcacactagactcctgacacagaggctgacccatggctgcctggagaatcttctgggcttgtgcagaaaagttggggaaagccacctttccctactgtggcagtcaaggcttggtataggccatcttccctcccttctcatccatgatactctgaatgccctgtttgtggaacttagtggactcctgcacctctgtcttggtttccatgaacccctctgcccaatgtgtgcttgtcagccctccagacctggcttttacagagcactccaagacattgctctacacacactcagctccacagacacctccctgttgttctactcgttgcatgacctcatagttatctgcttccccatctgtttcctccatcaggcaggggttttctcaaaggcaggaactcaaatgccttattgatctctgtttccctaggacccagcccagggcctgacatggagtagatagatgcccgataaatgtttgatcagatgatggaatgaatgactgcataagccgaatagatcactgctgagtgctcttccagctttaatttctctgggtgggacctcctttcccttccttcctttggattctgttcttacctctgaaataggtgagattaatttagagtcctagggaagagggctgcctgcctggatggtacaaaggctggctgtggctgctctgtgtttctctgtatacccagtgtcagggatagcagctgctgtggggacactgcagagtgtcccagttctgccatgactcaccatatgaccatgacaagaccctttggaccctctgtttcctcattgtttcaaagagatttgtctagaatctagaccaagcttgtccaactcgctgcccgcgggtctggtttgaaggcagctgctgcacagtaatgggaaggacagtaagccccaccatcgccttccctttgccatataaccctgtgacctcagaagtccctgaacccagatccttgtttgtaaaatggaaagggatagctacccacccctccactttgaccttcctttggtggcagccagatgtgctcagggaaacctcagatttgtgagtatgtttctactgagaggcaggaggaggaatattatagtctcaggaagagggaggaatgagagggagaggagaactctcaccctttccacaggctttgggcatatgcagccagcttggaaatgctgaccatcctgtgacctggctactattgcatcaggcttccttcccacctgtgtccaggtcctatctttgtctcttctttggctacctccatccttttccttcagagctgcaaaaaccttgccaaagccgtatggtcctgatgggtgcagagcccctgtgcctctggctgcctgtgaagggggatctgcagtgcagtgcctgccgtaccccacagggagttgtataggaacctggggatggggtgactgaggtagggggccagaagtggcccagatgatactcacttctgctggaacttttctttgtccatctttcagcatcctctggtggagaaggcttagctccattaatgctctcctaggtcctggctgtgtattttctttggtatgggagtggggaactgggagggactcatctgtttgccacagactacatgtggagagggtgattggtgagaggtcattttggagatctacacacctcttctgacccctgggaccactctcctgaatctcctcatggtcttggcttcgggcccagcagggcgtgggtgctcggcatcctgctgcttttactgtttttcccaaagctctgttagcttcccgtggttcccactggctataggaatctttatgtaaggacttcccagtgtttccagactgtatttgcccccaggggtcacattccccccaactatgcctgctgctgctttttctgttcccgttgttacctcactgaccactgcattttcagtatttgttgtagcccctcagcctctgtggcccactgtgccacctcttccaggaagccatccttgataccatctttctggtaccatttttgagcatctgtggcctttgctgcctgttagataattagctctggaatctaactcccatgtgtttactcctgctcttaagtactctgaacattttgaggcctccccaggccctgggtttgtgttggactggtagggaatggagagaagagtcaaatgtggtttcttccttggaggagctcataggccagtggcctaagacaccagggaagcaccagcaggtgtgacaagtggtgacacacaagagaggagggggcacctagtgtgcccctggcctgggcctggtgggggcttaagtgaggaggtaggagtggcttgtgcaaaggctgaggcaggaaggagtatggggagacatgggctggtgtctgtgttgtgttaattggacttggacccttttgaggagggctgggctttccctgccttcctccagtgccctctgcagagtggggcacacaggccttgaggggttctggggtccacaggccacaggtgggggtagtaaaaacccccagaagggaaggaacctgtccaggaaatcttcgcttacctctttcaagctctttagattttaaagagacctttcatatttactatgagttgcagtttttttaagttacaaaatttctttactccatgcatgtttaaatggatagtttttgctaccatttacatcaattagcttacacactttgggttttgtgtttttgttttgtgtttttagagaaaggatctcgctttgttggccaggctggagtacagtactgtgatcatagctcatagagcttcctactcatctgcagcctcaaacccttgggctcaagtgatctttcccaccgcctcccaagtagctgggactacaggcatgtgctaccatgtctagctaagtttttttaatttttattttttgcagaggtggggtcttcctctgttacccagatgggtcttgaactcctggcctcaagcagtcctcttgcctcagccttctaaagtgagcgtatgcactttataaagggaaaaccctctctgaagagaaatatttcagacagggcatggttgctcatgcttctaatcccagcactttgggaggccgaggcaggcgaatcactggaggtcaggagtttgagagcagctggccaacatggtgaaaccccgtctctactaaaaatacaaaaatcagctgggcatggtggtgtgcatctgtaatcccagctacttgggagactgaggtatgagaatcacttgaaccccggaggcagaggttgcagtgaaccgagattgcaccactgcactccagcctgggcaacagagcgagacacccagacccagagaaatatttcagtgaaagcatgtttcatgttcagaaatttggggtacttttggttatggttttcttggccatatcttcatcatttggtgggtttagttttcaatatgtcctcctgtccctttctgattaaatcacttctgtatctcttacctcattggcatctcactgtagtccaatgaaggaggtgccaggagtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctatttggaagtggcttttttgagcacaggggatactaggacacaggttccaacaagaaacttaggtctaatttagggtcttggatttgatgattgggctccctctcccccttctagggcctgccatgtgtctgccccctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatcccactttactggacaggaagagagctagtggcaggcctgtgacttggcctgatgtctcgggggagtcggggtgggagcaagagtcaaagacaggaagcagccctaccttcagaagagccaggcacacagatgggtcctttgtggttattgtcttctccctttcccaggttccagactggctgcccgccatatagcttgtcccttcgacagcaccctctctccccactcagtggattgggtgctgtcccagggtgggggcttactctcctgcagaggcaggttctcagctggccctgagggttgtatagcttcacagctcccagagtgcttgggcatagggtggctcagatgaggaaacaggctcctcttttaaagggaaagcaactgccattactggcatgtccaaaagggggatgctgtccaggactgcatggcccagaagctccgctctgagtaactgctggtctctaatctctgtggtctcaggccaggagtctgtccctgggctgagaagggaggggagaagagggaagagatggaaaaggaacattgctcttcccagtctccctggcctcgtcatataaccttttattttacaaattcagtcttgtggcattttgctttaatgcttagagctggccccaggtgccaggcagcaggcacatttccttctgcccaaaaaacaaaacacacatgaatctgaggttgggcgtggtaagggcaggccaaggctgaccgtcctatgtggatatctgtgaggtagtgtgcctacatgtaagggtctgttgtgggtctactcccacgaaagccttcatcttacgatgaaccagagaggactgcagacttgccaaggcctagctatatgcttggagccaggatttgaaacttgatctttggggatgcacgtgcctcagactattggtgagtgtgctggtggggcactgcaggctcaggaagcagcgtgtctgcatatgcttatctgtacacaagtctgtaagagtcccccttctccccatacaatgcccccatccctgccaggcttctttttgagctggcgaaatagctgcttgtattcttctcttcatggatcatctttatttcacccaagtttgggtttgcacctagtggagccttggcaagtggccttatttgtctccactactgccagcttttgtaggctccatgtcaatggcactaggcacacaggtagacaggtgggctgtctccagacttctctattaccagcacttcccagcatggccctcacagcaaccatgtgaggtaagaggaatttccagtttcctgatggggaaactgagaccaaaagagtgagggactgccaaggcctcatagctagaatttaagagctgtgtggttctcctcactaagctgggaaggggatggtcagggaaagcttcttgaaagagcaggagaaggcagatctccatcagggcagggagcagagcaaggccccaggattctgcctggggcaccaggaagcctggcttatgagaaggttctcagtcctcagagctgacatgtgatatacagtccaggcacaggtgtgtgtggtccctcattacttcagagccccttaagaaagactgaatctatttcttcatcagagtttgtgagcgattcaatataagggactaaatccccctcactgccccaagcagcttatcttgtcactgtctaccatagccacatttggaatggtaatgcccaggccattcctgaagcccaggcagcattcactgtgggcttggggacatggtgccattcctgaagcctgggcagccatcaccatgggcctggggacgtggtgctgggcagaatgaatatgctgcagccctgatgggctgtgctggctgggctttgccttcttgggtcaaggcgagcctgggcattaggcctttgtcattatgctatacatcaggcttctgggctgctacttgtgggatcctgcccttgttctcaaagagttcctccttctcactgccccatcttcttcatagtgacggcctcttcgtacccctggcttttcttttccccagagttcccctgaatgttgtcctctcatggttctgagttggggaggagtgctaggtcatggatttttgggtataacgtgtgactttcctactcccctaagtagttctccccttctcaagctcctaagttctgggaaggtctcttttcctgccctcctgactaatggcagagaggtctgacccagactgtgccagactggatcattcgctctgtcacctgccaccagggcagaggccattcctctctggggagtctccttgtgaatttctggggaccagctctggctctctcaagaaagaggatgctgccatatttgttctgggaggcaggaagatgaagggtgaggttgggaggtagcacaggatgtggctttcaagaacctagtagagcatctcactgtgctgccagggccaggctggtgccttcttacggaagacagtacaagggatcaggtgtggccaacaggaacttgggagcattggatgcctggcgtggagctgcgctatgcttacctggttcctatctcaggcacctgttctgccttcaactgatctcaatggaaatatgtgcaggagtgcaggcctgttgactctgtgtgtgtgtgtgtgtgtgtgtgtgtgtgtgtgtacagtcacactcacctttgcaagaaggtgtgggagggggatgacagcagctccacaccggaagagcagactggtttctgtttcaaaaggcagagtttgtggttgttctgcagtttctgatctagccatttcccctgatggaagctcctccttctgtcattggaagccctgtgttctcggttaggtcttttatggcccagttctccctgcccctgtttctacccgagtataactgttcatttttgttccccatccctatttggttttccctccttctgcctgtgtacctgcctttttcatttcttcagtcattaagcaagccctggaggggccctgcctggccttaggtatgtgagcatgtatgtacgtgtttgtatgcacgaggcatcaagtgtattagtaccacaggaaggagcttctcagttgggcccttggtggaagagaagggagccggggaggtggacatttccagactaggaatcaagatgaaatagggatgggaagcaacagctattcttgccctaggtgtggcttagtgtggatggagcagagagggtgagagggcaaaagctggggaggtaaattcctgagccctgtcacaaagagccttcaaggccatagaaggtgtttgttgtttgttctccttagactggcagtgggcagcctcgggaggggcttgaatgaggtctaggggggtcagaataatgttttatgaagagccagaagactggggaaggatggctgatgggtgagaaccaggggtcagggaaaacagcagaaaaggcaggactctcagctggaggacaggctggaggggtttgctgaggggacaggtggttccaggtagaaccagaaatgtgtcggggagctagggttagggccagaagcaatgcccactgttccaggtgggatagatgtggagttttgtgacagttgctagagggacaggacaggaagagagcatctgggggagttgggccgttaggacattccaggcaggttggtgtgcagttcgggctggaagggctcctggggtgggggctggccaggcaaatgctggcactgcatctggctccgaagttaccaggccagtctgggtttagaggattttaagaggcttcagagcttggggagtactcaaagaaagtcatagctgttggctaagccaagcttttttcctttgacctaatctaccttaaatcggtgatttctgggctggaatgtctgccctccagccagcaggcagcccctccctgtgctggagagtgtgtcagagcctgtgcacctttgctgagggagcagaggagtccattggatgggccccctccatgtcccacatatagtgctgggtgtttctagctgttacgacttttgatcttaccaacatctttctgatgctattgtgttactcttatgttactctcttcacaggtgtagcagtgaggtcagagtggctgtcactttattgagatcacatagctaatgtgaggtagagctaggattttagttcagccagtctcacccagagctcgtgcatgttttttctaccaccctgccttctagagaaactcagtcaagccctttgctttacacatggtaaaactgagactctgagaagttaaataaattattcatcattgcctcaagttttagtggctgagggcaggtcatctgctattcaagcccgtgtacctctctgactatgccttgtgaaggccacgggagcatgcaagggccttggatagctaagataaggaaatggtcccaggcaaaatggtggtctgggtccaggatggttgctgctcttggacagccagtgccttggtcaggggatggggtggggattaggccccttgctgagacttgtgtggggatggctttagcagttaggcatttcagggatgcaccagtcctctgggccagagcctactttctcccagggatcctgaggcccatcttgacctacccagccctgcctctgggactttatgatttgatttgtgtgtaccttgtgtcaggaagtggtcctcatgaacagccttgggtccctatttcttcttctggagtctagctcttttgcaggtcaaaatgtctcagtgagggaacaaagatagggaagggacaccccacagaaccacctttcccccatatagccctctctgacatctcagcccttacttagcaaaggcctatccctagactcaacccagccctcttattaccagagtgactgagtggtcttggctctgcctctggggttcctccctgagagagagtgtaagaatgaggaaaccaggctgccctcctttcggtgttgactctgggagaccccagcttgatcttggcctctttgctaccttcctagttgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaaggtgggagttaagggggtagaggaggtagaggatagttaggggaatgcctgctggctcctgcccagtgggaggtatgtgccctcggggcagctattgataccttgctcacagccacatctgaggatgaagtgaacatgtggatcaagggcttaacttggctgatggaggatacattgcaggcacccacacccctgcagattgagaggtaagaaccactcctgaaggggttagggctgggagcattagggaccagggggacagggacagcagacctttgtgtgcccagacatctcccaggcctgactgtagatggagaagtggccctcacctcaggcttctctctccaggtggctccggaagcagttttactcagtggatcggaatcgtgaggatcggtaagtactgagctgtggctgtagcccagcagggtggggatgggcatccagaaccttagccaggcctctaagtagctgcccggagagccagaggacccaggggaccttaagtggggccaggagggtgggcagaaggttctgccacgtgtagctttctgcacaaagtcctctggtggccttggtgtgagctggtgagaggagccagccacatgctgtgtgccctgccactatgggcagagactggatgtgtagaactggctttgggtgtcctggaggtgagggtggccagtagcgtgtgaagggtgccctgaaactctggctctgagacctggtatggcagccagaggggccaaggagagaagggggagcaaagaccagatagtgtgggtgctgcaccatggtgaggtcctttgacctgaaagaaatgggaagccatggaagggttctgaggagaggagtgatgtgacctgacttgggttactcaagatcactctgcctgctgtgtggagagctcagttaggagctgtttccacactccaggtgaaaaatgagagggcttggatcatgatggtaatggtaggaagtggctggattttggccatgttgtattttgaagatagcgccagaaagaatgtccttaacagattgattttggggtgtgagaggcattgaggataatagtatgctgtttggcttgagcaactggaaaacagagtcaccattgactgagatgagaagatcatgggactagcccatttggagggaagcttgggttcagttcgaggcatgttaagttttctgatgcctattagctgtccagggagagatgttgagtaggcaggtggttagagtgagtttaggtacatacacagtaggggctacagattttaacttgggagtatgtagataacactgaaagccacagggctgggtgagatcacctagggggcaagcagaccaagaaaagggcagggtccagtggctgatcccagaccacccccatattagagattggaggggtcagggacaactagtgcggtaagaggagaacccccagagtgttgagttctggcagcccaaggaagaagacagtggtgaaatctgaccgttgacccttggatttaacatggtgagaagagcggtgtcaccctagcggtgaggggctcaagggaatgagagggagcaagatgactcttgcaaggagttttgctatggaggggagcaaagaagagggcagtagctggagagctaagcaggggcaagacaggtgtttttggtggaagaagtaacaagctgttcgtatgctgatgggaaagagaccacagagggcaagatcggtgatgcaggcagttgcaaccagaaggcctctgtttcctcactggaaaacaaggaccctgatagcacctacctcctgggtgactgaggatcagaggagggggcgcctatatagagccagccctccctccgcagtgcttgatccactcagtgtggcgctcagccccctcggggaattttggtgcctcctcccaggctcttggggcccagaggaggtggtcccaccctcccctcccctccttgacaccaccttccaggagagaaagccccccccttcccccttcttgtccatcctgttgccaggtctagcagtgtccccagcctcacatcctgggcaggacacccctggagagcaggggcgcttgttctctcagtttctttcctggagccaggccctgtctagccccaggaggtgcccagttgccagtcattgtatttggtggagcatgcacctcctccttcctccctctcatgggttagtgggttctgaggaccaaactcccagcatcccagtgggcagcaggtagggacctgctgccatgctgcccccaacagggaagttgtgagtgagccctgccttctgtcttggataggctgactgccaccttggcacaggcctcagcagtgccggtaggaggggaggcctggagtgtggtttttcttcctcccatgcctgacccactttactgaatctgttcacatcttccttgccagaattacaggttttttttgtttgttttgtttttgttttttttttttttttttttgctcagatgaggaactgaggtccaaagaaaggaagggactaacctcaccccatgggttctgatccagtcttgccctcaggcctccaggttcccagaatagtgttgtttacctgtccagccccaggtgggctcgacccacaggtcagaggtcatgagaagctggatgagaccactggggatgtccctgttttctcagtatatcagccaaggacctgaagaacatgctgtcccaggtcaactaccgggtccccaacatgcgcttcctccgagagcggctgacggtaagtgccacccagggctgtctgtagatgggggcaggggaagccaagagcccttcagctgggggcctgactgcctgactggcactcctgctctataccatgcaggacctggagcagcgcagcggggacatcacctacgggcagtttgctcagctgtaccgcagcctcatgtacagcgcccagaagacggtgcatgagccacctgccctccctcaacccctgcccctgctcttccaccccacaccccagctctgcctgcctcagccctgctgccctgcttaggggcttttgggtgccatttctccagttcttctcctcttgaggcctgcccccatctgctgctctagcctgccttcttactagcccatttcccacatggcctcccaggggtcttgccctgaccaggttctgtttcctgcagatggacctccccttcttggaagccagtactctgaggtttggtttggagtggggaggtggggttttccctgggcccccttcatctctccactgggcgattcttgatccaggtgggaggcagtgggagtagggaaccatgctggaccattctgggaagctgtgctggctgggagttgggttctgccttccgtggggcaccttgttgtctgttgaccatactagctagcttaccttctctccctgcagggctggggagcggccggagctttgccgagtgtcccttcctgagttccagcagttccttcttgactaccagggggtatggctgggctgacattggcccaggctggtaggttgtggggggctgggctcatccctgactggaggcttctctcatcccctgccctccctaccccatcaggagctgtgggctgttgatcgcctccaggtgcaggagttcatgctcagcttcctccgagaccccttacgagagatcgaggagccatacttcttcctggatgaggtgagcccgatgtttcacccattttttgtcaagagaatgagtaggggtgaccaggaccccacccgggctccaggagctagacgctccttagggatgccaccttgtttctacctactgtgcaccttgcccacccccagttgggacagagcactctctctcctacccccaacctaccatcttgggttggacagggcagggactcactgtctcttcccttccacatgtttctggacagtttgtcaccttcctgttctccaaagagaacagtgtgtggaactcgcagctggatgcagtatgcccggacaccatgaacaaccctctttcccactactggatctcctcctcgcacaacacgtgagtgtggctccttcaggcccacccagcttcttccccaggagggcccatctgaccatacctacctgcctctccttgcctatccaggtacctgaccggggaccagttctccagtgagtcctccttggaagcctatgctcgctgcctgcggatgggctgtcgctgcattgagtgtgcgtggggtccagggctgggggagggaagatgggaggcctgcccgcttgaccatggtgatgttgctccccagtggactgctgggacggcccggatgggatgccagttatttaccatgggcacacccttaccaccaagatcaagttctcagatgtcctgcacaccatcaaggagcatgcctttgtggcctcagagtgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgccctggtttctttaggccagtgtcctgccaactcctttgccctcacagcccagaagattgtctctgttccctatgtcccattccttcaattctgtttactgcttaaactgtggtcactggtctcccttagctcaccagggctctaacagctaactttggaggcttctcctctctcctggcctctttggtgtgaaacatttttcttgcactgctgagcagcctccataattgggccagctcgggactgcatcagttgccaccctttggtttccactgctgccacagctgtagaacccctctctgccccaccagtggctatggcctgcctcttttctgggatagtttttacagacaagaagcccccaggcccttggcttccaacagctcactgtgaggggctacttagacccagagaattgcagaatctgtttcactgtgcttgtcccccatcccgcaggtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaaggtggggtggcgggcttattgcggaagccccacacttctcagtgccttgcccaggccatggcttcagctgttgggcctaaacctgggtgaggaggtggggtgaggactggggtctgcattgccctgttctggttgcccctacagcacaagaagctggctgagggcagtgcctacgaggaggtgcctacatccatgatgtactctgagaacgacatcagcaactctatcaagaatggcatcctctacctggaggaccctgtgaaccacgtgaggactgggccaggctgggggtggtaggccagtgggtgtgaggaccctggctcacaagtccctctttggtctgttccaggaatggtatccccactactttgttctgaccagcagcaagatctactactctgaggagaccagcagtgaccagggcaacgaggatgaggaggagcccaaggaggtgaggaaccagctcaggtctgggggctgggccaggtcaggcctgggccagggtcacagtatctttgctgttgccttcccctgacaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggttcatttgaagcccacacctttggttcatgtgactgcccacacctgagctcctcaggagattggcctccctccttgaggctccctccttgagttccaccctcatttggggtggaacttggtctttggggccctggcctgttttccccagcctccctcactctgtgtcttccacaggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtgagggaagggcctgggggcggacaaggcagggcagggccatgggtggtgctggccgggcctgactctgcctgttctcaggtggtaccacgcgagcctgaccagagcacaggctgagcacatgctaatgcgcgtccctcgtgatggggccttcctggtgcggaagcggaatgaacccaactcatatgccatctctttccggtgaggggtgtggcactgggttgtggggccttgcttgggtctgagctgccctgaccctgtgtgactgttttgtccttgtgaagggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgtgagggggctgtggtagacggggcatggcaggggaggcaggagagacccagaatcttaccagtctctggatgtgtgtaacagcaagacctggtgtgttgtagaagttcgtgggagggcccctgactccagctgggagccacagtgtgggtaccaggagggtgtctgcaggaggggacatctgagcagcatctttaaggatggggacaggcacataagcagagggttcctcatgagtcaagatgtggagtgaggaggttctggggctcacactgggagaggtgcacacagtggaaactcatccacctgggcttggcctggactctgtcctagggcagatgagatgaggctacccaagagtggttgtggagcctccgcctggtggatggtatggagggcagagccacaggaggtgagaccagtgagggaaaaagtcaggacccatggcagcacagctggtgataagggccctggacagaaggaaggggtctaggaccagaagatcagttgagagactgctgtcgtcagtagacagggctggctggggagagagaggcctgttgtccactggcacctgggactcaagtgatggagaggagcggcaggaggaatgtggggagtgggaaggcttttcctgactttgggctcagcagtgaaccaacgagccactgaactaaagcactgaatatgggtagtctgtgaagggcccacctgcacatagctcagaaatacttgggagtttgggcatttaggacctgagagattttagaatcctgggctgggccttacatgtaagaatgtgaagaaaggaaagggaacagtgaggccgggcctgaggcctctgaagccgtctctactgaggtcgaaggatccctgtggatcaggtgcaagtttgctgcactgggggaaagggaagctgctccagaaaccagtagctgctttctacctctgggctctggggcattaacatatcccattgtgtcctgtttccaggagcctgactacggggccctgtatgagggacgcaaccctggcttctatgtagaggcaaaccctatgccaactttcaaggtacagctcaggcctctgggcataggaagctggggagggtccccagctgcttggggcttcatttctgtgttctgggccatctgtggtctttgtggagaagtggtggttgtggttttccgaggcccaagaggttgtgagagatgtgtggttggtgagcgaccgcaggtctcccagggccgacccactccctagcccctaccccttaagtcagcagtgaccctttaaactgctcctgtgggtgacccctgtttccttcctgggcagcagcggggtaggagctgggaggcacactggccactcattccccggcctcatggagccctgttacacaggttcttttttgttttgcctttttctctaaaaaggcctgggccctatttctcaccccctcccctccacagccaggggacctggaaggaagtttttctttccacttcacagatgagtggtagggtcccatccaggccccatatgcttccaggtcccggggaggcactcagggccactgcagaccctgccttcttggcctgccagccctgactcctgggagcggattcaaggttctccctgtggcccagggtggggcttaaggttccacctgggtcccgaggtatttcactggcagaggccctgcctctctgatcatatctgtcctggagcttccctgcagggcagtaacaagaactataactagggcctgttgatggcagtgtcatctcccactggcctgaccccaggcagggaagcccaagcacatgtgtgtgtgcacatgaagccccaggttggcagtggcagggagagcctttctgctctgactggtgcttctcacctctgcagtgtgcagtcaaagccctctttgactacaaggcccagagggaggacgagctgaccttcatcaagagcgccatcatccagaatgtggagaagcaagagggaggctggtaagccagtggtgtggtaggcccagagtccaagggccccagtggagctggggccccaaagacatgcatttgtgatgtgcttgtctcctgtgtgcaccagcagtgcctgcctcaccctggcttaggcatgggaacccctaccaaaggataccctcctcatgggagttcggggtggttgctggaggtcagcaccctgtggctcccacaggtggcgaggggactacggagggaagaagcagctgtggttcccatcaaactacgtggaagagatggtcaaccccgtggccctggagccggagagggaggtaagaccagaaccacctgagtaacagcattccctattcccagattctccttggcatgcccccatcacacagtcccaagcacgcacgtgcatgcacagacacctgtcacatgggctggtcgcacagcccatgtggccatgcacgtagtctcccatatacctgtgctacatttggcagtcacaggtacacccacaagatgtatttgtcccatgcacacggatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctgctggttggctgacatccccaggcctaatgggttgtaccacagggatgtgacagaggcttggagatggggtggagagggagacacggcctgaggaagaagcatgagtcagagctgagttggaacactggctccaccacaaccagcagtgacttgtttgagttgtagcgtcgtcatctgtcaaatgggccagcagagtagtccttcccctcatggggtgtgggaaggaggaaatgggatgagatagaactcatttgagccagtgcctgcggtgtggagtggggtggagggggtgagatgtctattcccagctgttatctgctctcgccctcccagccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggtgagattctgctggaaccttctggggggcagtgtgtgggcccgtcaggcagctgaggcctccagctcccagcacaggccccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggcatgggcgaggaaaggagcccaggaaaggcaggtcagacagactgcaggccactggtgagggagagggtctgctgtgttgagagctacagaggtaaagacaggaacgataagaacttgcaagtgccctttggattcagcagcagctaatagcccttgtgagacttttgagctgcatcagcagcatggctggcattagatggcagtgggcagcagggagtctggaatggcaaaagcagagcctttgtagggcctgtccttgagggagagaacaggtgactggggtttgagcaggctctcatgcagatggctgaaaggagcgagcagcgtgtgggaggagatggagcccaagcttagctggtaggaccagccttctggagaaggtggcctcttcccctgagcctgggggaacagagaagtattctcaagggttagggaattcctacttggtggccctttcaccaagtgcatttggtagatgggtctgtagctgctttggagagggcacccgcaagccaaatagagaagggatagggtgcttgccaggctgtcccctagaaggaaaaggtgctggcataccaggtggttgaaggactggatctgggggtctaggctgaaaagggaagagtctgaatgtaagagccactgaggccgggcgtggtggctcacgcctgtaatcccagcactttgggaggccgagatgggcagatcacttgaggtcaggacttcgagaccagcctggccaatatggtgaaaccctgtctctactgaaaatacaaaaattagccgggcatgttggccggcacctgtaatcccagctactcgggaggctgaggcaggagaatcgcttgaacccgtgaggtggagattgcagtgagccgagatcacgccactgaactccagcctgggcgacagagcaagactctgtctcaaaaaaaaaaaaaaaaaaaaaaagccactgaaagaaagtcctccaggagaggatgggttggggtgcttgtaagtgggcttctgtagagatttggcatggagatttgccatgaagagtgggtggttatatttgagttgggggcgctgaggcagtgaggatcatccttaggacacagatggaaaccaagccaggggcctgtatccccagtgcagtcacaggtaacacagaagaatcatttttaccccagcatgaggctgggtaataaatggtcagaaagtgtcatttgggagtgtggccaattccaggatccctggaaggtcactgggaacatgggtggtgatgaggagtctgtatcccccaccccccctaagagggttggagggcaaatgtgtcctctgggacagaaaagaggaaagatgatttcaggatgaggctgaggacagagctccctcatttactgttgggtgtggtgtctggaaggtacaggggaaggtgggagaggggcccagagcacctgcagtgtgggcatgcccaaggttggcaggggcttccttctcctgggcagggctgtagcctggggctacagggccttgtgtgtgtcaccagctcactgaagggaagataatggaacggaggaagaagattgccctggagctctctgaacttgtcgtctactgccggcctgttccctttgatgaagagagtaagggccagggcccaggcggggtgtgcatgtgcctggagggcctggtgggtgcaaaaagagtatttaggtatccccccaacacttcctgggtgggcgggctctgtaagtgttttccctgtttggcccagagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctggtgaggaagtcccctgtgaggagggtgaggaggggcactgtggggcagctggactggaatacaccataatctgcctcttccagacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgggtgctgctcatctgggcttcagggtaggaaaggggctgcttgccgttggagtctgtttatgttgagttctccaaaagtaggtattttcaggcatcaaggtggtcagggtgggtggggcctgagctgagtctttgaaggggtgaagatagcatgcagtcactgtatgcatctaggacgtgcagagccatggtgtgacttgttctgatgacttgttttgttctgatgagatcttttttttccctaaggggaggtcatttaaaagatttctgtgttaaaatagtaatggatttaacatgaagtagattgcaaaactcacatggaaattttggctaaagctcagacttcagataaactacaggcagcagctgctctggacagcttagggtccctgatgtcgtgagggactccatgggcagtgtcccgggggcccagcagagggcgcgctgcctccactccacagatgctgactgagcctccgcagtggggaattggagggagcaggaaggacaatcccaggcccttctttgtctgcctacaggtgctgggggcccgacatctgccaaagaatggccgaggcattgtgtgtccttttgtggagattgaggtggctggagctgagtatgacagcaccaagcagaagacagagtttgtgggtcagtctgtcttcccagtcatcctcctcatcctgctggggcactgcaagcctctccccaccagtcatcccatcctctcccacggtgacctgaagccttttgtcgttgccttcacagtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggtgaggaccattcctggaggcagtgcccctgcaatcttgctggcagggtggggctgggccccttgctctgtccctcgtgggctgagggccaggcttttcctcctcctaggatacagagcagtgcctttgaagaacaactacagtgaggacctggagttggcctccctgctgatcaagattgacattttccctgccaaggtatctgcagcaggggtgggctggcctggggtaggtgggaggagagccaggcagcagcctctagaagtgcagaggagtcattgaccctcttgtgcacctggcttcgttgaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaaggtgaggaagatggaggggtgctagagccaggaaggcagtggctaggtcctccttcttcagtgtttctttctcctgggtagaaaagttgtaatattgtctggcattgggctgcaaggccctgcctgccagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttcctttgacttgtatgctctttcgggggctcaggaaagcctgttgcatgggacatgctcactagaaacagtcgccagatgattattctgcagtagaagcaggtaggaaatttctggaaatttctcaggttaagcagcaagagctgtaacccctcctctgggctaacaggagttgtgggtccactctctcctgcccaccctctgagggtgtgtctgagcagagtacatcctgcctgggttctttgtggccagccagttttggtggtgagctggaaacaaccagagcccctttccagttccacagaaacctctcctttcaaaaatgttgcattcagttcgttaacactgccaggtgccattctgattgcctctaggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacagcgatagtgctcaggttcttgtgtgactttcttttacagcttcacagtcccagttcatagagaggagggtggctttttcccatacacaagaaggtggtgggtgggaattcacctgggccctcatgatccatgtttcctctctaggtttttatggcctggagagaaaggtttcctatcagagaaggaagaggactgtgtaggcccttctgttagggcccatccacgttggttaggacgtccttggcgtgtttgttagtgttgacccttttagttttcatcaatacgtatctctatttgctgaacaagtgtctttctggaacacaacctggggaacagacagctctgcctttcttaaggcagctttgtagacctgaggctcacctctcttgggctctgtaagacattgcctttgcctcactgcaaatgttttgattgttcttcctagtggaaaacgtgccaactctcaagcaaatttaaagatcattttcacttcaagattcctccagacctgacaaatgttgattgacccagaaggcagagtgtttgttggtggggaagacccttacttggggccgaatgctttggcatcaggagttgtttgccccatcccatgcatgcaggccgtgtccctacagtgcgacagctcagggttatgacctgtggagtctcaaccctaacagcacattagcaccacttggg

SEQ ID NO: 16013 - DNA, 78850 bp, Human
ctcaggaggttgaggctgcagttagctgtgctcatgccactgcactctagttaggtgacagagcgagaccctgtctcaagaaaaaaacaaaaaagatgcggaaggaggaaagagggaagaaaattgagactggaagtcatagacccaccacttttgtccctatgggtgatagcaaaatcacctttgacgagattgtctgattgtgcgcagctttgggtttagggagacctctctgcatctgctcctttacccaaggaggtatgggatccacactgcttggaagttagaaagaaaagatcacttttagcagagggctggacaatatctgaatgttgcttactactgtcttggatgggcactaaagggacggtgaaagtcctttgactatttttggtgttctgaaattcagtgtcattgcacttcacaagaagcaatgtaaggaggcaagtgtcctcccaggcttcgctaaggctccaaagccttgtttggaggggcctcttcagacacagcagctcgtattttgaatttatattccgttggcaagagagattgagcaattattagattgagagacatttaagagagagagaattatttttaaatagtggggcggcagtcccagagtgagcgggagagagaagctctgtgcacctgcagttccttcattcattctcagtttcttggacctctcacaacgcgagcataattttcgctgagtgtgcagaagttcaagattctttttttttttttttttttttttgagacagagtctcactctgttgcccaggttggagtgcaatggcgtgatctcggctcactgcaacctccgtctcccgggttcaagagattctcctgcctcagcctcccaagtagctgtgattacaggcgcccaccactgcatccggctagtagagacggggtttcaccatgttagtcaggctggtctcgaactcctgacctcaggtgatccgcccacctcggcctcccaaagtgccgggattacaggcgtgagccactgcgcctggccaagattctttactggccaccctctctccaacctcccatacaatacagctgctaaaaaccacttagtttatctagatctgggtgaaataaatagtaatctggcacttctcgtctttttttttttttttttttttttttgagaccagtgtctctttgtcgccaaggctggagtgcagcggcgcgatctcagctcactgcaatctccgcctcccgggttcaagcgattctcctgcctcagcctcccgagtagctgtttacctacaggcgcccgccaccacgcccggctaattttttgtattttcagtagagacgggggtttcaccgtggtagccaggatggtctcgatctcttgacctagtgatccgcccgcctcggcctcccaaagtgccgggattagaggcctgagccaacgcgcccgggccattgtcttttatctcactacacatttttctaattttatttattgtgtattttacttacacaagaatgtaagctccacgagggcagggatttttgtcagttcaccactacattcttagctcttggagcaatgccttgcatatggcaagcatttaatgaacatttacagatggaggaagaaacaactgcaggaaggagagaaaggaaggccagaggcaggacaagaggaagaagcgagagcaaggaaggaaaaaggaagtggaggaggaaagaaggtaggctgggttctcccagacccgcttcgagtccagcaggcagcgcgaaactcccaccagaactacaactcccggcaggccccgggactcagggcgggccgctgcggtccaggcgggacagggcgctcctcccgctgggcccccggcgtgccttgcgagcgcaggctccgccgcagtgccagccggaacttgtggttcggaccgtgggtgggggtggggccggggccgggcctggaggcgggcgggggccggggggcgggcgcctgcccctcccccgtcacttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtgaggcggccgggccgggccgggcctggtggggccctcgcgggcgccgccgcggtggggaggtgggcggcgggtggggcctaggcctcggcgggcccgcgcacccctccgccttctcccgggcctctctctagcccgcggggccttcccggaggaggcgggtcctcttgcgttccctcgcctcggggcgccctgaggcctggccccgggcgcccccatcccctccagccctcaccggtgccacaaacaggtgctgcggccgcctttcctcgtcccgcatggcgcgcgcggggatgccgaagttattcccggggctggggcgcaggcgggggggaggggggggtccctgcttcaggtccccgagggctggagcctctcagtgtcgccggcccaggtctgtagcttagtggttaagagcacggcccaggtgtccaaaacgggtgccaaacccggctctgccccgttaggcaagacacttaaaaagtctttgtgtcttggttggaaaaggggctgctaataccgtccctgcctcttaaggttcagtgaaatggggcgtgtaaagcgcttatcagagtgccagacccacagcgtgtcccagtaaaccgtctgcataatttattagcgtgatatgaaggtataatttaatgggcagagtggatagaagttgacctacctatccgtttgggtttcttagaggctgcagtgttccgcgtgcccatgtccagagccagggcattgttttcagttgttaacatctgaaaggggcgtacgcttaattgggacactgtagttgacagtctgtaaacgatggatgctgtttctttccatctccgcttaggcaactgcaggatattcaccatctcccgcaggatgagcaacctgtccatttccccccgccccgccatcatccagcttcttcttgtcattccatttctgggaaagttgctggcagaagcttcccttgagttgagcaaacctatctagagcacttgctgtgtgttgggctctgaaggggggtgtacggagatggaaaaatttgtctgtcttgtcttgctctacacctcgataagttttttttcacggaagctttgcttatattcacccctccctgttggctgactttccttttaagcccttgccccgcctccgtgttgcagtattgcttgtgtggaagttttcttctgttccgcgaagatacgtgcttcagtctgttctgccactgttcttcggctgtgtggaagtttttaaggtcacacttctcttctgcttgtagctttcattgttaagagcgtggtggagttaaatcaggttcccggttgattttggcgtttcaggaatccgtgcttaccaagtgtaaattacattgctacttgttgaggtaaaaactaaaaatacagttggagtgtagagggagcagtttcggttatcctggtgacaggtgggatttttagaacagcaactttactaaaacatactgggtttttaaaaattctgtacttagttttataggtgtactctaaggaaatgcaacttatgggtgttcaattttatatgagtaaggagtgtgtgtttacctgagtgatcctcctgtatcttaggattgttttaggcattaaatttccttagtgaactgaaactattttgatttatacccatctcttaacacacatgcggcaaagtggcctccttgtttttgacattttcctagaattttctgacagtcttaccattgtttgtaatttaaaatgtttgtttgaatttttttttttttttgagacagtctcacgctgtcgcccaggctggagtgcagtggcgcgatttcggctcatttcaacctctgccaccctggttcaaaagattctcccgtctcagcctcccgagtagctgggattacagacgcccgccaccgcgccgtgttaatttttgtagttttcgtagagacggggttttgccatgttggccagactggtctcgaactcctaacctcgtgatccaccctcctaggcctccataagcaggttaggcgcggtggctcacgcctgtaatcccagaacttttgggaggccgaggcgggtggatcacgaggtcaggagatggagactatctcttgagcctggtgtggtggcgggcgcctgcagtcccagctactcccgaggctgagacaggagaatcgcttgaacccgggaggtggaggttgcctgggcgacagagagagactctctccaaaaaaacaaaacaaaaaaaacacataagcaaacaactatacaagcagtataaagcatgtctaatactgccatatcacaatggcatatttcaatagggaaatggtattttaaataccattttttaaaaaccttttattctggaaaacatgcgaaactcgaatagtatggagaaccccatgtgttagtcactcacttagctttgacaattattaactcatagccaaggtcggttttgtttcatgttgtatccccccacacaaactagattattttgaaacaaatcttaaacattgtgtcacaacattagcgattttgacttttaccagattgccccagattaaggtcacaaaatttacttttagtagaataatagttctcatttttgtttgttgggcttcccttctctgtttatacatgatttctgtacagcagaaaagaagaagaaaattaactcttgatccaatgccttcagctcctcaaaatcaaaatacaaccttgctgctttattgtgtacaaaagcaaaaattcttgagctattaatgactataattgaaaagcgaacaaatacagatttccccagtcctgttttggcagagacctgccttttaacccactttaatagagataactttgtgtcaaagttaaactacagttaataattcataatgaaaacttaaaatgtttctttacagtagttgtgtaaagatactgctgttaccttaggttaagaattaagcaaaagataatcttctaacatagaattgttttccaaagtgcccccgtctgccctatttccaaataacaaatttagcaaatatgaatgaaaccttaatttttgtgaatagtatgaaatcacagcataagtgttcacgtttttctttcttgtgtctaaaagatctctcttacaatggaagttgacaggaatattataaatattataaatgtctttgttgcataactttcaaatttctggtcgtgaatagttttcagcttttaggtctgttatttgagttttgtaggtgtactttgagcttgatcaggtacagtggaaatgttacatgttatgttttagttatgactacctggaagatggggaaagatacacctcttaaaattgatttaggaaagaaacgccaatttagtatctgggaaaggacacaacacatttttaaaaatgtgtagtgcttcccattaagcttaacgtaaaacttttaagcattgagaattgttaccataaatatagtttcttgagaataagttgctctcttttatgtttcagccagaaagtccatgtatatacagattacagcaggtccttgaataatgttgtttcaagataatgttgagaaaaaaaactgtctgtggagtttacacgttctccctatccctgcatgggttttctctgggtactcttgatttcctcccacatcccaaagctgtgcacgtgaggttcactggtgtgtggagctgtgtgtgtaagtgtgagtgctttctgcagtggatgtcctgtccaggactggttccggccttgcaccctaagctgctgagataggctccagccaccccaaccctgaactggaataagtggtaaaaaaaaaaatttttttttttgagatggagtttagctcttgtcacccaggctgcagtgcaatggtgcagtctcggcttactgcaaccccatgcctgtaatcccagcacttttggaggctgaggtgggcagatcacctgaggtcaggagttggagaccagcctggccagcatggcgaaaccccgtctctactaaaaataaaaaaaattagccgggctgggtggcgggcacctgtaatcccagctactcaggaggctgaggcaggagagttgcttgaacctgggaagcagaggttgcagtgagcggttatcgtgccattgcactccagccggggcaacaagagcaaaagtacttctcaaaaaaaaaaaaaaggcatgtatacttcacatttatttcagtgtttaatattcgaagtgtttggtctttatttaaaagtttggtgatatttttctgatgagaaatatgccctagaacctaactcttgtttgtatcaataagcgtgtgttagtcggaagtctcagtttccaagaacctaccccttatgttaagagaggatttactgtattttaagtttagaaatggccatgactcatggaactctcctccatccccattctaaagtccagatcattgatatcattctgggtgttatcaaaatggatactgcttcatccagtctctctccccaataccacaaggtagtctcagtttgtggggcaactttctttgagcctttttactggattgagtaagagtgtaattcagtataaagatgaaactttcatgaaaagggtatctttttgtgggattccacaagtcaatcccagagtttgtcgcccaggctggtcttgaactcctgagctcaagtcatcttcccacctcagcctccttagtagctgggattataggcagaggccttgttttcatgagcctctaaattggatcttcttatttgatgtgatacccagtgacacagaattgttcaatttgaggaaatataaattcctcccctctcaaataagagctttggagttgcttttctctcagaatgggattttagagctttcaaaaatgtttagagaattttatgacagatttgtttcacactagacctataacaggttattttacattgacttctggtgatggagacatttgtggttgaaatgcttctcgtgtaattttctacatgagcttttctttaaataaaacttcaccagagtcaaggctgtataccatttgtgctgttccaaaaaatataaattgccagttatcagttgaactatgagaggacatgttagttgctatggttatttacccccaccattttattatgaaaaatttcaaacatataacaaagtttatgaagttttattgtacatctctttagataccatctactttctatttttgcctccctgtttcatggtgctgaacaccgtctactttttttttttttttttttgagacggagtctggctctgttacccaggctggagtgcagtggtgtgatctcggctcactgcaagctccacctcctgggttcatgccattctcctgcctcagcctctcgagtagctgggactacaggtgcccgccaccatgcctggctaatttttttgtgtttttagtagagatggggtttcaccgtgttagctagaatggtctcgatctcctgaccttgtgatccgcccacctcggcctcccgaagtgctgggattacaggcgtgagccactgtgcccggcataccttctgctctttgtcatgaacattttaccatacagtattatgaagcttgaataatgttggccaaatccattgttctcacctgctaaggagataataggattataaatatatagctgtgttgatcttatcaaatgccacgggatggatgggcttggatatctgtcttgttgacagcttaatgctctgaactagaaaaccttactgcagagaaaagtaatatttttaaagtggtaaaatgggaattactgcaaatagcttaatttgttttttaagtgtttacattcccatactggtgaataaggttgatgtaacagtgatttatgtcaccagataaatggaagtagagaaaaatttctgcaggctgttaattgctgtatattttctgggattacatatgtttatttgttaaagaagtagactcagggaactccctcaaagtatatttactggaagcaaaagtggaaaaatctatttgagaaagtgtttgctttcgattaaaaattagtcttctgaatatcaaatctgtaacccatctggcatctgtttaatctggaatctaatttgggaaagaagtgtgatgactatgtgggtttataacagtaatggaagcaaaactggccattttattatgatagaaattttgtgtcatgtctcccagacaataaaggctaagaaaatctatttaaatacattggggtcttttcccctgaatgaacatgattgctgagggttaaaccttcattagattgcctctgctttttttttttttttttttttttttttgagatagtcttgctctgttgcccaggctggaatgcagaggtatcatctcggctcactgcaacctccacctcctgggttcaagcaattctcctgccttagcctcccgagtagctgagactacaattgagcaccaccacgcccggctaattttttgtatttttagcagagatggggttttgccatgttgcctaggctggtctcgaactcctgagctcaggcaatccgcctgccttagcctcgcaaagtgataggattacaggcttgagccactgttcccggccttgcccctatacttgatgtagctacagaactggttgctcagtgagtgggttggttttagtcagcatattctctgatcctatttaaaattttttacaagtggagtgttgctgtaagttttatagatgtttatgtgtaaggacaggtttagtgaatttgctggataataatatttactgctattgagctcttaccatgtgccaggttagaattacagggtgaaagttattttatgcagaaaaggaattaaaaggtcaggttgaatttacctaataatataaaagttgcagttcatttagctctttccttgaaccaaagaaaagggtttcttagaccctttatgttgtatttctaatactcataaacatctttgcagcgtaaagctcataataattgctgaggatgctgatgcgcttccgaggggccagataactggctcagagtcctgaggcaccaagtattagttctagagcacaggctggtctggctccaaagtcagtgttctttccactgaaccatgctttgtctctaaattatgcttaggtgctttttgtttaggataattgattctgcttgtcactggtggccctcccctgactctccccaccgcagcagctaggatgaattttgctcattagaaccctagatcaatttgaaagaaagtctggttaagtaatagtcttttagatggacccttgaaatagctttccagtttacttttatttgttatgtcaaattaagctaaaacttaaagctgatccacaggtttgtgtgtggggaggggctgtcttattaacctttgtgttaaaggaggccagctcctaaattactgctatcgtgtgtcatcaggtttgttaaaaattgctggcatggtggcccacgcctgtaattccgtcactttgggaggccaaggcaggcgcatcacctgaggtcaggagttcgagaccagcctggccaacatggtgaaaccccatctctactaaaaatacaaaaattagctgggtgtggtggtacgtgcctgtaatcccagctaccccgggggctgaggcaggagaatggcttgaacccgggaggtggagtttgcagtgacctgacatcgtgccgctgcacttcagcctgggcaacagagcaagactctgtatccaggggggggaaaaaaaaaaaaagaactgtagtccaggttgttgctaaaaaaaaaaattcatttcttctgaattctaacattctgctttagtggaaatgagttaactaagcttccaattaactttataggataggtgctggttgtcctctttgcttcctagccctttctaacatccctcttgtggctaatactgttgggagtatttagtacagcttcctgtttggaattgaactgcttcctgaacaattttgttttacttttgtttgaaacggtgatctgaatcagaagcttctttggtattccacctgggcagtcttctcttatggttagtcttgaaaggctggatcagtgaaattaaatctgcctttggatgtgagcttttagtgaaatggtgtctgaagttccattttgtgtttaacctcaactgaggctaccctgtagtctgtaatgacatagcatgtctcattaatcactaataggtgttggaaataccccttggcatgaagtgagcagataatgctgcttacattgtcactatattagctcccttcagagatgagctttaggatctaactagatcttgtctgattctctcctatctttgctgttttgaaatccatgccttctatagattacaattaactgaggcatgaattttctacccttgcagattccaccctgattcaaatagggccattgtctgctgaagccattgtgattttatgcagaatgctaggcagtcctttcctctgtcagaaagaacaatttatatgtaataataagtctcattatgcttggaagcttattttccttgttgcacaattgaaccaacctgctcatgaaagctccatgaccctttacctagatgacagtcaaatatagttaggcaaataagtttccttttggtttgtcattgagtaaacctttgcaacctgtaatgtttagcaagtgactacttctgtatagtaattttccttttagttgagaatttattcaagcaccaaacataaaaaagaataaaagtgaaataagctttcttttgcataagggactttctataatttgctactttttatcttcttttttttttttttgaggtggagttttgctcttgtcgcccaggctggagtgcagtggcgtgatctcggctcactgcaacctccacctcccaggttcaagcgattttcccacttcagcctcccgataagctgagattacaggtgcgtaccaccatgcctggctaattttttttttttttttttagatggagtcttgctctatcgcccaggctggagtgcagtggcgcgatcttgactcactgcaagctctgcctcccgggttcacgccattgtcctgcctcagcctctggagtagctgggactacaggtgcccgccaccatgcccagctagttgtttttttttttttttttttagtggagacggtgtttcaccgtgttagccaggatgattttgatctcctgaccttgtgatccactcgccttggcctcccaaagtgctgggattacaggcgtgagccaccgcgcccggccatgcctggctaatttttatatttttattttattttatttttgaagcagagtctcgctctgttactcaggctggagtgcagtgacccaatctcagttcactgcaacctctgcctcccgggttcaagtgattgttcagcctcagcctcccaagtagctgggattacaggcatgtgccaccatgccagactaatttttttttatttttagtagagacagtgtttcaccatgttagccaggctgatcttgaactcctgatctcaggtgatccacctgccttggcctcccaaagtgttgggattacaggtgtgagtcactgcgccggcctaatttttgtatttttagtagagatgggatttcaccatgttggccagcctagcctcaaactcctgacttcaggtgattggcccaccttggcctcccaaagtgctgggattacaggcgtgagccacggtgcctggtttagtatgcattcttgactggggaaaattgcagtggtaagtgtgcactatatagatatattgataatgatcatgatggctttggattatcttttgaaattggaggatttcaaaaaatagatttgcatatggaaatgtgcatttttgttggttttttgagatggagtcttgcttcattgcctaggctggagtgcagtggtgcactcagggctcactgcagcctcaatcttctggtctcaagcagtcctcccatctcagccttccaagtagctgagactacaggtgcatgccatcatgcctagctagttttaaactttttggagagatggggtcttcctctgtttcctaggctggccttgaactcctgggctcaagcagttctgtcttggcctcccaaagtgttgggattacaggcgtgagccaccacacctggccaaaacatgaatgtttgtatgaatctcagctatcactgtgtaaaagtatttgagatccaaatgactgctgtatttctcccctctctctctctcttctttctttgctaagttgatgatggttattttttagcattgtctttatgtctgactctaacagctcctttttccgttcttatatttagctttttttatgtgtgttttaaaattttttttttgtttttgagacggagtctcactctgtcatccaggctggagtgcagtggtgtgatctcggctcactgcaagctccgcctcctgaattcatgccagtctcctgcctcagcctcccgagtagctgagactacaggcgcccgccaccatgcctggctaattattttgtatttttagtagagacggggtttcactgtgttagccaggatggtctcgatctcctgacttcgggatctgccaccctcggcctcccaaagtgctgggattataggcgtgagtccacatgcccggcccttaaatttttaaattttattttaatagagacagggtcttgccatgttgcccaggctggtctcaaacacctgagctcaagcgatccacctgcctcggcctcccaaagtgctggggttacaagcatgagccatcacacctggcctttattttttacttctgctttgggctagaaaactgaacaccctgggccaggtgcggtggctcacgcctgtaatcgcagcactttgggaggccgaggtgggcggatcacgaggtcaggagatcgagaccagcctggctaacatggtgagacccatctctactaaaaatacaaaaaattagccgggcatggtggcatgcacctgtaatcccagctactcgggaggctgaggcaggagaatcgcttgaacccgggaggcggaggttgcagtgagcggagatcacgccattgcactccagcctgggcaacagagcgagactctgtctcaaaaaaaaaaaaaaaaactagacaccctgcttctcagaataggggatagggaatttggaaacaaaacaaaaactagacacccaaacttacaaaaattgttcaacatagaaaacttcttggctcaggtgaggcccctattggtaaaaggcatgggctatgttagaaggtctttggtatttgggctgctcagaggcctttttcagttcccattcatgccagtctttgaatagctgagatattagaacaactgagctctagactggaaagttgttagtataatatactatctacgaaaagaacctgagctgttaaaataccagaaaataaactagagctcatgatttatttctggaatcaatcagacaatgaacagcaattttttattgcctgttaagccatagtagcagtgagaaactgaaacaagcaaaaacacttagtgttgtaagaatgtataaaagcatctcaaggtaagaaattctgtgttactactgacaactaccatttaagttgaggaacctctagataaatcagaccgcagaatttgagaattaaactcaaattctgtaatgtaaagttcacttctaaaaatgattatgatttggacttattagagataatgtgcttttttcatattctgcaatttaatatgccactatttatgtacccaatgccttttggtaaaattttccataaaattgtatttgggtcaccaagcatatgccaacgacatttacgaataaagtggtaggtataaagggaaagaaaacacaggtttgaaaatcagtcttatgtgatcggacgatatgtaatgtacagttccttttaaaaagcattatcgccgggcgcggtggctcacgcctgtaatcccagcactttgggaggccgaggcgggcggatcacgaggtcaggagatcgagaccatcctggctaacacgatgaaaccccgtctctactaaaaatacaaaaaattagccgggcgaggtggcgggcgcctgtagtcccagctacttgggaggctgaggcaggagaatggcgtgaaccctggaggcggagcttgcagtgagccgagattgcgccactgcactccagcctggacgacagcgagactccgtctcaaaaaaaaaaaaaaaaaaaaggcattatgaggttgggtgtggtggctcatgcctgtaatcccagcactttgggaggctgaggtgggtggagcacctgaggtcaggtgttcgagaccagcctggacaacttggcaaaaccctgccatttctactaaaaataaaaataaaaaaattagccaggcgtggtagcgggcacctgtaaccccagctactcaggagtctgaggcaggagaattgcttgaacccgggaggcggaggttgcagggagccgacatcacgccactgcactccatcctgggggacagggtaagactccatctcaaaaaaaaacctgaacaaacaaagcctaaacattatgagatattcacattactctcatcagggaataattgggactggaaaaggaaagttctgctgtctcttataaatgtgtctctgcaaaatattcttcacccagcttccaggcaattgtgtcttttttttttttcccagaggagtctcactctgtggcccaggctggagggcagtggtgcgatcttggctcactgcaacctctgcctcctgcattcaagccatttttgtgccacagcctcccaagtagctgggattacaggcctgcgccaccatgcctggctaatttttgtattatttatttattttctttgagacggagtctcgctcttttgccaggctggagtgcagtggcgcgatcctgagtcactgcaacctccacctcccaggttcaagcgattctcctgcttcagcctgccaagtagctgggactacaggtgtgccatcacgcccagctaatttttgtatttttagtagagatgggtttccccatgttggccagggtggtctcaatctctttttttttttttttttgtgacggagtctcactctgtcacccaggctggagtgcagtggtgcgatctctgctcactgcaagctccgtctcccgggttcacaccattctgcctcagcctcccaagtagctgggactacaggcccccgccatcacgcctggctaattttttgtacatttagtagagacggagtttcaccgtgttagccaggatggtctcgatctcctgacctcgtgatccacccgcctcggcctcccaaagtgctgggattacaggcgtgcgccaccatgcccggcagtctcaatctcttaacctcgtaatttcccacctcggccttccaaagtgctgggattacaggcatgagccaccatgcccagcctaatttttgtatttttagtagagatggggtttcatcatgttggccaggctggtcttgaactccgggtctcaggtggtctgcccgcctcggcctcccaaagtgttgggattacaggccatgagccaccatgtctggccgcttgtgtcttttgaagactctactgcatgctgcctcaaaccatgacgtcatgccttcagtcttccctacttgtaaattataggtttccccaaaacttgagcagtatgtcttcagtttcagaaaaaagacctaccctactaaattattattattttttattttccagagtttattaaccacttaacctctcagaactgaacaaagacaacattgttcctggaacgccctctttttaaaaaaggtacatataatttggctttataatttctggcctgttgataatcagtggtacttttgaattctttaatgagttgtgtggagaatgatttttacttctggctataatattagagaaacaaattttatgcagtttgaatttcatctttactcttgatttaattagaaagtaagtacaggaaaagttattggcaagaatgtaaagcctatgttctttaaatatagagacatgagaattgatgactgaagctgtcattaaacatgactggctcaataagcttcttggtcatagtatcttttgtagtttgctttttttaaaaaaaccctttgatttctcagattgtttatgttaaacatgattttcaaactcatagaacgaatttagcattgttttctattgtgagatagggttacgaatcaagcttcgttgaccactagcagcttgtgaacattcagataaaaaaggagttttctaagagtgttcaagattttctggtcttttgtcagggcaatgcaaaatacactatgtgggttaatactgcttcctgcttttaacactttccctctagaagctgaaagcacattgctgtaccatatctctgaggtagtaattagtagacaagttaacctactttgaggatgaggaaatggaagcataaggaaattattgaagttgtacaaagctcagtgaatggttttaaactcaccacactggatttgtataatgcttttcttttctttctttctgaaacggagtttcgctcttgttgcccaggttggagtgcaatggcgccatgttggctcacctcggcctcctgggttcaagcagttctcctgcctcagcctcccaagtagctgggattacaggcgtgtgccaccacacctggctaattttgtatttttagtagagacagggtttcaccgtgttggtcaggctggtctcgaactcctgacatgaggtgatccacccaccttggcctcccaaagtgttgggattacaggcgtgagccactgtgcccggcctaatgcttttctttttaaagaattgtattatcggctgggcgcagtggctcacgcctgtaatcccagcactttgggaggccaaggtgggcggatcaagaggtcaggagatcgagaccctcctggctaacacggtgaaaccccgtctttactaaaaatacaaaaaacattagccaggtgttggggggcgggagaatggcgtgaacccgggaggcagagcttgcagtgagccgagattgtttcactgcactctagcctgggcaacacagcgagactccatctcaaaaaaaaaaaaaatgtattatcatgcctcaggattcctttagtgttttgactcagtgattgctacaagtgaggctttgtcaaatatcctattataaagtgttttggggaaactgaggcacaggggagtgggttgccaagagctgggagtggaattgaaagctacatctcagaagtttgatctgatttaacattgttggttgctacttagcagcaagggtggtttcttagaaactgagtcttggcactggtctgttttgcatgaagatggtggtaaatgcagtcgtgtttctaggtagatggcacatggttacagattacagtttcccttttctgaaaggaaaagcctgttaaccattatgttgaaccaagccccttcatagtcaagaaaatatcacacagaactacttttaaaagtctccagcagatcatgaacaggtattcatttttattgtgttaaaagttttctatgtttgtataagtttagattaaaaactgtttacaaatgtatgtgcttgaattttgttatttttgagaatgtctcctagagaaggagagacggaagcttgataaagttttaaaactagaaaagaaaataaggcttatagttttttaggctatagaggtaaattgtttttcactttagcatggtgtgatgggttttctaggatgaaaataatgaaaatctcttttaggaagtgtttctttaagcagaccatctgacctcccaactgttacatttgtgtggaaagaaagtcctccattgcccatggcattgggccaagtgtgagacagggaccacattcagtctcacttgtattgcaagtgcaaagatcctgaacagcctgggttgtttccaggcattatttttggttaattttactgtcttgcaagtgagtgtgcctcctcagggctaatctctgtctttgtcttgagcatcaggtacttagtgatttgtttctttttttttttttttttaaagtagtttggtcatatttcttttaaaaaacgttttattattgggtgatttagtatatataggcctgctattggacattatttgcttgacattgaccttaaagcggtcattttggaaatgatcctataagacgatagtgattgacatgcttctgtactagcgtctgccctgcctgcaggtatttggataatgtttggagtcaatgaattactattttggggggctgggagggagaagtaatggtggagagtgagtttactttcagaaaacattcaaccatattgcagcaagaaagatgtgtcagaaaagaatcttagaaataactggtataggctgggtgcggtggctcacgcttgtaatcccagcacttcgggaggccgaggcaggcggatcacaaggtcaggagatagagaccacggtgaaaccccgtctctactaaaaatacaaaaaaaaaattagccgggcgtggtggcgggcacctgtagtcccagctacttggagaggctgaggcaggagaatggtgtgaacctggcaggcggaacttgcagtgagctgagatcgtgccactgcactccagcctgggcaacagagcgagactccgtctcaataaaaataaataaataaataactggtataaggaatgatgtgggtattttaggtgtatttaaaggctattgaaaaggactttattttgtagaaaaagtggtttattccttgatgttttttaattgaccaagtttctctgggagtggagcctctcaacaaactaaagagaacagaataatagatttacatgtgattgctgaaagatgtcgtcttgtgtctttgaggaagagtttaacacacagatcctttccagcatttaagaatgtgcaatctgccatttatgggttcacatgtaatagatgcttaataagtttttgtagactattgagtgaatatattttagaattgctattgctttataacagcgaggcacaggagtgctcctttgtatctgtatatccatcttacatcagatttaccaaaggacttgcaaggggagacatttagtgaaatgtttgtgacgatctgaaaaggaggcttctccagaattgggatgacttctttccttctttttttttttttttttcccagacacatcttgtttggaaatatcacttattatgaaggagactgatatgttgattaaacaaaagtatagctactgcattataagttgtgttaatccggtttaaaaattacttattaaaaatgtttttctggctgggcacggtggctcatgtctataatcccagcactttgttgaggccaagacaggcggatcacttgaggccaggagttaaagaccagcctgaccaacatggtgaaaccccatttctactaaaaacacaaaataattagccaggtgtggtggtacacacctgtagttcccgctactcgggaggctgacacaggagaatcacttgaacctgggaggcagaggttacggtgagccaagatcgtgccactgcactccaacctggacgacagagtgagactgtctccagaaaaaaaatgtttttccataattgcttaagtatttcatagtacaaagatttaacagtctgtaagttgaaagtggataagactaaccatgtattagtagcacaagataattaaaagactaagcacgattgcagatagttctgtaaaccatttctagaagggtctgccttcttgtatattaaatcactcggactgtgctcagtatggtctagtcttggtaggttcactgctgagtgctgaatacacattttgtgaccactttttagtacatcatgtataatttaaaaaaaactttcgtagcgctcatgtgcccagattctccttcaccacaacccatagaaactatttggcacttgtaaaacggtaactgccagccaaggcaagattctgtttttatgagaagatttttgtgttaccaagccaatcttaagaaccaggaggacatggaattaaggaatcttttaaaagaaacacctataactctatcattttgcagcttgtattatggtgcttatgtatgctatgtaaaattagggcttgagcctaagatgagtatgttttgttgatctggtgtctaaagcccttcaaatagggaaagaaccaggagatgaaaggtcctcatctgtgtgggaggcagaaaggcaggaaaatggcagcacaacacaattcacagtaagaggtgttttccagcaccagcgagatctgaagaatctttgcgtttcaaacttctcaacctaattttactgtgtataaaatagtgtttgtctctaagaagactctaacaaaacattttgatctctcaagtccttaatttacctggtggaaaacaatccttaaagacaggtttaaaggaaaagacttatttgcatttaaggacttagtcttcaggacagtactgttgagcaacaggtttagaatttacacagaagttctatttccaaagttccacagttccttgaaggctgctatgaactatatctatatcagtaatgaaaaacttaatttgttccttgagttatgtgggcaaatgatatattttcccccattcatcactgtgatgtctgttccggcttctctttgggagaggagcatctgtttgggtgctaaaacattagcatcaggccaggcgcagtggctcatgcctgtaatcctagcacttagggaggctgaggcaggaggatcacttgagatcaggagttcaagatcagcctggccagcatggtgaaacgctgtctctactaaaaatacaaaattagccgggtgtggtggtacacgcctgtaatcctaagtactcgggagactaaggcaggaaaatcgcttgaacccagaaggcggagtttgcagtgagcggagatcacaccactgcactccaccctaggcaacagagcgagactgtctcaaaaaaaaaaaaaaaattagcatctattttttagggcctttcgagatagaaaggggattttcttttcctgtctaagaatataagctacttgttacattagtaagattgtattgtgtgggttagtatatgtgtgcttgtaacagtatccctggctcctctatccactaaatatcagtaggttccccattctgcacactggttgtgacaaccaaaaaatgtctccagacattggcagatgtctcctgggggaacaaaattgctcccttttgagaatcactgccttagatgctctgttcaggcttaaataagacacataaaaattttaaactagcaggtgactaataatttgtgagtattgtttgttgcattttcatatttatcatgttggaaatttaaatttacctagtcttatttggagagtttaactttttttttttggtttgttttgttttgaactacatatttcaaccaactgttagatgttaagtcctttaagtgaatttaagggtaacatttttgaggcagtcttaatttaaaaagcctattcctttctcagcttctagaaaacttacatatttatgactgacttgagcagagtgcggtgcctcacacttgtaatcccaggactttgggaggctgaagtgggcagatcacctgaggtcaggagtttgagagcagcctggccaacctggcgaaatgctgtctctgctaaaaatacaaaaactagccaggcatggtggctcatgcctgtaatcctagctacttgggagactgaggcaggaaaattgcttgagcccaggaggcagaggttgcagtgagctaagtttgcaacactgcactccagcctgggcgacaaagctctgtctcggaaaaaaaaaaaaaaaattaaaaatttatcactgacttgaaatcctggcagtcagcctgctttagagaacattaaccaaaaatcccttggtccacaccctttctaaatttaggcattcattcagagtcttaaactctaagagccactcaggacacagttgggttgctctttctgggatgggggtagattctggagcagatactttactcctagctcattttttgaccttgagacctgtggttggtgttgtgaagtcgtacatacacaagtgacttttttgttttaaaaagtgctctcaagatagtttacaaaaagcaggaaaaggaggagtgagtgaataaatgaagagaggggaagagaggaggaaaaaagtgtttctattttagcagctgacggaaaaaaaacccaatgaaataaggtcatagctgacttctgaatggttctggacttgtttcttgacactggcgacttgtcttctaagaccattatgtagatcttcaatggaacgcctctgttattttgttctgattctgaaagtaaaaaggaacaactgcactcttggggaattttgttgaataaggtaatacttatgcctctgctatccagagtcacatttcgcttgagtttcttttgagttttgcagtcctttttgctctcagtaagagagaatgtgttaggactcctcaagtagcttaattgctctggtcattcatctctttcttgaggaccagctttaaaaatcattttgatacttaaaaaaaattaaagtaactgtttctttataatagaacttctaattagttggtttgctggtttctgcattggttggctatttcctgagagacctgtcatttctgttctttgttgccactggttatttttaagtactttgactcattaaaaacattttcagcttttaaaggatggccatgaaaatgaacacaactgtccttatttttgtctcgtgaagaaatttaatgtatttagaagtaatgccttcattattctcttaatttacaatatgaagtaaacaagctccagtgctcccccacccaaccacaccagtaaaattgccagtctaaaatccattcctgtcttcttcatctccacttttgcttttaatagtataaattctctagtatggtctttgttactcacatcacttctcaggatctgtgagcctgggtagggttgtgatagtttccttgtttgggttctataattaaatgagacctcaaacaagccttttaggaaaacaatacatctctcatcaccataaagaaaaagaaacagcagaagtatcctaccttccttctgtcaacttaaggccctaaggttgtcagtctgagccttggtccttaagaggaagcagtgttcacattcacctgttcctggtatgataaacctagtttgctttcagtttcttgtaattttgagaccagaaagaaaccttactgtgccccaattactatggaaacctctccatactttcaaatttgcatttttgaatgtaagctatagtttgcaattcttaatactcaccaataaatattataccctactgattctctttgtataatgaatatgcagagcacacaggtattgtaaatcacttaaaaaacactgtgggaaagtcacaaggccaagaaacttactgtataccaaggagaaacatatttcgaataaatcaacatagctacatgctaaatggagctattttcataagtcagtaggtgacaccattttgactgaatattggcaattacatatctcctctataatttacctttttattttctttcccttacaacttttaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcaggtaagcatatgaatccaagtgtcttctatttcaaatgttttcttaccctgttttctgatctgataggttgcagatttagggagctctcacatttaccttcaaaaagcaaaagaaagtatcaccacccacacttctttatcccagatatagaacactggttgtgtaaggggttgacaggggcctcagttgacagacgattgtaggttgtgagaaagagaattgaaagctgaaaactactcacactataaagcctcatctgttaaagagcggtggctggcagaaagaattgagcagtaaataccaccttggatattcatcgttgtatgggataattctgcatttaaaattatttcccagaacaagccaggtgccgtggctcacgcctgtaatcccagcactttgggaggttgaggcaggtggatcagcagaggtcaggagtttgagaccagcctggccaacatggtgaaaccctgcctctacaaaaaatacacaaactagctgggcttggtgatgcacgcccataacagctactcaggaggctgaggcaggataattgcctgaaccctggaggtggaggttgcagtgagctgagactgtgccacttcactccagcctgggcaagagggagacactgtctcaaaaaaagaaaaaataggccgggcgcggtggctcacgcctgtaatcccagcactttgggaggccaaggcgggcagatcacgaggtcatgagttcgagaccagcctggccaatatggtgagactccgtctctactaaaaatacaaaaaatagctgggcatggtggtgcgtgcctgtagtcccagctattcgggaggctgatatagaagaatcacttgaacccaggaggcagaggttgtagtgagctgagatcatggcactgcactccagcctgggcaacaaggcaagactccgtctcaaaaataaataaaaaataaataaataaaattcccacaactgacgaagagctcttaaatctacataagccttctttttgaatgtccgtaagattttatcccaagcaagggggcagccagatttactagaaagcaaaaaagtacattgacatttatttatttttatttttgttttgaacaagtaagtttaagtctggaaggttccagaagtagtttagaaatcataatgaggatcaattagaaatggaataaagaagcagagttttttttctcttctttcctttcttatctctcgtttgtttcacggggtctctattgcctaggctggagtacggtagtgtgagattatggttcactgcagcatcaacctcctgggctcaagtggatcctcctgcctcagcctcctgaatagctggattataggtgtgagctacaatgcccaaatttattttcttgttaaaattttctgcgtcatggccaggcgtggtggttcacacctgtaatcccagtactttgggaggccgagtggggagattgcttgagcccaggagttggagaccagcctgggcaacatggtgaaatcccatctatacaaaaaaaaaaatacaaaaattggctgagctgtggtcccagctactccagaggctgaggcaggagggtcacttgagtccaggaggtcgaggctgccatgagctgtaattataccactgtattccatccagcctgggagacagagcgagaccctgtctcaaaagaaaaaaagtctccttcttggctggcaaggtggttcacacctgtaatttcagtgttttgggatgcctatttatttatttatgagacagagtctcactttgttgcttaggctggagtgcagtggtgtgatcttggctcactgcaacctctggctcctgggttcaagcgattctcctgcctcagcctcccgagtagctgggattacaggtgcctgccactacgctcggctgttttgtatttttagtagagatggggtttcactgtgttgcccaggctcatctccaactcctgatctcaagtgatcagcttgccttggcctcccaaattgctggaattacaggtgtgagtcattgtgccaggctgcgaggccaatttaaaaattagctgggcttgatggtgtgcacctgttgtcccagctacttgggaggctgaggcaggaggattgcttgagcccagaagtttgaggctgcaatgaactgtgatcgtgctgtcttactccagcctgggcaacagactgagactgactcaaaacaaaaagtatagaaacattcaaatctgataattaggaaaatgaactaaaggtaccttgccggttgcagtggctcatgcccataatcccagcacttgggaggccaaggcaggtggatcacctgaggtctggagtttgagaccagcctggccaacatggtgaaaccctgtctctattaaaaatacaaaaattagccaggtgtagcggtgtgtgcctatattcccagctacttgggagggtgaggcaggaaaatcgcttgaacctgggaggcagaggctgcagcaagccaagatcatgtcaccgcactccagtctgggcaacagagcgagattccatctcaaaaaaaaaaaaaaaaaaaaaaaggtttaaacacttgaaaaatacctaaaaatattatagacaagaaactaaggctaaagaaagaaaacctaaaaccaatattcttatgaataggagacagggtctgactagaaaaaaaaagggagtggggataataaataaaaacaatattctgcttcccaacaccctccctgcaacatggcaagaccagtgaaataaatggggtgtcagtgtcaatttttttttttttttgaaatggagtctcgctctgtcgccgggctagagtgcagtggcacaatcttggctcactgcaacttcctcctcccgggttcaagcaattctcctgcctcagcctcctgagtagctgggactataggcacacgccaccatgcccagctaatttttgtatttttagtagagatggggtttcaccatgttggccaggatggtttcaatctcttgacctcgtgatccgcctaccttggcctcctaaagtgctgggattataggcgtgagccaccacatccagcctagtatgtgggtatttctataccagagttaccttataacaaagtcttttcatccccttccttgtgcctgtttcctttcagtttcctcctttgtcttctcatttcctttactttataaatctgttttttttttttttgagacggagtctcgctctgtcgcccaggctggagtgcagtggcatggtctcggctcactgcaagctctgcctcccgggttcacgccattctcctgcctcagtctcctgagtagctgggactacaggcgcccgccaccatgcccggctaatttttttggtatttttagtagagatggggtttcaccttgttagccaggatggttttgatcttctgacctcgtgatccgcctgcctcggcctcccaaagtgttgggattacaggcgtgagccaccatgtctggcctataaatctgttcttagagtgtttgcttctcccactcagctgcgtggcatcttccatgccacccccacaattccttggactggttcaccagatagcattcttgattttttgtagtcctggagagatgttattttccccatatttgccatgtgagactctcttaaaaggaaaaggcacagactgtttccgtcctctgggatttattgctttttcttctaatgaattctggtgtccaaatcctattgactttgtaaaactcctgcccaccaacatcattttattttatttatataattgttagaaatagataaggtctgaggatggcagcctttggagaaaagactagaggatgcccaggaatgagagtttcactgtatggaagatgacaagtgttgtttgagagatggtagtggcatgttgagtttagcgaaataatgggcggggtacagctggcggctgtttcagtaaccagtgtctgctcagaagaccttgtattccagttggttttaatagcagtgattcatctgatttcaaatcttgcttgcctgccatgggttagttactcccctgacttcactctcttttgaagacacaccctctcctagattacctggcttcaactggttcagaaaagaccctagttgcgtcttctctgggagtgtactcctggaatgatttgcagttttgtatcatggctgcctacatttgtagaccttccatttgtttttcctctattttcatatccctaggagaatagtagtcttatatactgctagttgacttcagtgctcttaacgttttcacttccttctcatgtggcgaaccccatagagaaaaatcccagttgtgtcttgtgaatgagttagtttgtttcagcaagatccagcttgagtataggcttttgtgtgagcaaggtccagctcactgtaaggtaaatattgtccatactgcttgtgcatttataacccacctggaatgttctctattttttatactcttgaaagtggtgctgtaattcaaaatacatgttttcaaactgatgaggttgtcttaaacaaaaactatacttagacaagattatagatttttgaagttgcttcttttttcatccttgccaatgggtcaaagaaaatatgtgttgctttttggaatatttgggttttagtttttttagagtctttctttgccgcctaggctggagtgagtggtgtgatcatgtctcactgcagcctcgacctcccaggcttaagcaatcctcccaccttggcctcctgagtagctgggacctcaggtgcatgccaccacgcccagctagttttttttttttttaattctttgtggagatgaagtctcactatgttgcccaggcttgttttgagttgctgggctcaaacaatctgcctgccttggcctcccaaaatgctgggattacaggtgttagccaccccgcctggccatattttgcttttaaaactccaaatagtgtatggttgtttgggattctgaacagagacaattctcaagcacctgtgattgattgcccgtaagttttccagctttgggccacctcttgtctgcagcttacttctggctcctctcctgcttgtttgcacaaggaccttagggcagggagaagaggtgatgggaaaacagttttttcacttgttagcaatctgggcaaaaggtttgaagatgcaattgcctggctaattttgcattttagtagagacggggtttcaccatgtagtctcaaagtgagtattttgtattgtctttggtttcagttatccttgtcattccccttatcttagagaatgaaagtctgactataattttaaaatttgctaatcattattcaagaattcagtctttttagaacatggaaaggaaaaaaataattcagtctttgaaacttgtttgttatctgtattaacagcacattctggaacttaattcttgcatatctggagttaacttttttcccaaccatctaaggacacggagatacggagttgtcttttgcagctgtagcgtaagatgatatagtatgagagataaggaattgacgctgtctgtttctgatcctaaccttgcagcaaagataatataaataaggatgagttatttatctcattttgcctcattttccttcacacgcaaacctcaagccttgaataaaatcaagtgtttcttttcatttgactgaaagtaacataaggcacaaacatgaatagtcaccgtagcataatacggttcagttgcctttgaagtcagacacatctaggtttgagtctcagcttgttactagctgtgtgatcttgtgcaagttactacttttttgttgtcgttgtttcctcatgtgtaaaacagggataatacccaccaaataggtttattgtgagaattaaatgagagcatatatgttaacctgtggagcacaatgcctagtaaatgcttgagaaatggtagctgtaattctggctacttgggtagctgaggcaggattaagcatttaattaagcatttaagaaaaacagtatttaccactcacacaaaactagcttaaaaatgttgttttaaaacataattctatttgaaatgtgtctttatagacacatttaggcaactagggactgggagcagtggctcatgcttgtattcacagcactttggaaggccaaggccgacagatcacttgaggtcaggagtttgagaccagactggccaacatggtgaaaccctgtatctaccaagaaacacaaaaattagctggatgtggtggtgcgcacctgtagtcccagctactcaggaggctgaggcaggagaatcacctgaacctgggaggtgggggctgtgatgagctgagatggcaccactgcattccagcctgggtgacagagtgagaccctttatcaaaaaataattaattaaaataaaaatagaagtcagtcatttttctataactgttgtatttcctctccaggatttttttgcagaccttaacttcgggattccctttattaactttttattatattttggctaatgcactttctcacttgaacttttaataatttaggtagtttggctgtgtgttcatctctaaccacatatattctttttacccacaagttgttcaaagaggagaagttgttctctcttgggtgatttagattatttgaaaaatcaagagatgtggtatgcttttggttctatcaaaaccaagattctagccttgctacaccaacagaatgcagcagagtggcaggtagcaccggatggggaaagtcctagagaaaggcaagacggttcacgagaataactttgtgtgtttttttttttttagctttttccccttcagcatttatccatgagacaatcaccaagatgacccagggattgtactgcgttgcaggcttctgccatttgaccttcctgcctgccagggttttgagttcatgctgttgtttgtacttaaatgagtagcctgatggactgcagaacatataataaaggagacccctgatgtcctgatgtgtgaagtgtcaaggggggtaaaggattatttatttatttatttatttatttttgagatggagtctcattctgtggcccaggctggagtgcagtggcgcgatctgctgggattacaggcatgagccaccgcgcccggcttttttttattttgaaatggagtctctgttgcccatactggagtgcagtggtgcaatcttggctcactgcaacctctgcctcccgggttcaagtgattctcctgcctcagctacccaagtagctggaattacaggtgcatgccaccacgcctggctaatttttgcatttttagtagagatggggtttcactatgtaggccaggctggtctcgaactcctgacctcaagtgatctgcctgccttggcctcccaaagtgctaggattacaggcatgagccactgcacctggccaataaaggattctttgtttttttcctttagtggaagccgtgcactgagggaatcctaaaagtaagacctacaagaaaaatcagctatgaaggcaagttgcctcaccccttaaggcaccaaatttaaatgacctagacatactgaaatccaggtttcccttgtaaattatttgtaagtgagataaagtgatattcagtgattacatcagaagaataaaagcttcaattaattttttctttttttgagacggagttttactctgtcatcacccaggctggagtgccatagcgtgttctcggctcactgcaaccgcaacctcccgggttcaagtgattctcttgcctcagcctcctgagtagctgggattacagacacgtactaccacacgtggctaatttttgtatttttagtagaggcagggtctcaccatgttggccaggcgggtcttgaactcctgacctcaggtgatctgcccgcctctgcctcccaaagtgctgggattacagttgtgagccaccacacccggccgcttcaattgatttgttaaattccaaagtagtgaatctcaaatctttggggtgcatcagaattactttgagaacttaataaaaatagaaacgctcatgccttaaatcctatcactttggaaggctgaggcgagaggatcactggagcccaggagtttaagaccagcctaggcaacatagggagaccctgcctccgcaaaaattaaaaaattacccaggtatgggccgggcatggtggctcacgcctgtaatcccagcactttgagagtccaaggcgggcagatcacaaggtcaagagaccaagaccatcctggccaacatggtgaaaccccatccctactaaaaattcaaaaattagctgggcgtggtggtgcatgcctgtagtcccagctactcaggaggctgaggcaggagaatcgcttgaacctgggaggcggaggttgcagtgagctgagatcatgccactacactccagcctggcgacagagcaagactgtctcaaaaaaataaaaaaaaaaaattagccaagtatggtggtgtgtgcctgtagtcccagctactcaggaggttgaggtgggaggattatttcaacccaggaggctgcagtgagctatgattgtgccatttgagctccagcctggacagcagagcaagaccccatttcaaaaactgaaaaaaagggtggttatgttttcaaacaagagcccacaaacacattgcagcatcaaaacaaacattgtcttaatttgtgtgaagtactgctgtgtgtttaaatcaagtttgcaaaatatctttcatgagaagtaattggaagagaattttgaggctggacgtggtgggtcatgcctgtaatcccagcactttgggagactgaggcaggtggatcacttgaggtcaggagttcgagaccagcctggccaacatggtgaaaccctgtctctactaaaagtacagaaattagccgggcatggtggcaggtgcctgtaatcccagctactcgggagactgaggcaggagaatttcttgaacccaggaggtggaggttgcattgagccaagatcacaccactgcactctaacctggggacagagtgagactgtgtctcttaaaaaaaaaaaaaatttcagtgcatacacacacaatctcttttttttgttgttgtttataaaaaacaacaaaaaaggataagaaggggatgacaggatgaattatcaagataagaccaggcctcttaaaccatgaccatagaaagtgttcaaggttcaagtgacatattacagtcaatgtcaggtttcatgaatttgagagctcacacttttcatttctaggaatttacagtactgctgacacttggaaatcagcaatggggagctgagtgaactggtattaaaaaggtcaaacacacagctgctgctaaagctttggagggaacaaaatttcctaagcccatagtcagcccttttggtagcgaaggaaggaatccaggtcttatgcatgggccaaacaggtacctttcaaaagtgtgtctagaggtaccatgtagtatgtatatgaatggtttcttaacttgttgattttgaaagcacagattctacactaccagtgacaaatgcttattttttaggaatccttaacctcattgtaaagcagtggtttccaatctatgatgccttaacgcctgacaatctggaaaggcggtcataggaaggatggcgggtgaccagataatttcaaagatttccgaagtttaatgaaaatatatttttgataagagtgtatagattagcaagaatataagtttaatttagagtcacatcaagtcagtgtggtaatattgattgtaattttgttggtcagaagtgcttattgccagttgtatgtctcttagttattaaaaagaatgagaaaaatgtaaatattacttaaatacaagccagcaggtagtatctcctcagacaaggagcccattcagggagcatactaatcaagaaggcatggctggtgaagggttggggatcagtgacctggaggctgtgtcattaatggctgttttagcagagaccccctcacatgcatgaagtcatcccaggtcttcgtatgtaggaaggaatctgggaagttaccagtcacatctttcttgttacttttgatttctttgcagtatactttcttcatgtttattctctattgcagacaaattctgtggatcagagctgctcttaaaatgattcagactgtacttaaaatgcaattatatgaattttgtaaaaaatataattctaatgcaaggaagagagagatctgtaattcatgtggccctctgtgcaaaccccaaagatattcttatagatttgattcatgcattaaatttagttgaaccagttatagtacagaatcaggtcttttttatttctctctatatacatcctaaagaggcattttaaagtggatttttatgtgcatttagattttgccatttctagtgttctgtttttgatatgaaagtgttgtttttaaatattgtgcactgacactaatctttccaggctggttttctttttaaatggtttttaaaggtttatggattggatgaactgaaagaaaaaaaaattggaaaatgaatagcatgtattttctgaagttgataattttgagataacttgttgtgtatgaaaatggaactcattttcgtagcaagtatgaccacaggtcaaattcattagaaatgtcaagaatggaaatacctgaatattttgtgggccttgtgtgacttctgtgaagagaattgggttgccaccttctcactgatttttcacctttaagttgcacatcatgttgtattgtaactctttgagtgtgctttgtgttttttgaactcctctggggcaggaattgtgtttctttttttttttaagacagagttttgctcttgtttcctcatctggagtacagtgacgcaatctcgactcactgcaacctctgcttcctgggttcaggcgattctcctgcctcagcctcctgagtagatgggattacaggcatgcgccaccatgcctggctaattttttgtatttttagtagaaacggggtttcaccgtgttagccaggctggtctcgaactcctgacctcaggtgatccacccgcctcggccttccaaagtgctgggattacaggtgtgagccaccctcactgcaaggtccgcctcccaggttcacaccattcttctgcctcagcctcctgagtagctgggactgcaggcacccgccaccatgcctggctaattttttgtattttttagtagagatagggtttcaccatgttagccaagatggtctcgataccctgaccttgtgatcctcctgccttggcctcccaaagtgctgggattacaggcgtgagccaccacgcctggccaggaattgtgtttcttaagcttagcacagtgctttgcatccagttagtaatgtaataaatgcatcgttcaatactgtgtacggacatacttctgagtgcaagccaataatcctgtaaatcagtacaaccaaggttatattgattaagtattctcaaacagtaaaacaatttggacatttacatgggattttttaatcgtgaaatttgatgtgttttggaacttatttctgacagctgtaccatatagctttcactgataatgtcttgggttaaattgtggctcctctggtaaccctcagagtagattttgtgctgtcgactgtgtataaatatctagaaatcacagcatattcttggatttccttgtctgatgcctagcagtgagccacccaggtccttttatgtaaagtatcatgaatccaattagcagaaagcatgctattacattttattttagtgagtatcattctcataccagaaaaaaacagttctttgtcgattctttcttgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtatgtgtttttttttttttttttttgtaaaatacaggagaaaacgtgtctgatcttttacataaaccagtacctctagattgtggagggagtaatgatttggtttgggcctgccaagtgttgaagttggtcttaattactcttgtgcctttgtgcccctcccccgccttttcttttttttctttctttctttttttttttttttttttttttttgagacagagtcttgctctgtcacccaggctggagtgcagtggtgcagtctcggctcactgtatcctctgcctcctgggttcaagtgaggaggctgtctcagcctcccgaatagctgggattacaggcacctgccaccacgcctggctgatttttttttgtattttttagtagagacggggttttgccatgttggctggggtggtcttgaactccggacctcagatgatctgcccaccttggcctcccaaagtgctgggattacaggcgtgagccaccacacctggctgcgcctcttttttttttttttaattcattgagacagggtctccgtatgttgcccagactggtcttgaacttctgggctcaaggagtcctcctgtcttggcctcccgcagtgctaggattaaagtgtgagccaccacacccggccctttgtgcttctttttttttttttttttctgagacggagtctcgctctgttgcccaggctggagtgcagtggcatgatctcggctcactgcaagctctgcctcccgggttcatgctattctcctgcctcagcctcccaagtagctgggactacaggcgcctgccaccacacccggctaattttttgtatttttagtagagacggggtttcaccttgttagccaggatagtctcaatctcctgacctcatgatccgcccacctcggcctcccaaagtgctgggattacaggcatgagccaccacgcccggctcctttgtgcttctttaactactgctcttgggtagggcctgagcatatttcttgctggcagtgtggcttgtgccctcaagcagcctggctaaagataacccttgtaactgctttgtgtaactgaatcatatttaaacatgattcccatagcatcatgattcctgcaagacaatgattcccagcatttgtagattacctgattattgggtactttttgacttttgaacttgtgcgttttgtaaatagctttggtgcaataaaatattaattgaaacctgaaaatgccatggattaaaaatcttctgctggcagtaataagacattagtggaggccaggtgtggtggctcacgcctgtaatcccagctctttgggaggccaaggcaggcggatcatgaggtcaggagtttgagaccagcctggccaacatggtgaaaccctgtctctactaaaaatactaaaaatacaggcatggtggcaggtgcctgtaatcccagctactcgggaggctgaggcaggaaaatcgcttgaacccaggaagcggaggttgcagtgagccgagatcgcaccactgcactccagcctgggcaacaagagaaactccatctcacaaaaaaaaaaaaaaaaaaaaagacattagtggatagatgatgagcaaaatggaattcttcatttccctgctctctgttgggggatagtcattttaaaaatataagctatgaaatggataagaaactgggttctgctagggaaatggataagaaactgggttctgctaggtaggctacagcttattgggatttcttgaaatgagggtccttttgaaagacttgtgcattaaaattcccagcctcctattggagacatgcaaatttaaagctaaggtttgagaaggcagagcaagccaagtttttgtctcagccaaagcctaattcattttagattttgtcagtgcaggttagtgtgataaactcataatttataagccattgtattttgtgagatgtaagtttggattgctaaacactctttgcttatactgtgtagcaattctaatccagtttaagcttttatgaaatctctggatatattgatgaagagtgattagcatcaaacactaatgtgagtaggatcgtgatgaaggaaatacttgcatttgccagagagtgtataggtgacttatcaacttgagactgtaatttgcctaacctccttttatttctaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaggagttgagcccaggctccctgacgcttcgacagggtaggagggtagtggggagatgtcaccgcacattatcttttctaagaaggcacattgacagctgtccataatttttatttgaatgcctccaagattttatgctctgtagctttcttgctttttactccttttttccttttaaaatttcttaacaagaaagtcagttgccttctttttcagtctgtagcatggttttgagtgacatgatacggtgtgaacacgttagaaagtttgtgattcagttgagttgtgaagaacatgtatggatgaagtcttcggtgctcaagattatgcttgccagaatctactgtgatatatgggtaccaggttagaggattttctgaagctgttttttaccagccactcttgattatatagaagcgccagttaccttttgcctcataacagaccatcatagaatttagtgatggtttaaacatctccaggcatttattttgcttatgagtctgtgattgaggctgggcttggcaagggtgtagcttgtcttcgttccacacagctttggttgaagtggatctgcacggggccggaggatctgcttttaaggtggctcactcacgtggctggtaagttggtgcttgctgtcagctaggagctcagctgggggttctggccccaggacctcagttcatccctgggtgacctatggaaggattgcttatacttcttcatgttatggtggctggttgccaagagtaagcatcctagaagatgggaaatggaagcagctgccagtttcttaaggcttaggctcagaaatcacagcatcgtgtctgccatattctacaggtcaagcagtcatggagcccagattcaaaggaaggagatatagaatgtcacttagaaaaaaaaaattgaggtggctgggcgcagtggctcacgcctgtaatcccagcactttgggaggccaaggcgggtggatcatgaggtcaggagattgagaccatcctggctaagatggtgaaaccccatctctactaaaaatacaaaaaattcgccgggcgtggtggtgggcgcctgtagtcccagctattcgagaggctgaggcaggagaatggcatgaacccgggaggcggagcttgcggtgagccgagattgtgccactgcactccagcctcagggacagagcgagactctgtctcaaaaaaaaaaaaatggaggtaaaaattatataacctaaattgactattgtaagtgtacaattcagtggattttagtacgttcacaatatggagaatcccatttccagatgatgaaaggattgtcaaagaattaggggccatgttttaaaaccaccatgataggaaaaggattttaacatttttgtgactaaatagcaatataattcttagggaatcagtaactccatgccattgaggggtcaaagcattagtgaatatctttggccaggcagaatcttatcacagatagagtcacaaagtctagaagaagtccagtgaattgaaaacattgagatttcataattctgtttaatcacaacaggaaatgccacctgaaaatatctctgggtagcatttgacttttcttcaccaggaaacatgttcacaaagaacaggaggatcctgcacagaacagtgggctatgtgatgagaggtgtagacccgagtggaccttgggcagggtgcctgctgagtctgttgtatccagctgccacccagggtgacccaacttgggcttcatggctggccgcacaggagcgatttgtttttcttttgttacgctgcatttccattttccgctataatcacctattctaacagatgatctgtttccagggctcactaaggaccaaatcaaagaaaatgaggctgtaactaaaagaggaggatttagtgaagttaaaagaatgagcttttcagtggtgagatttgttaaaacaccaaaaaggtagtgtaatttgagttattttggaggcttttcagctttttacttgactgttgctaatctaattggagtcagatggagtaggtatttctagtccttccagccaatagttgatgaacaattgctggacactgctatatggcttttctgcatcacaatcacttgagaagttaaaaaaataaattctaggcccaaccccgggattctaatgcaataggtgtagggtgagacccaggaatctggcttttgcttttgttgtacttgcttgggggtgtgtgtgtgtgtgttttgagacagtctctccctgcttttgttgttcttgctggtgtgtgtgtgtgtgtgtgtgtgtgtgtgtgtgtgtgtgtgtgttttgagacagtctctccctgtcacccaggctggagtgtagtggcatgatcttggttcactgcaacctccacctcctgggttcaagcaattcttgtgcttcagcttcctgagtagctgggactacaggtgctcaccaccacgcccagctaatttttgtatttttagtagagatggggtttcactgtactgcccaggctggtctcaagctcctgagctcaggtgatctgaccaccttggccttccaaagtgctgggattatgggcatgagccaccatacctggccatgttgttgttaatgagctcttggagtgattctgaggtatggtcaaggttggggaaccacagatctaagagctgtcagcacttccccagcagttcctccccttgagtcctccatgagagtgatcacagtattgctacaaaggataagtgcctgttggtgtttctgagtctcccgccttcactcactagagcagcgttggttggcacagtcctgagggcagcggctgttgtagacatgttcttctgggctgagttttcaccgggtcctatgaaatctctgaggagctttgctgggagtggtgtttaaatctacttgtgccctttggcgtttcttctctatgccccttttctagctctgtagagttggaagtagagaccgtgcctgtcagaaatggcttaaagactggccttagccagtgaagtgaagagtcattaattcagaaaagacttatttgaagtactagatgaatatcccttaccctaaacgcttgcgactagaagtgttttggatttcagagctttttttgattttggaatatttccatcatacgtaatgggatatcttgggaatgggacccaagtctaaacatgaaatttatttgtgtttcgtatacaccttatacagaaagcctgaatgtaattttatttttttcttgggggtattgaataaactgttttgactgcgacacgttgcatgaggtcatgtacggaatttccacttgtggcattgtgttggtgttcaaaaagtttgatttttggagcattttaggttttggatttttgaattaggaatgctcagcctgcaataagtgaaacacttggcctctttcgtaaatgtgctgcccttgattttaccaggctctctgatagcaggcagtaggggaataaagagagacagttttaaaagataactttttttttcttaaaaatagtgcatatggactataaaaaattttaaattcaaaaacaaggaacaatgaatgatttataaatttaccacttgcggataatcactgtaaccatttggtgtatattcactgacaagcacatatacaagtaaatacagatgcctatctatttcataaaaatggcatgacagtgtacagtaaccaccttttttcactgatgtgtatatcttgaatatgttacgtcatttacttaaaattccttggaggacccaaattcagcacacacctaagcactttctaatggctacaaaatgttccactatgtgaatgcactgctttattttccaacagggacttgattatttaggttgtttgcattttccctcttataaaatgggtcgggaagaacatcgttgcagttaaagtctttgtccacggtcctagaagtggaattgctgaaccagcgggtatgcatggtggtacatatggccaagttctccacagaaagagggtgccattttacaacctgctgacaggccataagcagcccgtctgtccacagcctgccagcattggaaatgatcattttaaacaaattgtcagtttagctgtggcatatttgtggagcatgtgattgtgtggtggatcagtgcatcttctctagaagatatgcagtaaagccagcgcttgctgtctacagggcaggcatagtctgggccctccatgccaggcgctgtgctagaccctgagttgaaacagtcagcgccatcccttttcctgtgaacttagtcaaatggagctgccagacattaacattaatatcagcaaaaagtgcatttagtgcaaggatggaaaaatgacaaggattagaagaacgtaaagtatctcatttaggttggaataatggtggtgagttcagagcagtcttttcagaggaagagacatttcggctgatactaaagatcagcaaagggcagggacagtgtatgcccagagagggagtggcagttgcaaaggccccaagttaagaaagtgcatggtttatttgtttatttaatctaaggtttgtgctaatgaagtatgagttttactcagtgtctgagctattaggagcagtatggtcatagctgcagtatctgtaatagagaaaaacgggggctagcttaaatgtctgttactaggaaagtggttaaaaacttggctacgtttatcccctgagtaccagagtgagatatctcgtataggcaggcatgaaaagggatgaagatgcagagctgttactgtgcatacagtgtgatcctgttggtgtttcagtgtgtatgtatttttgtttctttctttcctttttttttttttggagatagggtctcactctgttgcccaggctggagtgcggaggccctccatgcaggctcactgcagccttgacctccctgggcttaggtgatcctcccatctcagcctcctaagtagctgggactatagattcatgccaccactccctgttaatttttgtattttttgtagagatggggttttgccatgttgccctggctggtcttaaactcctagtcttaaatgatctgcccagcttggcctcccagaatcctgggattacaggcatgagccaccgtaaacatcctgaagtttttaaaatacttttttatacttttgtaaaaatgaataaatgcagctctttctggttttgagtctttatcttcacttgggataggtgcatacttaattaggagtaaagttaaaattagagacccatttgtttatttatttattttcttgagatggtgtctcactctgtcactcaggctggagtgtagtggtgtgattttggctcactgcaacctccgcctcctggactcaagcagtccttccacctcagcctcccaagtagctaggaccacaggtgcatgccaccacacctaatttttgtatctttggtagagacgaggtttcaccatgtttcccaggctggtgtcgaactcctgagctcaagtgaccaccacctgcctcggcctcccaaaatgctgggattactggcatgagccatagcgcctggcctgaaattggagactttaacccttcttgtttcctcagtgttcattggacctagttttctttttcttttttatttttttctaacagagacaggtctcactattgttgcccaggctggagtgcagtggctatacacagacatgatcatagtaccctgtggccttgaagtcctggattcaagtgatccttttgcctcttgattatctgggactgcaggcatgcttgtgcctggctcaggttttcttttcttttttttttttaagacggagtctcgctctgttgccaggctgcagtgcagtggtgcgatctcggctcactgcaacctccgactccctgattcaagctattctcctgccatagcctcccgagtagctgggattacaggcatgtgccaccacacccagctaattttgtatttttagtagagacggggtttcaccatgttggccaggatggtctcaatctcctgaccttgtgatccacctgcctcggcctcccaaagtgctgggattacagacgtgagccaccacgcttggtctttttttttttttttttttttttttgagacggagtctcgctttgttgcccaggctggagtgcagtggtgtaatctcggctcactgcaacctccgcctcccagcttcaagcaattcttctgcctcagcctcccaagtagctgggactacaggtgcgtgccactaccgccggctaatttttgtatttttagtagagatggggtttcaccatgttggccaggctcatctcgaactcctgacctcgtgatccacccgcctcagcctcccaaagtgctgggattacaggcgtgagccaccacgcccagccaggttttcattttttaagctgctttttcaagctctttaaggaatgatattgcatgagttgtattcttttttagaggtattacaaagaactgagagaaagtatacttatattttaaaatagtgcaaaactctttctgtcttacaattatcataggggtcttttggatccttttgtaagtctttacatgatgggatcttagggatcttaattttcctgtgttttgaacgttttgctatttgttattccacataattatttcaatactattcatcatctactcccaaatatgccagatgagatgaaaatcataagaaaatggaagaatgataaagcctctggggtggatatacaatagtgaagtaattgtcatgatgacaccttcttttattgtcctatggccttgcctaggctattgcattgtcttccaagaggttaaaaaaagaagactagagacaccatcttttgagtctcctttttgctttcattgaacccaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgagggttaagtgtggttcagagcatttctttcttttctgttgttttgttttgttttgaaatagggtcttcctctgtcgccctagctggagtgcagtggcacgattgtggcttactacagccttgacctcttggcctcaagtgatcttcccatctcagtctccctcgtagctgggactacaggtgtatgccaccacacctggctagtttttgtattttttgtagagatgcgggttttgccatgttgcccaggctggttttgaactcctgggctcaagtgatccgcccaccgtggcctctcaaagtgcagagattatagggatgagctatcacacctggcctctttcttaatgttgcctagattttattgctgaactatacactatggaatcagtgttaacagtaattcctacattgtgaagataagactaagtgcccactaaaccttcctcattttactgggaatggtttttgtagattagttttgaaccatttgctgcctccctacttggaacattttgtcagtctggataataggaaatttttaatgagccaggcacggtggctcactcctataattccagtactttgggaggctgaggtgggaggatcacttgagcctaggagtttgagaccatcctggacaagatggagagacctcatctctaccaaaaatatttgaaaaaacgaaatggtggcatgtacctgtagtctcagctaatgaggaggctgaggcaggagaattgcttgagcctgggagatcaaggccgcagtgagctctgattatgccattgcactgcagctgagggcacagagctgaggccctgtctcaaaagaaaaaaattgtgtaaaagagcaaaataatttcattttcaaatatgtttttttgcatttttattttactggctgctttgttcctaatgatactcctctggaagcaatggcttagagcagtgaatcgcaactccagtcacctggggacttatttaaaaaataaacaaatactataaataaaactgctatccaggccatgccctcaaaaatttgagttcagttgtctggagcgggctccagaatctgaacttgtgaagctcccaagtgattgtagtgctgctgtggttgagaaccactggcttagggtgtagaacggagcagtagacccattgttttctatcagtcttacgtggaaccttgatacatgtatataaaatagaaaaggagcatttcgttagtataaattgttatttaaaaaaatttttttttggctgggcacggtggctcacgcctgtaattccagcactttgggaggccgaggtgggtggatcacctgaggtcaggagttcgagatcagcctggccagcatgacgaaaccccatctctactaaaaatacaaaaaattagccaggcatggtggcttgtgcctgtagtcccagctccttgggaggctgaggcaggagaatcactggaacccaggaggcggaggttgcagtgagccaagattgcaccactgcactccagtctgggcaacagagcgagacttcatctcaaaaacaaaataaaaaataaatatttgttgttgttgttgttcttgttgagatgaggtcttattatgttgcccaggctggtctcaaactccaggcctcaagtgaccctcccgccttgacctcccaaagtgctggaattacagttattagtataaacttataagtttggatttataataatggtaaaggcaatttctgagaatgaggtatatgagttttcaaaaacaccaaattatattcatttaaaaacacggctgggaaagatacagtcccactttaggatagtgattaactgccctgggaatgatagtgagatggccttcattgcctctttttttgagacagagtctcacccggctactttctgtatttttagtagagatggggtttcgtcatgttggccaggctggtctcgaactcctgacctcaagtgatccgcctgccttggccttccagagtgctgggattacaggcatgagccacctcgcctggcccgttgccttgtgttttgagatggagtcttgctctgccacccaggctggagtgcagtggcacgatcatagctcactgcagccttaaactcctgggcaatcaatcaagtgatctttttgcttcagccaccccagtagctgggactataggcacactccactgcacctgggtaatcttaaaatttttttgtagagattaaggtctcactttgttgcctagactgatcttgaactcctgacttcaaacaaaccatccatctcagcctccagaagtgttgggactacaggcgtgagccaccatgcgtggctcattgtttttcttaaaacagaaaaaaacagtccgacgtcagtagtacttaactattgacattggataaatccaggaaattgcctgttatgttattatctgtacttttctgtatgtttgaaataggttgtaaataaaaataaaagttaaacctaattgggctgatacaatgaacaaaacattgaaaattggggcatgtacgtggcattcaaagtcttacgacagtctgagcacctagtttatttccaagttgtgttctggctgctcataaagagcattctcattggcacagttcttagcatgtggaccttttttttttttttttaaacagatcatctattaaaaaaaactctggatgctcttcagggaaacagctgtcaagctttattctgttgtgcacaaaaatgagttaatctggggttagcacaagttactgtgttgatgatttctggtatcttaatatttggtgtgaaacatttttgttgctgctttttaaaaaattcaggcaaaatatacatctaaaattattaaacatttttaagtgcaccagtggcattaaaatacattcttggttttgcacaactgtcactactaattttcagaacctttccatcattccaaatagaaattctggactcattgaagagttactccccactcccttgctcgtggcccttggtaacctctactttactttctgtttctatgcatttgcctagcctaggcacttcataaaaatggattttttttttaatgtgtggcttatgttacttactgtaatgttttcaaggttcgtctctgttatagcatgtttcagaatttcatttcttttttaagggtgaatgttttatggtatgaatagtaaatatttgtttttccagtcatctgttgatggacatttgggttgtttttaccttctggctattgtgaatgctgctgtgaaccctggtgtataaaaatgtgttcaagttgctactttcaggtcttttgggtgtatatctagaagtggaattcctggatcatataataattatatgtttaattttttgaggaactaccaagctgttttccatagcaactgtaccattttacattttctattaaattaattaacttactttttttttttttgagacggagtctcactggactggaatgcagtggcgtgatctcggctcactgcaacctccgcctcctgggttcaagcgattctcctgcctcagcctcccgagtagctgggactacaggtgcgcgtcaccacgctcagctaatttttgtatttttagtagagatggtgtttcaccatgttggccaggctggtctcgaactcctgacctcaggtgatccgcctgcctcggcctcccaaagtgctgggattacaggtgtgagccaccgcacgccctgcccattttctattttatttttaataaaatccaaatctggtacaaccattttacattttcataagtgactggaagcttctcatttctccatatccaaaaacttgttatttccatttcttttgatagcagccatccttatgggtgtgagtggtatcttactgtggatttttttttttttgaaacagagtttcgctcttgttgcccaagctggagtgcagtggcataatctcagctcactgcaatctctgcctcctgggttcaagtgattctcctgcctcagcctcccaagtagctgggattacagacgtctgctaccacacccggctagttttttgtatttttagtggagatggtatttcaccatgttggccaggctggtctcgaacctctgacctcaggtgacccacctgcttcggcctcccaaagtgctgggattacgggcatgagccactgtgcccagccgactatttgtatttctttagagaaatgcctgtgtaagtgctttgcccattttctaattgggttgttttattgttgagttgtagttctttatatattctggatattaatcccttatgagataaatgatttgcaaatcccattctgtgggttttcttcactctcttgatagtgtcctttgatgcatgaatgttttaaattttgatgaagtctaatattaatgtttcttttgttgtctgcggttttcatgtcatatgtaagaaatcaccagatggtgtcataacacttttcccctatgttttcatctaggaactttactgttttagctcttatgtttaagtatttgatccattttgagtttttagtggtgtggggtaagggtcctgccttattattttgcatgtggatatctagttttcctagcaccatttgttgaacaagcttacagtattttttttttaagtttaatatctatttaactattagattggtaattacttttgcaccaacctgtaaatttcaagccaaacctctgtagaactccagcctttaaggtaccttgcttgcaaattgccagttttaaggattcactcataaaaaagtagaccctttttctgcttaggatttaaacaaaaatacaagtgtgggctgggtatggtggctcacacctataaatcccaacactttgggaggttgaggtgggagggttgcttgagcccagttcaagaccagcctggacaacatagtgagaccccatctctacaaaacattaaaaaaaatagctgggagtggtgcctatgccagtagtcccagctactcaggagggtgagatgggaatattgcttgaggtcaggagtttgaagctgcagtgagctatgtttgtaccactgtccttcagactgggcaacagtgtgagacactgtctccaaaaaacaaaaaaaagtatgtgtaggttaataaaccaccacaagtgctatgaaagtagttttgactcaggtgagatacactgaaaccagattggaaagaaaagattatggaaggatagaaggaattacaaagagcatctggaataaatttatttgtccaggattatacccttggttatatatatatttttttaacctagagtttgttttattttaattatagctttttttggtgggtgtgacacggtctcacactgtcactgaggctagaatgcagtggcgtgatcatagccacctcagcctcaacaccctaggctcaggtgatcctctcccctcagcctcccaagtagctgggaccacagatgtgcgacaccgcacctgctaatatttgtattttttttataaagatggggttttgccatgttgcccacgctggtctcaaactgggcataagcaatccacccaccttgtccttaaaaagttttgggatcacaggcgctagccaccatgcccagccaattacagcttttaatattcagtggccagacgcggtggctcatgtctgtaatcccagcacttcaggaggccaaggtgggcggatcacctgaagtcaggagttcgagaatagcctggccaagatggtgaaaccccatctgtgctaaagatacaaaaaaaaaaaaaaaaaaattagccgggtgtggtggtgggtgcctgtaatcccacctacttgggaggctgaggcaggagaatcgcttgaacccaggaggcagacgttgcagtgatccaaggtcatgccattggactccagcctgggcgacacgagcaaaactccatctcaaaaaaaaaaaagttgagtgtaggtggaatatacctgataaacataaggaaatgcacaacagataaaatcttggatagtcctataccttgcctatttagcagtttcagccatgggttccttttcagatagttctaatctcagaagcaggactttataaattctttgacaaaataagcaataatgtgaagaaaaacagctctttttgttttgggggactttgctagataagctttgagcttatctagttcctcttattatcactacagcacagtataaaatccatgttatcagcacgcagaagtaagatccttgctcctctttaatctcatccctgattggacgactcttaagtgaaccttgttccaaagatggaatctctgcctttgttgaggagactttattagtttgcgccttgtatttttttgccaacagccgttgagtatgagatacatggcagttttgtaatgtgtttcatcgcatccttatttatttctttatttttaattatagagatagagagtctttgttgcccatgctggagttcagtggctgtttacaggcatgatcacagctcactgtagccttgaactattgggctcaactgatcctcaactgtcaccttgctgagtactggggcaatagtcgtgtactgccatgcgcatggctgcattctcttaaagtggtttcccgccgggcgtggtggctcacgccttaatcccagcactttgggagccgaggtgggtggatcatgaggtcaggagttcgagaccagcctgaccaacatggtgaaaccccgtatctactaaaaatacaaaaattagctgggtgtggtggcgcatgcctgcaatcccagctactcaggaggctgaggcaggagaatcgcttgaacctgggaggtggaggtagcagtgagccaaaatcgcgccactgcactccatcctgggcaacagagcgagactccatctcaaaaaaaaaaagtggtttccagggaatttatgttcaaataagcctgcatactcatgtggacagacttaatctgaatttgccacgtcccacatatatctgtctgtattttgacttttccaaaatgtggcttcccactacttgagaaggacttttggaagtcactgttccgagcagcagtgacatcttgctgaaccacagtcaggctgacacatatccaaaggtctattatgtgcggattgtttttggtgaacttatgaggtacaatttgactcaaacttgacaggacatgtatctttttaacctcttaaattcagtgacacttggtatgtgtgtggttaaattcataaagccaaagctcagtgcttttaaggtttaccattgcagctaggatgttgatgggtgtttttttgtgggggacagcgtctcgctgtgtcacccaggctggagtgcagtggcgcatgatcatggcttactgcagcctcgatctcctgggctcaagcaatgctcctgcctcagccctccaagtagttggaactacaggcatgtaccaccaccacatccacctaagttttgtttttttgtttttgtttttgtttttgttttagagacaaggttgctcaggctggtctcaaactgccatgttgctcaggctggtctcagactcctgggctcaagctatcctcctgccttagccttcaaagtgctgggattacaagcatgaaccaactcacctggccattgactattttaataagagctaactactaaacaattattcttacaggtgaatggaagagaatccgaagaagaaaatctcaataaatctgaaataagtcaagtgtttgagattgcacttaaacggaacttgcctgtgaatttcgaggtaagctaattttacatgtaggactttgtattctaaaatcctgttagcattcatcataagagttattttttcccctaaatatcattggaataatcttcacataatgtgaacctccaaatttaagattcatactttatatttagtgaagcagtgtttattctcttcttctgggagtccgtaactaaggggcattcatggatgtgtagagagttcatgatggcttcagttggtgtgtggacctcctgaagcagtctgaagatggttgtgttagtgttcatatgtgtattcttctggatagggaagggtggaggggctagttcatcacttagatcagtctcaaaagcatttgtggtccctaaaggtctcttcagagtaattttgaaaaggactcagtttttgtcattgtctagcgtctgccctcaattcctgtttaataacttcatttgttgttgagaccttgtgttctaaaaacaataatcaatgaattgtctgatcaaagtgggaaataaggtacattttaatatatgttgccttaaaagacatatagttcatccaaatggacgagggaggtaagggagaattttttttgttacttatttttattaagcgccagcttaatgctgcagaaaatttcacatcacccttgataacccactttcttttctcccacccaaattcttgatcaagagtttttcaagtaaagacatgctcttctctcttctatataaaacgttacgaataaaggcaaaagattgtgtacatcttgctggaaaatgctgcccagggctctggagatggcggctgcccgggctcccttcgctgtccaggtcctgaaagactcttgttcatgaactgtctcttcacaaagcaagtccaccacgtgctgggtttatcattcttagggtcgaaaacttcctcacaaagtctcagtccagtctcttgccttagctgttgtaaataggctctcatcacttcatcttcctgtttgtttgcaggtttggtataaattgcgtgaagtggaaaaccaggctctccaggaatgggaaaactaatgattcccagtgtatacatttctttctcaccttgacttttggaattgcacttttggagttttttcagacattcagaaatgtagagagttaaatatatcaaggtcctatcagcttcattcttaatttcatagtttttgaagaagacattggccttgaagtaatagttggcttcatccacaatatctgtatcttttgtctctctgggggcaggtcctttgaattgacttctgataggtaacagtgctatgtttccgatgagtttggtgtcaggatccatgagagaagagtaatgagccggcatcttggcggcgcccgggtttcaacccagagcttttttttttttttccctgagatgagtttcactcttgtcgcccaggctgtagtgcaatggtgtgttctcggctcactgcaacctccacctcccagattcaagcgattctcctgcctcagcctcctgagtagctgggattacaggcatacgccaccatgccgagctaattttgtatttttagtagaaacggggtttctccatattggtcaggctggtctcgaactcctaacctcaggtgatccacccatctcggcctcccaaagtgctgggattacaggcgtgagccaccttgcccggcccagtaagggagaatttttaatgtttaccttagaaataaggtctgacccacagcagattctttgcagattcttttgatttacgtgcttgattatggcttatttcttaaaaagcctatctgaagcttatattcctgtaaaatatctttgaagtattctttacagttacaggtgatgtataccttctcctcctatgtgctagcaccctaaacttaacccagcttcagtgctccatcctttggccgagtgatgatgatttctcacctcaccctgctgatgcctctctgcctgccatgggccagaggtgggattgtagttgccagggctccctactgtggcccacctgggtacgagggcttgtttgttcctctccattcctctgacactcattcctgcccctccaccctcagtgggtaagagcaggtttacactgttctcttggagtccagagcaccgacatggatctagggctggaatcttctcacctggccctacattccctccctggcctttctccctccatcagtggaggctgggatgcacttggggagggaatgagacaggggacattcagaatggctgtttgggctcacagttgagtgggaaaaagatgggagctgcatcccaaggagtcatgaggtctcccccggcacctgtttcaggaaaggggagaagtgttgcttttctcccctgctgacagattagtctgtcatgagagtggatttttgcaggttgtgggggaggggtaccaagaccgtggggagtgggagatgcctggctggcttcccgggtcacctcatgtgcagagttgacggcttgggccagagccttggattcctgagaagcttaccacctgctcactcttgctgctacccagagtcactgagatttctggaaacttagagattgctattttatgtttttgttctgtgggatttggggtcagattgcttcctttcctccttcacttttgttaaggtttcagatctggctctcaactctgtgttcaggaatcttgacagtagtcacataaaagaattgtaggagtgccctctcgtggtgatcttttaaagtaatttatcacagcttgcatgtagttggtggcgtgagtgcttatattcattaactcaaatatcaggaattttttactagcttgcattattatgttgagcaaggtctttcctttcttttgccgctggaaggttgcctggcatgtattagatgtttaggaaatagttactgaataaatgaacagaataatttttgattaagtttttggtaattaaatctgtcacataggaagcttcgttaggtgttttaataggggaagacaggaacagttttttggaaaaatatatacagcttgacttttgttttgttttgttttgttttggagatggagttttgctcttgttgcgcaggctggagtacaatggcacgatctcagcttatggcaacctccacctcctggcttcaagcaattctcctgcctcagccccctgagtagctgggattacaggtgcacaccaccatgcctcactaatttttgtatttttagtagagacagggtttcaccacgttagccagtctggtcttgaactcctgacctcaggtgatccactcaccttgatctcctaaagtgatgggattataggcatgagccaccgtgcccagccagtttgacttctgataaaacatacagttttagttagaaaatgtgatggtgctgatggatacggtcatcgggagacaattgtgacatgctcacaccacatgcaatccaggtgatcctccagatttagattggggggatcttgatgtgggcagacaatgcaagccgttggagagggccagggtgggctgtgcatttgaagtgagccatcagggtggctgacctgtccctccaaagtctaacctgaggacagggaaagcactgttgtgggaagaagtgtttcagaatctctgcccttgggtgtgggcggcacctatgggagttctttaaaatcagtccacgggtgcctaagcaggccaggtccttcccacacctctgctcctggccactgtgctgaattcctaccccccattctccgctacctccttcccctacaccaaaaaaaaaaagagtgcatccattttggaggctcacttttcttacctagacattttttcaattttttacttcaaaaatttcaaatctatctaaaagttacaagaataggacaatgaatataactttcacttagattaaccagtggttaacattttaccatatttgcttgctccttccttccttttgttttttttttttttgtgacggagcctaactctgttgcccaggctagagaacagtggcatgatctcggctcactgcaacctctgcctcctggattcaagcaattctcctgcctcagcctcctgagtagctgggattacaggtgcacgccaccacactcggctaatttttgtatttttagtagagatgggatttcaccatgttggccaggctggtcttgaactcctgacctcaagcgatctgcctgccttggcctcccaaagtgctgggattacaggtgtgagccactgcacccagcctgctttttctttttccataaatatacatattattttctgttttttactttgctggattatttgacagaaagtggtagatatcataccctttaactcctaatatttcagcatgtatctcttaagagcaaggacattctcttaaataaccacaatctattaagtagaggaaatttagcattgctatagtactgttacctaatacacatcctacattcacatttcaccagttgtctcaatgatgtcctttatagaaatgtttcttccgctctagtgtctgatgcagactcacaccttacatttagctgacctttctctttagtctctgcagtatctttagtatctgcagtacattctcagcctttctctgtgtttcatgacattgacatgtttaaaggtcagttatttttgtacagtggccctcaatttgggtatttctgatggattacttatgattaggtctggttatgtgttttttggcaggatcaccatgggagtgatattgatccttctcagagcatcatttcatgtcactttgtaattaactcctaacctctgaggagatgtttgaaggctgggccttcacaggtctccccggtggttccagcaatcttttttttttttttgagacggagtctcgctctgttgcccaggctggggtgcagtgatgtgatctcagctcactgcaacctctggctcccgggttcaaatgattctcctgcctcagcctcccaagtagctaggattaggcatgcaccttggcctcccagagtgctgggattacaggcgtgagccaccacacccacccctcagggatcttgatgattcttgctggcattgattatcactgtggtagatgtcaaaattatgatttttggcatttccaagctggcattctacagtaaagaaaaagtttccttcctcccctcttatagtaattatatcggtatagatgcattgctgcttttttttaaacccaaagtattactccattgttatcgtcacccattttgatgtccaaattgtcctttaaattggcccttgtgccctttaacatgcccccatcagttattttttggatgaaggggtggtcaggcttcttgaggtataatttacagtgaaagtcaccctgtgtaagtgcacagttcgatgtgttttgataagtgtatatggttctgtaaccagcaccatagtcaaaacagaacatctcccacccagtaaagttccctgtgtccctttgcagtcagtctctcccctctgtcctcaggctctggcaagcattgatctcattctgtccctatagtgttgcctttttaagaatattacataaatggaaaatagagtatattgccttttgtctgacttctttaacttagcttggagtcattattcatgctgttgtgtgtttcagtagtttgttcctttttatcaccaagagtgttacatagtgtgtacacactacagtgtatctatttaccagttgaagatttgtattgttgtgagtttttggtgattattaataaatctactgtaaacatttatatacatctgtggagacatgttttcatttttcttgaataaatacttgagtggatttgctgagttgcatgataaataaataactttataagaagttggctgggctcatgggctcatgcctgtaatcccaacacttcaggaaaccaaggtgggcggatcacttgaggtcaggagttagagaccagcctggccaacatggtgaaacctcgtctctactaaaaatacaaaaaattagccaggcatgtgcctgtaatcccagctactcattagactgaggcatgagaatcgcttgaacctgggagtcagaggttgcagtgagccgagatcatgctactgcactccaacctgggcgacagggcgagactgtctcaaaaaaaaaaaaaaaaaaaaaaaagttgccaaactgttttctaaaccagatgtatcattgtgcatttcacctgcaatatatgagagaggcttagttgctctacatcctctccaacacttgggtattgtcagcttttaaaattttagttattccagcctggccaacatagcgtaaccccttctctactaaaaatacaaaaattaggtgggcatggttgtgtgcacctgtagtcccaggtactcagggggctgagggaggagaaacgcttgaacccaggaggcagaggttgcagtgagccaagatcgcgccactgcgttccaccctgggtgacagagtgagactccgtctcaaaaaaaaaaaaaaaaaaaaaaaaaatttttttttaaagtcattctagcaggtagtcagtagtatcttgttgtggttttaatttatatatctccatgaagactagcaatactgagcttcttttcgtgtttttattttactattttctttgatgaaatataggtttatatcttgccagtttttttgagtgtctttttattattgagttttggaggttctatatatattctgaattcaagttttttctcagataagtattttgcagatattttctcttaagtctgtggcttgtcgtttgattttaagtgactttcaaaaagcagaagtattgaattttggtgaggtgtagtttgttaaattttttatagttaataatttttgtgtatgctgagatacatttggctaacctaaagtcattttccttagaaattttagttttagctcttacatttaggtttataattcatttcgagttagttttcatatatactgtgacataagggatgtttttgtcttttttttttttttttttttggatttggatgtctaattgtgcctgcactgtttgttgaagagacagtcctttattttttgagacagagttttgctcttgtcgcccaggctgggattacaggcttgagccaccatgcctggctgagacagtcctttattaaataacctttgcacctcccctcttcacattttgagaacttccatgctttctgatacaacaaaatgttttagcctcactttgaacttcccctgctctagctttagccccagtggaaacataaatttctaatagaaatggtcttggccattcctccaagaagatccggttccttctaattgggagtggtgtgtagagacaggacagggtgctagcatgcttgttcctgctggagagccatggctctcggttaggagatagagctaggaaatatgtatattttgaaataacaagtttattttatttgattttagagaaaagaactcacttggtacccgggctgtagtgcagtggcatgatctcacctcactgcaacctcgacctcctgagctcaagtgatcctgctgtctcagcctcccaagtagctggggctacaggcacacgccaccacacactgggctaatttttgtattttttttttttcctctgagacagagtttcgctcttgttgcccaggctggagtgcaatggcgtgatctcagcttaccgcaacctctgcctcctgggttcaagcgattctcctgcctcagcctcccgagtagctgggattatgggcatgcgctaccacgcccaggtaattttgtatttttagtagagatggggtttctccatgttggtcaggctggtctcaaactcctggcctcaggtgatccgcctgcctcggcctcccaaagtgctgggattacaggcgtgagccaccgagcccagccaatttttgtattttttttgtagagacggggttttgccatgttgcccaggctggtctcaaactcctggactgaagccatccacccgccttggccttctcaaagtgctgggattacaagagtgagccaatgtgcctggccccttttttagttttttttgttttttagacaaagtcttgctctgtcatccgggctggaatgcaatggcgcgatctcagctcactgcaacctccgcctctggggttcaagcatttctcctgtgttagcctcttaagtaactgggattacagtcatgtgtcaccacactcagctaatttttgtatttttagtagagacagggtttcaccctgttggccaagctggtctcaaactcctgacctcaggtgatccacccgcctcggcctaccacagtgttggtattacaggcgtgagccactgcacctggcccccttttttactttttaaatgtcttttgatgagcagtttattttttattttattcatttatttatttttgagatggtgtttcgctcttgttgtccaggctggagtgcagtggtgccatctcggctcactgcaacctccgtctcctgggttcaagcaattctcctgtctcagcctcctaagtagctgggattacaggtgcccgccaccacgcccagctaattttttatatttttagtagagacggggtttcactatgttggccaggctgatctcgaactcctgacctcgtgatctgcccacctcggcctcccaaagtgctgggattacaggcgtgagccaccgcgcccggccagtggtttttaattttgaggaatttcttttttctttatggtggatatcttttgtgttcaactctttgccagccttacagtcttgaggctttctcctgttataaagtctttgtaattttagtttagatcacatttaagtgatcctaggtctaatttttgttgtggtatgagttagagatcatggtttgatttttttttcttccccccaccccgctccatgcagatacctagttagttgctctggtactatttttttaagagatttttaatttgttttggtgtgtttgccaaaaatcgagtgaccttatatgtgcaggtctttttcgtgctgttctgttgatctatttatccttacacaaaaccatatcctagttgttgtgactttataggaagttttaaaatctggtagtgtaagtcttctatttttctttttgagtgtcttggctaatatcggttagatttttaagtttttttgtttttttttttttttttttgttttttttgttttttttttttttgctttttgagacgaggttttgctctgttgcccaggctggggtgcagttgtgtgatcatagctccctgtagccttgatctcctgggcttaagtgatcctcctgttttagcctcccacatagctaggactacatacaggggcacactaccacacctggctaattttgtttttatttttgtagagtcaaggtcttgctgtattggccaggctggtcttgaacttctgagctcaagtgatcctcccaccctggcctcccagagcgttgggattacaggcatgagccaccctgcccagcctgattttctatctgtgttattgtaatcactttcttgataatgtccatgatacacaaaagttttaaagtttgattaagtgtgacttttttttttccctcttgttgattgtgcttttagtttcatatcttaaaaaccaattgccaaacccaaagtcatgaagactcgcctgtttttgcttctgagagttgtgcatgttagcgcctctgtgtaggtctttggtccatttggagattgtaatcactttaatatgcagctaactttctgttcatgtttaattttagattctttccccatctttgttgacttagttttatttctttaatatgtaaaacagtaaatgcttccagaagtcaaaactatcattcccgtctcatcccgtctgtctaccctaatccctcacacctgttgtaggtaactaatttcattgcttgctttttgagacggagtcccactctgtcacccaggctggagtggcgcaatctcagctcactgcaagctccgcctcccaggttcacgccattctcctgcttcagcctcccgagtagctgggactacaggcgcctgccaccacgcccggctaattttttttgtatttttagtagagacggggtttcaccatgttagccaggatggtctcgatctcctgacctcgtgatccacctgcctcggcctcccaaagtgctgggattacaggcgtgagccaccgcgcctggcccattgcttgcttttttttttttttttttttcctttgagacagggtcttactctatcgcttaggctggagtgcagttttgtgatcttggatcactgcaacctccgtctctcaggttcaaggggtttttgtgcctcagcctcccaagtagctgggattacaggtgtgcaccaccacccctagctaatttttgtatttttagtagagatgggggtttcaccatgttggccaggctggtcttgaactcctgacctcaagtgatccacccgctttggtctcccaaattgctgggattacaggtgtgagccaccatgtccagcccattgattttttttatccttcgttttttttttttttttttttttttttgcaaaaatgagcttataaatgtgtgtctgtttatatatgtgtagatatttgtataaaatcctatttttcttaaactaaagctaccataccatatactcttttgtgggtttttttttttttttttttacttaatgtgtgcggggaatccctctttatcagtgcttaagagatttgtctcgttctcttttgtggccacatagcaaccagtatttagtaggcctagtcctggctggaggctcagagcagatactaaacttgagcatttgtactgcatttatttctggactttgctgggctagcttcctttttgccagttgcagtggaccacactaaactcaggacagcctgtgagccaggggcatgggagtaaaaaggtctccctatttcatgcctgactgtttgggactcaccagactcaagagcataaaccagtttgagaagtaagaagaaaggcgagaaagcatttgaaatgatccccgcttcctttcatttagtaggtcttgtccttggttccccttccctgtgtctgtgtgaagtgtgccagccagtgtgccttggagcttttaataagtgtctgtccgctttcactcagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaaggtgagaacttttctgaacacagaaggtgttttcattacttatagatgggtggggggtttagaaggctggtcgctgtccccaaggtgaaaggggatgagaccaacgtgccacaccccaggcctgccagaccccttagaggtgctgcaagagccacctgttaggtaagataaggacattgtgtcagttcagtagaggtacccgcagacgggcacacacatctgtgcaggagggcgctcatcacagccctggcgatcacagtggggtattgggcaggaacgccatgccggtctgtggggcgcgtggtgaaataacagtgcctgtgtctcagtgaccatgttgctgttctgaaggtggaggagatttgtgccaggcaggaggcccatagtgggagggtaggagtgagacattttgctgtgtgccttttcttttggatttttgagccacactaatggatctatcaaagcattatattgaccccttccccaaccccagaaaggggacataattccatggggaactttgtgattttcagtatatgtagtttcatgctgtatcaagatccaaatttttcttacataaaagcatactatgtataccttttgtttcccttttttgcttaatatagcctggaagtcacttctgatcagcagagtgagggttccttggcacaaaaggtggcctcaaggaagtaactgggattctgaggttcttcttgccatgtggcatcagcttgagcttttttaaaaaagtggttcctggattttgagttcttttcaagaaaattgggaacccatcatagctcagacttttggggagttgtaggaatagtgttttatgttttttctgcccatttactgtcatatgttgaaatatgttaaaaaacagccgtcgcagtcatagtgacgcttcgttatagtgaaatgttgatgttggtttgctaagaccttaaaatcacctagaacaatcataaaaaaaataaagcatcttttcattgttaaaatgttaaattaaaaaaaatcgaattctgagccattaggtcaacccaaaatctcttatctcctctcatatcctgatctctgagttgaccaagttcatgcagtgaataacattacagagtttctgccttgtttgttcctcagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgggtccgcatggatgatgggcgccccttcctctgaccacgtccagccttgggggctgatggcggttcaaggcctggacaccttcctgaggaggctggatcctgtgggccatgttctgccagcgactgtgatccttatttatttatttatttatttatttatttatttttgagatggagtctcactctgtcgcccaggctggagtgcagtggtgctgtctcagctcactacaacctccgactccctgattgaagcgattctcctgcctcagcctcccgagtagctgggattacaggcacgtgccaccatgcccagctaattttttgtatttttagcagagacggagtttcgccatgttggccaggatggttttgatctcctgaccttgtgatcctcccacctcagcctcccaaagtgctgggattacaggcgtgagccacctcgcccagccaactgtgatccttattaagaccttgtggcttgcaataatttgatagcttaaacataccacagaaatctgtaaaggctacatatcaaagattaagttgtttatcttaatgcttaaaaaaatgaatgtaatgtctgcacaccagcactactgctgggtgcactggtgggaatgtgggtgtgttgcactgaaatttggaagaaagagtcctggggtggtgggtgctgggagaagtttttcttcattacatctccttgaaggtttatgacattgctctttaccaaaggtaaattttgtaagtagtatcaagagatctgttcctcttcctcctaattcttatggagtctggaatctagggttacctcttccttagattgggtgacacttcagattagtatggaacatttctttgtacttagctgattaagttcaaagctaagtggtcatttcacataggcagcttaacttaattgtgatttgaatttaagtgctttctgatgtaagacagaatccttatctcttgtatagcaatttataacttagaaagttgacctcgtatattttacctatgcagtcagaaggtaggaaaagaatgatcctttcattccacaaaaggaagttgcagtttgctgagaggatcagtagtttgcccaagatgaaatggctggtagatggccaggttggaatttagtcccaggccagggaatggtttctttgactctctgagtcttgtgacctgggcttttggttttagcagccaggtgcctgttattacaatcaacttggaagggggttgtaagtagtgatgtgctggaacatgtttaacaaccaactcttcttcggggagggtggtttggtggaatgagctgaatatgtatgttatagatatatacatgggtgttatatacatgtgtgttataaattttactgacacaaaggatgtgtgttataaattatactgacatatatgtgtgttttataaattttactgacagaaaggatgtgtagtacaatttataaataatatacactttattgtaaatttcatacatatttcagtgtgacagttaccaacgatagtgttataaaatcagacaacacataatggtttattactatccagttcagcaaaggtgttgctcatgtcactgacaaatacatactgtagatttgagattttggttgtagcatgaatactggttgagatacattttttttggggtagaggggaatggagtcaacttgctctgttgtccaggctgcagggcagtggtgtgatctcggctcactgcaacctctgcctcccaggttcaagtgattctcctgcctcagcctcccgagtagctgggattcacgggtgcccaccatcacgcccagctactttttgtatttttagtagagatggggtttcaccatgttggccagactggtctcgaactcctgacctcaggtgatccacccacctcagcctcccaaagtgctgggattacaggcgtgagccaccacgcccggctggttgatgttttttatttatgttaataggtaagatgaaagtaaaacaggctgggcttgatggcttacgcctgtaatcccagcatgacggatcacttgaggtcaggggttcgagaccagcctgaccaacatggtgaaccctcatttctgctaaaaatagaaaagttagccaggcatggtggcacacgcctgtaatcccagctactcgggtggctgaggcaggagaatcgcttgaacctgggaagtggaggttgcagtgagctgagatcatgccattgcactccatcctgggtgaagaagtgagaccctgtctatcccaaaaaagaaaaaagaaaaagtgaaacaatgaagacatgtaacatcactcatttgtaaatgatatgagtggcttctctgcaaaattagataattttcaaagacgggaagatatttcagttttttgtgctagttacaatgtaatggctgcagacttctcatgcttttaagattaacctgctttattaaccttttcatcattgtaggtttagagttagacaataaacagcttatgatctttgatacgtagcatttgtatatttctgtggtataaatagtcccaccatggctgatttcaagctctcaaagtgatacttccaatggcaatgctgggaatagatgtacagtagttcaccatcacagactgtttccattgtacaaatgcaatagctgggcagaccctcagaacacagatgattataaaatgcagtcaaaaattacctctgttaaaataattatcagcttatataattaaatgtttaatactggctgtgtttaacagccagcttcccaaactcctgactatttaataattagctctcagagacaaggaggccaggttcggggcactgctgttatcttgcttctgaccatagttggttattttgctgacacaccaattcctgcctggttgttattctgaaggtttaagcactggtctgtgttttgacttctttgtgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaaggtgagtgctgtgggctctctgattgcaagatggtctctcgcctcaccctagggaactggggcacctccaggggcaggcttcaaggcaaggctttatctgcctgacagttcaaggagtcctgctgaggagtgtctcatccatttggaccataatgtgctcagaggggcctcgcatgtccactggccccaggaggctctgggttagatcgttgattgtgtcagtatctttgtggtctggggacgctttgtggagggcagcttgctcctctctatttgtaggatgaggatgaagggtaattaggactgaaattactaagtgtgatttgcactctagaaatgaagcctgtgtgaaagatttataactgttaggctttcgttaattgtggaataggctttgatttttctggcaaaataagacagtgtgacagtagagacaggccaaatccaaagtttaggtttgggatttcttttttcctatgtgagttaaacatcagatgaaaataatcccctgttgaaaaattcacggccaggtgtggtggctcaaacttgtaatttgggaggctgaggccttgaatccaggagttcaagaccagtctgagcaacatgatgaaaccctgtctctacaaaaaattaaaatatcagccaggtatggtggcttgtacctgtagcccgagctacaaggctgagatgggaggattgagccttggaaggtcaaggctgcagtgagctgtgatcatgccactgcactcagcctgggcgacagaccctgtctcaacaacaacaaaaaaggaacgtaaaaagaaaaattcgtgtctgccagaagtggtaagcaggacctcagcaaaagccatggctgaccttcttctttcccatcactgaatggtcctggtgagataaacttgaaatcaggcctgattcattcatgtctgccagtcatattgacagaaacagcatcagtcatggccagttaataactgactgggaccccagataccaccagtatagatcttagacttggctttagggtttttcatttcagaatcttgtaggacattcagagtgtcctttgttacttcttagaaaggtgatgttgtgttagacaaaattcttaggtaataacattttccccgtaagggtgttaattttggaatgtcaccttattttttaattggatatcagctccaggaaatattcttgatttatttgtttagcttcagtctgaaagcttctttccccaccttggtgggctctaccgtctagcatctctgctctttctggttaaatgcttcccgtcttcctgtgggtgcagagtgcagctcagcattcacaggttagtgcactttgttagatgctctttgtgggcaggggtgtgggcaggagggtgcattaggagaaggaggcaggctctgcccaggtgtctgtcagggtgccagtggtcaggtggggcagggtttttctgccgattgccacagttattgctgactggactttgtgtagatttagacagcaggagctaatttttcagtgatctgatttatgctcatggccttttttttttcttcttcttttttaagacacccataaagaaaccaggggatggaagaaaagtaaccttttttgaacctggctctggggatgaaaatgggactagtaagtgtgatcttaatatcgtcttcctctgaacgtgattctgggatttgcatgggtcctgaataacagcaggagcccagccagtgaggtcccgcatgcaaagtgtctttatcattccctgattccctgcgctgccatgcgtgccaaggggagggccagcgtggggtttgatggtgtcattgcgtttttccaggctgtggatgtggattcgtgtttaccgtgtatgtccctcccaggtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggtaactgtctggcctgagctgtgatggctgtgcctcaggacagtcatcttttggcttctctcagaaaatgaactttgaactttgtacttttttcttaaatcaagttctgtccagggatgggctggggagcagtgatggaagggtaggaggtatagaagtattgtaagcatatgtggtaagagaaatatctttatcctttggtagtaagatttcaacatgcaagccaaccctaaaagcttctaaccactagcagtggttgtaaatttggatttcaaagaacagactcatcgtgctgacactttctgtctggtaggaaaggatatggcttctcccagtcttgggcttctgagcagacacctaggttcctggaaggttctgggctgacagggcaggtgttagtatggccacagtggggctgagttggaaaaaagagctggtgatcttgcttgtggggcctggagctgcagccctccagcccactcatacttgctgttccctacctagcctcagctctcttttcccccttaggttgaatacaaagacttccccaaaaacaacaagaacgaatttgtatctcttatcaattgctcctctcagccacctctgatcagccatggtatcggcaaggatgtggagtcctgccatgatatggtacgtcacaccttgggtgagggattggggtgttgtgtgtttatgtggagcctgccttggttcagcttgttactagcctgaggaagatgggagaaagattgtcccatagaccttgagagcaatgaatcgtttgatagtgttcatatttttgaagactttttgtcatagctgattggatcgatttctcactcttgatcagaactcatcagctttagcccacctttcccttccttttccctgctggcctggaggggcaactgggatcctgcagctcacccagagactgcactcacttcatctctcaccagaacaaggaattgcaggtccacgttctggcagctgtaaaaaccacttgctttggtcttctgttcagatgaaattattgttataagaaaactgagaaaaggaattgatcagatcaacaaatctaagtaaactgtgatgtattcacttgatgggatgtcatgcatgcatgaaattaatgtctctgggtggggtgtggtggctcacactaatcccagcactgcgggaggctgaggcaggcggatcacctgagctcaggagttcaagaccagcctggccaacgtggtgaaaccccatctctactaaaaatacaaaaaaaaattagccaggtgtggtggtgggtgcctgtaatcccagctacttgggaggccaaggcaggagaatcgcttgaacccgggaggtggaggttgcagtgagccaagattgcactactgcactccagcctgggcagctgggtgagactgcgtttcaaaacaaaacagtgtctccgaagataatgtaataagaagaaaaatacatgataggccgggtgtggaggctcacacctgtaattccagcactttgggaggccaaggtggaaggatcgcttgagcctaggagtttgagaccagcctgggcaacttagtgagaccctgtctctatagaaagaaaaatacatgatagatttttgttagaaagcaggatataacatttatacagtctggttaccacatggttaaaaatactagaaggaaaaatataacattttcagaggttatgattcagtgaggtaactgaatattttttaatttgtattttaaattaaaaattcaaagttttatttagtagtaccagagttgaagaagttgccacctgtttgctgggcagcaggaactctcttgcctgcctgaccagtgtattatgctgtggtcccaagcggtggctgtggctttacccttctttccatccccactaggctgcgctgaacatcttaaagttgctgtctgagttggaccaacaaagtacagagatgccaagaacaggaaacggaccaatgtctgtgtgagtgcactgatgaaggggaaggcgctgatgatggggaggctgcccctcgtttgtgttgagtttacactatctgctgactcagcggggaaatatttgcctgagttactttctggcccttttgcctgaaagttttccagattctctgggcagaaagctctacttttaaaagacattttgaggctgggaacagcggctcacacctgtaatcccagcactttgggtggccaaggcaggtggatcatgaggtgtcaggtgtttaagaccagcctggccaagatggtgaaaccctgtctctactaaaaatacaaaaattagccaggtgtggtggcaggcacctgtaatcccagctacttgggaggccgaggcagagaactgcttaaaacctgggaggcggaggttgcagtgagccgacatagcgccactgcactccagcctgggcgacagagcaagactccgtcccaaaaaaaaacaaaaaaacctttttgagttggtcataccttcacatggtcagaactctgcattattttacaaggtacaatcttcccctcggacagcccccatcccatccctcctattctccccaccgcctcccccatagatcacatttttactagtttctcctgtatctttcctgtatgtttctttatacaaatatagacatatatttcttccctcattttcttcctttccccccacagagataagtacacacactctccttgcgtattttacttactggcataccctgggaaaacttttgttatcataaactggggcttttagtattgtacttcctgatgtttgccaatttcttttcatttttaacagtactttaattctcttacatttcaaaactagtgtcattttcatttttcttccttaaaggtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaagtgtttggtcctgttgagcagtaactaaaataagggaagatgtgagtaaggggatggaagctcgtcgtggggggaccagggccagcccctctgggaagcgttgctgcctcagaggcatgttgggtacctggatgtagggacttgtgccccgtccagacctgacattgctacccaaagaaatgaccccaaggagctgagaggagactgccggacacttcccagggcatcctcatctctcaccataactgagcactgaggaggacatgcgttccagcctggttgagggttgggctagttggttttcattttttaattttagaagaagtggaagaagattataaaggcttcactgtaaagccagcctatgattgtactgccggaataactgaaagtgatcagaaggttatggaaaacactaagggcagaaggaaatgcaacattttgaggagaaaagcagtgaaaggagaaaaagtgtctttacgtctttaaaaacaacaaaaaaagaattcatggacctgtgactcacatcacaaccctcccccagactgaaggttcttagagaagctgagcctggggccctgacttgatgcactttcgcagggagcgtacttgctggcggcgacactggaagccgaccagtgtgatcttttgtgtcttcgactatttataaaaattcattctgggccgggcgcagtggctcacacctgtaatcccagcactttggggggccgaggcaggtggatcatgaggtcaggagatcgagaccatcctggctaacacggtgaaaccccacctctactaaaaatacaaaaaaattagccgggcatggtggcaggtgcctgtagtcccagctactcgggaggctgaggcaggagaatggtgtgaacccgggaggcggagcttgccgtgagcagagatcgcgccactgcactccagcctgggcgacagagcgagactccgtctcaaaaaaaaaaaaaaaactcattctgggtacttcattgaagaaggggtgccctggggtaactttggtaatacactcaagtaagcattaagtgttaaaaatattacaataaaaaattatagttcaaaaacagtagtaagtttttcttctttttatttttatttttttgagatggagtctggctctgtcacccaggctggagtgcagtggtgcaatctggaatcactgcaacctcctcttcccgggttcaggcaattctcttgtctcagcctccctcctgagtagctgggatcataggcacgtgccagtgcgcttggccaatttttgtatttttagtagagatgggatttcaccatgttggccaggctggtctcgaactgacctcaagtgatctggccacctcggcctcccaaagtgctgggattacaggtgtgagccactgcgcctggcttaagtttttcatgagtagctttgcatagtaagacattacaatatagctttttttttcctttttgagacagtagcttgctctgttacccaggctgggttgcagtggcctcaagcgatcctcctgccttgacttcccagagtgttgggattacaggtgtgagccactgcacccagcagtatatagcctttctttactacttttttttttaaagacagtgtcctgctctgtcacccacactggagtgtagtggcatgatcacagctcactgcagccttgactgggctcaggtgattctcccacctcagtttcctgagtagctgggactacaggcacatgacaccattcctggctaatgatatttttttttttttaagagagagggtctcactacattgcccaggccagt

SEQ ID NO: 16014 - DNA, 78850 bp, Human; identical to SEQ ID NO: 16013

SEQ ID NO: 16015 - DNA, 78850 bp, Human; identical to SEQ ID NO: 16013

SEQ ID NO: 16016 - DNA, 78850 bp, Human; identical to SEQ ID NO: 16013

SEQ ID NO: 16017 - DNA, 20870 bp, Human
acaggctgggacagccctgcagggtctagccctggaaagtcgaccattttctggacggagggcggcgccaagcctccagcccggttcagccgaggaattgtgctcagttcaggtagggcaagggaggcccagagcatggggagggcttcctgggtctgtaaggccccttgccagctccggcttctccctagctttttggagccttctgcctactctgctaggtttggggagtttgctgaggtgtttggagggagaattccccttctgcagccttgggtggaatggggagttctcccagctcctgccttccttccacctgtgagggaatgctccaatctgccacagttcccatccccttttaggaacgcccggtggaaatatgggaggcctggagattttcgagaaacaagcccagatgaatcaaaggtccttactagagcaactctgaggcgggacctagtgtagttaaggagtttgtacatatagcagagagaaaagacagaggtaactttcttttggaggacaaacgaggaagctcagccaggaaaattaattactctgtatttcctagtgtcacattaggtccttttctttttttttttttttcttacttaaaaaaaaatcccaaaaccgaaagggataaaagccccagaggacccagcaggccccggtgaggagtccaaaagcccggactgaccagtctggacgagtaggtggctcccaggcctccaggttccgcggcagccgggctctgcctcgcgagcacgcccgcgttagtagcatcaccaaatcatgaaggaactctccctgctttaattaaaaaggggaatcttgggaaaactagagcagattaacacagctaaaagtcggttcccggtgatttattttgatgcacgcacgagacggtatctagacttgcaggcacacacacgtctgtttttaggctcaacttcagaagcgggtgtgcagttccataggagttctgtattcgtgtccacgttgcacccaggaaaccttagcctgaacaccaatttgaactgtcagttggccctagcttcacacaaacaggagaaaaattgtttaacccctggagctgtcaagtaacctcttcagggtacaacttttattttacacgctgcaattaagggattgcaaaccccagcagagccaccggagccgcttggcagaatctccaacctgggggaaagctcaaagccaataaaactcccaaggcgctgcggcccgagggggtggctgcctcgagcggaggcgatcccttgttgggaaaaaatcctggagtgacttcgccggtcttggtttggtggttatgtttaattgcgaaagggataatgatttctaataaaattgcacggggccaaaagggcagctcggatcgtggtagcagggttaagggagaagtgctagaagctgggccccaggcgtggcgcttggaccttgagcagtgccgggctttgcagaaggcatctctggagaaaaggaagcggagaaagaaaggaaggggaatgtggcggaattggggtaagagagggggtgttggggcagggcctcgcggcggagctcgaggaaggttttatcagttcgcaggctggagtgcgctctagaagcaagttcgcggcgtagagaggcctttatacctgtgtcggagcggccggcggcagattgtggtactggcgagcaattggactattgttgatatgctaatgaggcgattaggctgttggtaaagagctggaaaagggaaaagtttctaccattagagggagatctccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggtaagcgcgacgccggctcgatcatccgtgcggtcacaggctccgagcttgaccctccctctcctcctcctctccttgcaaccagctgcgaaacgcgggtgggacaaactttccccagcgcagcgcccgtccctcggattcgcccgaagaacgcgggggagaagctggagagagaggacgtggatgctcccttctttggtttccctactttgaagctcgtgtcccactttactcccctttctgaccaattttggctgtgcctaagaatgggggaaaagaagaacatgggcttttgaagcaattgctggcaactgggcacttgcctgtgcactcctcgtgttatcttcatcgagattgagggcccaagtcaccaggaacagaaaggaaagagaaaactcttttctctcttgaacttcctctccgatctttaatattccttcttctttctattcattcattcattcattcattcattctttcttccccccacccccacttctaaagcggttcccttctcggctttagagacggcccccccacacttcgctgtgagctgggctgcatcttcctgtaagcgggttcaacttaagaccactgatcccagctgcggggctcgctccagatcctctgtgcttcacgaagttctaagtagcttctccctctgagctacaggatcgacgcaccccacgggggtgtgtgggggtggggtggggagatgtgctgcgccgagcctgctggccgctgggtgcgggagcaccagcttctgcaccagcccagaacgaccgtgggaatccttgcgcggctgcagaccacctctggtgccgcaagcccgctgggccgacagagcgcgccgctttggaacccattttaaaacgcagagtcccctgagctcgccttcttgaggcagcaagggagaccctagcgcgacctgtccacccgcaggaggcgctgggaacggttacaaccaacactgtaatgagcaatgagtccgagagaggggttggggtgtgtagggctggagattacctaaataaataggtggcagtcccaacttttgctgttttttttttttttcttttttggcatttgcagctgagaatgttaggcaggaggtgtgtgtgcaggcgcaggggcggagatcttgacttcactcgaaaccagaaattgggtttatgtgaacgatgtgtcacccgctccctcctcccttttctttctgaagattattttaaatcgttctcctttcaggccccccaccccggtagatggggacggggtgacatcccacgggtactggctcttccctgggggggtcctgtcgcgctagaggaggggcgcagggaccccacgtcagaccagtcgctttgttttcgaggctgggggcgagctttgcgggcaggtaggaatgaagccgaacccctcagtctcataggacaattcatactgtactggtctgggctttggccggaggcttgggcatttcactttcgcagaggccgaaacccagctccaggtgtgggcgccctcggcgggcggggtccgaacctccgtgcggctctaggtgccgactggatggggtgggtggctaggtgggggatgaacttgcacccctagagggatcctgtgggggcaagtgtgaatgcgtgtgtaagcgaggcaaaaaaagatgagagagagaggagaataaagtcaaagctgtttccacaactttggccgtggtgggcaagcgccggagcggggatttcgggtttcggagctggcttggggcagtctgattgtgccggggctctgtagggacacgcaggaggcgaggtgccgcttgttctgacaacctggcgggtagactggcaaaggcagcacgccgggagagctagtcgtgtcatctgggggggcgtcaggcgggagtggcccagccagtcggacgggtttttgccgggagccgcgagccggtgccagcggcgcccgggctgggccgcctagcgtctgtgcgcgccccggcccgcatcccggctcccgatccggaatccccggccccagagagccgagggcagagcgacggtggccggggagcgcacggtgcccctgtccgaggaaagctcaagaggaggccgaggagaggaccagtgcagcgagcgggccggtcccgggcagggcgccgggtcatggaggagccgcgcagcagcgggcagccgagtcccgagtcccagactcggctgcgaagcggcggagcccgcggccagacagggccgggaagcgcctgccgcgccgagagccccacgagcgcccggacgcggtcccaagcagctcctacccgctacgcacgacccccgctgcatcccgaggtctgccccagccttttaggtctgattgtcctcgctcgcttcctctccccttccccctcccccgcggcctccccctccgtgcgctccggctgggccccctccccctccctccctcccttcctccctcctctttccctcctttcctcctctcgggctctccctccttccctccctcccctctccccacccggggctcctctccctcgcccacactttctttctcacacacgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggtgagtcccatccccacccccgttgctgtttctttaggaattggattctggaaacctggtgccgtggagctgcccgaaacctcgggtttcacgcccagctttccttcaggacaccctctccatttgcatcccccaccccaccttccgcctttctctcgctcttttccatccctaaatcgagtgcattaccccctaccccagcccccgctcgacctctccgagcacgcagacctacctcgccgcggcttcccaaggcgtgtttctccccacgttcatcttgatttccttgagtcttcacttgtccccgagatgttctcaacatttgatgcttaaactgtctgcaggaaaagtgcagcgcggtgtgccccctaccctcgggacctgcggccgaaccgccgagggttcgcggtctctggaatcaactctcttcgcttgttttgcaagggaattgcaatagagaaacctaaagtcaggcgtttcttctgccctttggggctggggtggaaggggcggggggggggggccacagccccggggtgcacctctctcttttaaacccaataaggctgaatctttctattttaaaccttgacttgacgtccccctttccctatccaaaccataaatcgactctgtcgagaaaaaggctcctaacagaggaagcgaaaaagacagaccccgatcctgcagttaaaaccttctttaagctggtaatttaaacgtgtgtttttgttacagcccctctgcgaaatatgtttctatttaagtagtcatgaaacggtaacagtctttgaacgtttatgatttttttctctccaaataaatggaagagaataaacaataacgcagtggcagacaggttcaaatcgggggaaaagaaaaggccgcttctgctgtttagtatttaggaggaattttaattttgcttaagagagatttcacgctgcagtttaatgggctgtgttccaggagacccttttctatcttttcctctctttgaaagaaacccctaaatagtctcttgtgccccctccatatacagtttctctgcgttgttcggtctgtttcacttgagggtatttcctgaaaagaacttagagctgattttttcccggcggccagccaacgggaacgggcgatttcccacgcagacttgtcaagtggattttgtgtggatagttgtagctcgacgcctgattccttgttctttacctttcctctcgctctcttctaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccggtaagaggccgcgcaaccagcgcgggagggaacacagccccctacttacctaccccagaaaggatacctggaacatacagtcggtgggcccgggttctccctagtatttccttataaaaacattttattcggaggcggagagtgagggacgttttgaggaaccacacaaagtagttgcgagttctaccccagaacaatggtttctggagctccctcaaacaatgcctgcattaccatttccaccaacacagataaatcagacgaatgtcaccattaacaatatcttcctctcgacgacagtaaactgtctcaattgctaaaagatctacttccatcgctgagtctggcgtggagatttctccctgtcctgggaatgatgttaaatgcaaccaaaagagctcattaaatgtcctcaaaatgtaaaaggaagtgtaaaagacacactaagatcattttaaccggattttataagcacaagtgaaacctaaaagttatgtgtacaccctatcctgattaaagaaaaactaagtagcaaatccaagcagagggacattaaaatgcagccttcttcttactaggggtgctaagtggtgacctcataaatcattagctaggttcccaacgcctatcagaacctgctacactccatattaaattaaatgtttcgagactattgggtaatacattatttgagttctaatttagttatcaataaatgcagtttaaaatgatttctaaataagcatggcattagcacatttactatttacaatgcaaaccaggctattgataatttgaaaatactttctggaattaaacttaaaccagtacctctgcttcaattctatatatttatggtttcctcacaaccctcctgaaatggaattagagcaagccaataattttattaaagctgtaaaggcttctgttaaagctgcttttctttggagaggaaatgtatctggatgtgatttttactaaaatgctatttcaaattactgcatcaaatattgcagcagtatgtccgttgacagtttaatgattactacattagattgtaaggaaaatggtcagatgaacttacctccttgcttggtgaatttaaaacattatttaagttccgtaggaaaatagaaaatttattacatctctcatttggcccagttagtcactgaaatttgttggttatgtttagcagcccttgcatggaaggcaggaaagtgggcacttgatccagtataaggtttagtgagcactgtatgtctgtatatgtgtgttcatacttacatgtttttagaaactgatacttaacagtgcatttttttggaagtgagaggagcactaatttatataagagcaatttaaacatgaactgggagttatgattattttagttccctttcccaaagcactctgaatcttttccttgcttgttctttgaaaatatttgaattgcaaaataatgttgcaagcttttggaactactgtgaatgagaattgctctactttgcaaaaatttcaaggtgaattcttaacacctgtatactcactctttgtggcaaaattggtcagtaggagaaactaactaaaagattaaacaaaaacaaggaaacccagttgctgtttttccctctccctcccccatcttttaagaaaaaaattctttcaaaggaatttgggtcaagaaaaaggttgttttcaattttttcccattgctgcaacagttaacctttagtaagtataactgctaaatatttaagaaaatcaaatcgatggtgaaaattatttaatcattaatatctcagtggggttttaaacttaacagtcttccctgtatggacaaggtctagaaataacacaaataaaagtattatgccacactacatttactttatgggtttagggtgcatgcataaagggatcatatttccccatatagttaaaacacaagaactgcagcagtagtcatttctgaacatttctcaatttaattatacttaaatccagaagcactttaggcaagttacaaatgagagcattgagtataataaaacctgtaataaagcaacttagtaccatccacccggaatcattgcgatcaggcacaattaacaggagcataaatccaagacagaatggaaaatgttcgaatcagtattattgttggacaaagactagagaaggaagcaatagttttttaaatggtaatgcctgtgtttggtaatgattgcaaaatcttctatctcagcagccctggtgctaatttgtaaacacagccagacattatattgcctgtcagtttctgcattagaaaacatgacttcattttactttctaatcacgttttgactctagtgcgcacacgtatacccatccatctgtaaaaaaaaaaaaaaaaaagaaaagaaaaagaaaaacaccccacactaacaacaaacctgctgttggacaacaggaaagcaagctcaaaggttttttggttttggtcattttcatattcctatcatacccaggcttaggcagtagtctttctaaaaatttatgtggagttttccataaaggtgtgtgtgtttgctctttattatactacctaaaccttttcttttccaacactctcctgttactcccgcccctgtcatttctattgtgtttccctggctttcgctgcctgaacactggaattgctaaagtcagaagccgctgaggcgccaatctaaagctaggtacatttctaaatgttgaactgactgagaatgattaggtgctccaacacttgatttaatttccaaagaaagttttattccccatctccaccccttttaaacatggattatttgctggaggaggagaaattggccatgggtgtgcagtgaaacctcttgagttgcaaagccccaaattccaataagccaagatgagatgtttatatataaatgtcattatacgggagggggaattttgattctacaccttcccctcctcccatcttgcagggaatattcatttccttttgttttgatgatacacttacatccatgtgtatccttttgttgcagcatgtagaagacccgggtattaacatcccagatcaaactgtaattaagaaaggtaagccatttccttctgcattccaagcatgtccttacaggcagagtgctatttaaaagaacttgcagagatgtgtttattttttccaaataggatttcctaaaggctcagaattagcaaatagataggcacagaacagcaatgcttaaataatcagccttcagtatgttggtaatgccaacaggctagctttgttctgactcatgatttgaccatttaatttagtttaatgatatttggacaaacacacaaaatgtacagtagttgaactgatttggaagtggcatttcaattttgaaacagtttgatagtttaatccattgcctggatgaaggttaagaagtgtataatgctaaaatagtacaaataatttaacattaatgtaagaacagatgataagaagcactctttagtagaggaaaaaaacattcatgttcttcaatttagtttcttgttagctgtttaagggtcttagaactttgtgaattaggttaacaaaattttagcttttggttaaaattagtatcttgaagatgggaggaatattagcatacttgttcagaggagaaattgttagaaaagtgtcaagtgatttgcatggatttgtaatctgtattgtgtttagtgagtagaaataaagtttactgaattaaatgctattcactcttggtagcagctttttttttggttatggtggcaatgttacatttcaggattctaggcaccaccagaggacgatgctatataaaactgttctcatttctaaccccaatcagtatattgttagctagtttaaagtttcatttttgcatctgtgaagtctttgtcacgtcaaattagatgtgcaagggataaatcttaagagatgctctttccaagtcgacatgataattggctcttttattagtaatctctcaagagttcgtttaactcctattgtctctattagcctccccagagctattaatgtcacaagtgatctatccaaaacctagagccccccacctccctatacctctagcatatccccattaaagaacgcataaggaacactgtgatgagattgtgtgcatatgatgtctccaaatggaattttaaaatacaatgcatactgtacttaaatggttgtgaatgcatctgaattacactggtgctgagaaacgtaatgcattagtatactttctgcaggtcttctattttttttttttctaacagtggtgagtccagcaataaagagcttatggttttaactaggaagtatatatacccactttcccaataaaggcgctttagcagaggactgttaagtatttacttaacaaaagggcacattgctagtattccactgtaggcctgttcttccctccccactccgcagttcaaaactggccttggaatggatctccaaaactgagacgttttcaaaattgaacataggaaagggcctatttatcaaaaagacgggacgtgtggtgtggacaacaaaatccaccacttcccagcgtggtgcctcaattaaaacgctcgtttacagggtgctttagccatctaaattgtcggctgattttaataatgggtctttgaagcagtttttccccgacactaaaaccccacccagcaaaacccctgaagtacaagtaacttgctctcggtttgcaaatgtaattccctcccctgcaccctgaacccgtggtcctggacctcatctggggcccactccgctcggatgctcagcgcctcaggggtcaccaatttcaccacccatctctagagagcacccttgacggcgaaggggaaagggtcaaggcagaaacgcaggccaggctggctgggggagggcagggccgcctcccggccgccgggtgaggtagggaagggctcgagcccgaggaagggaagtagcagagccacagaatttcagagccggacggaaaagcggggactgtggcccaaagcctgggatccggccctggccgggatgagggccggggtcgggcaggatttgggggtgatccacgacgcccaacacgcggcctcccctctgtctccgcaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggaggtgaggcccggcacggccccgcccgccccgccccgcggccgggggaaccactgcgcttgcgccggggcggtggcggcgacgcaaacaggcctcgcgccgcggccctccctacgcgggaaaggaaagggggcggggagaagagcgtagagccaagtgggcgggatctgggggcgggggagcgggcgatgcggcgcgcgcctgcgctctccgctgctttcccgcgagcgagttctggtgcgcgcttcgttcgctgccgcgcgctcgcggagtcctccgctccgccctcctcctcgcgcaagcgcagctcgctccgccgcgggctcaatcccggccactgcagccgcggggcgccgtacagccaccttttccctcttcgcgcacaccttgcaagcccaggaaaagttcctctcaggctcctcgctttgccttacctctctgagtagggtctccgagggtaaccggtcgtgccttgtatagggttttaatagaatggcttttaactaaaggaagagaatggttgtcctcttgagtccgcacgccatgctttccggtcgctgtcatctccagacccccatactataggcgtttgcatatgatgatgattcccaatttactgaggccctgatgtgtgccaggctgcgtgcgagcatgtttacgtgcattgtgtgtagtcactaccaaggaatgcatctgttacatacatagccagggattcttacctcacccctgcgaggtttgagtgattcatttagtagataagattttataagggtcagcaaggtaaagcaccttcccttagggcagttttctccctgctgtgggcttcctacccctaggattccactgcacgttgtgagttgtggggcttgtgttgaacttacccggataatgtttcttctcttctttaataatactgagaacttcattgttttgactgttattcatttacttatgtgttgatagacccacagttcctttctagtggctatatcccgcacaaagcctataaagatcattttttggaagggtttaacatcaaccattctagtcttttcttcctcctgcacagtcattttgctttccctttgtagtctttcactgacacagatcttttccttgccctctgctttttccttcccttcccccatccccaatattggagactgtttacctaggggagtataatctaatccacacaattaaagagcacttgagtagggaataaaatctgaaattaattaatttgctgttttatttaaacaatttatcttaaccactttctgattatgggattctatttagacatctgtttagaactgcctccattgtctctgaaatcagtgaaacttttagggctgatatcagcttttgacatttccagttaggctggtgacatggcacgtaaacagttggcgaaacgaatttccctttggggctagagccagagcaagaaacgtgagagtgatgataactttggttactcggaacaacctaacagcatatcttgcaaagacagttttaaagaccccattgggattggtgtgattgtaacagcagagaaaatatacaggaatcagttgaactcaatacctcaaaccctagagatggggctgtgtttgtttgtggttcttctttagagagttgggaaatcaaaaccttccaacctgccacaagagttgcaataataactgaacgtagggggtgctttacagtttaacaggcgtttatctcctatgaacttctgtactattcctaggtttccctcctttaaatgtcttggggccaagcttctcagtttttgaaagcacattttaggaagctttcaaaatgattttaatgtggtgcagagcaacccaatgttttctaaatccctttctcgcatatatttgtgaaacagggcgaagtctaaaaatggaggaagatctttaagagaaaaactggacaaaataggattaaatctgcctgcagggagacgtaaagctgccaacgttaccctgctcacatcactagtagagggtaagcgaatccacttgctaactagaaggaacttccttcttggaaaatggataatatttagtggccagatgtttggtcgtattttatgtcagttgggcagtttcatctttgcagagaatatagccagatgtgaatggaattatttcatggcaaaaagaaacatttgcatgtactcctatacctccatccttcttccttcttttcctctaccataaagttacacctccccagcctaattctgagctaaacaacgcacaagtttaagaactgcacattctccaagtttgtctcctttaaagggctcagcagtaaataacttaagttattctgacatctgcgtttgagaaatgcgtgaccattacttcctgaattaatttgggaatctttgacctgcgtcctgatttaagaccatcctgaaagctcagggttatgtgccctttcaggtctttgttttccaaacatatgctcccttatctctttaattgtgcttttctcttggagaagaagaaaagtgagcaatttttgattctggatgatgtggatatggaaagataaatataagcattgcaaaaagtttctcctggtagctttaaacatacatacacccttccaaatgcctcaaaacaaaaagccaacccttatcctcactccctgctctagataactgccaccggaagccactcatattcctgctgcctctagattaagtttttctgatacaagattggcctaggttttggtgtactggaatgaatctatagctctcctgtgtttttctttgtgtcctattgtaaatatctcatgctaacagggaaaaaaaagttactttaattaccagacagattttaaaactagcatgtatatatatttaaagaagtcattttatttcattcacatcttgtatttgaggagatatattacaattgaatttaagttctggctttgtaaattattttttaaaatgtttaaaaccatatatttgaggaggaatcctatgaattctctttgttgatgatgtcagagattgatagtaatataactgtttagaaaatcagcaattgttcagtgccagaaactcaactacagtaccattacattaaaaatcataacagtccatagagaacccactattcatactccaaaagaattataagccaagaaaatggtagtggtggcttaaggtatagcgtggagttcgtctgggtttgggggttgagttctgtagcagggaggcagtttctggagaactgttattgtttgtgatccgctccattttatggaaacaagctctgcggagagggctttgatgctctaattggcgcatgcgttcttccggagctggagctaatggcaggaagccctgcagtaaaaaccaactggttcaggaaattaaaaccaaagattcgaaaatcaacaacacagacagactcagtggagtgaccctcaaatcctcttggttaatcggtttggatgaacagataatttatgtgatcaagttaaaatgtaacccctcagttgttcccttgcagaaaagctcaaagagtaattatgaatatcatttatgaatgtgttgataggtgtgaagttggaatacaagaagcattttaaaagagaatttggagaagtgtcatttagggtgggggatgggactggaggttggtggatgagattttcattttcaagtcttcttggccctctaggagaagtggtcatttttcctgataaatgcatccaccagatcctacagagaaggaaataaaatgcctgaaatgagaaaacaagtagtttgtgtttcctgcaacatctggggtgaagggaattagggagttgggagtggggaggaagttaggatccccactcttcattctctcgcactggctccctcctctcccctcttgccaggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaagtaaggcatttacctctatggggtctctgtgtctcgttgtcaagagaaagagaaacaaaaatcgtttttgctcttccttctcccttgttttccttttgtgttaatcagctttgttgcagttataacaccatcttatatatagtctatgttaaggaagaaatacaggtgggattcttgggcgctcccatctttttcctctcatctgtcccatttactcatttttttttttttttaatgagtgtgtatgggagtgggttgtaggaggggtttgactgaagttaagggtggatttgtgactatgttgtttcagaaagaccagaatcaaatcctcaaaggggtaacaggcttacctatatcagtttttgtatcctatcaatatgttctccaagggcaaagattaaacagtggcctgcaaaatgtgcaagccagaagctgtcctagtttcaaccctaatctgttattccatttcttaccttcctttcacaaccccttctcgaaagtgacacacacacacacacacacacacagagagagagagagagagagagagacccacaccccacataagttttagcccacaggcgagaagtcaaatagatttcaaaatggcccaagttatattcccatcggtgcctgggctgaataggcttctccaggtgatgtgtgaaaagaaaatgactgttttgatgtgttttctggaaattaaaaggcttgtttggaagcccttaattatcaaagttgatgtcacaggagggcatggaagcagagggcagaagctgaggccttgggtgggaccctgtttctggcctggggacatcagctggccttggagaagggagccagcccaggctcctcattcatccccctccccagccccccaggccaggctgctgctgcccctggaaggccccagctagcccttgcttcccagattcagagacagagcttcctgagtgcaggcctcatctacctctgcgaaatttcaactttctctttccccaggcttcgtaagcacacccatctccacaatttccctgcagtatttttattttgagctatgtggggaaagaggaggaatgggaaatcgaaatgtctgtttcttcttcccaaacactactttgaattatctccaagtaacagggcttgtgtgggcccgttttgtttttttgttattcttgttttttaaaggcaaaataatcccaagtaaagttttgtctctctgtccacattgacctgaatttgatttgaaggtgaacgagtgtggacttcattctacaaactgctgctgaggtctctctagaggagcagggaagagggtctttatgacattttgaataggaaggctgatggctgcagcataatgttcgcaagatgctactgtttctgacttccggtctgcgtgactcctttctttctcttccaatgtgtgaaatggtttcctatgtctaggatgttttgtgtgagggagaaaggtgggaataaaagtttaccatatctgagaggaaagagagagagagtcatttgtgaaggtaggaagtaaagagagatggtttagtggtcactgaaaggtggctggatctcccaacatgtggccacactgtctgtctctggggtcttgggtcatgtcaggtaccggctggatcccggcagaggtagctgcagggagggaggttttctctttgctgctagtgctgcccatagtggagccttatgtctctctctctgctccacttgtgctgcagacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttgatcctttaggttttcatttgtgttttggaaaccaaaatataaaatctccaggaccaaatgttaaggatgacaaggaagatggagaagaacagaagaaacttcccaccagcaggccccccgcctaacagctcccccccccccccccataactgctttggaatttgtctcagaggataactgagatttaaattgttagttcattagcacaaaggaaataccgacttcaaccttcacttgcttgctcagggtagtcagcggctaagacgggcaaatgagctcagaccagctctagatttctggcgggagaaaaggaatagtggcagaaatatacatgtagcagggaaagagagggcaaattgtctcccatttattttcatattttatttagagatgaatttactactgtgctgttcttcagtagctctcgaggtagagaggggagtgggaaatgatgttgatccctggaatctttcctgcttgcccctaaatgccagcccaccccttcctatcacc

SEQ ID NO: 16018 - DNA, 72128 bp, Human
ctatttagtatacaatagcattttgtctagaaaaaataacatacataccttaatttaaaaatatcttattgtggccgggagcagtagctcacacctgtaatcccaacacatcgggaggtggaggcaggtggatcacttgaggtcaggagtttgagaccagcctgtccaacgtggtgaaaccctgtttctactaaaattacaaaaaatagctgggtgtagtagcttgcgcctatagtcccagctacatgggaggctgtcaaaaaaaaaaatcttattgctaaaaaatgctgattatctgagccttcagtgagtcatagtctttttgctggtggagggctttgcctctgtgttgatggctgctgaccgatcagggtggtggctgctgaaggttgagatggctgtaaccatttctcaaaatgagacaacaatggtatttgctacattgacagacttttcataaaagatttctctgtaatatgtgagactgtttgatagcattttacttacagtagaacttctttcaaaattgaagtcagtcttctcacatcctgccactgctttgtcaactcagtttatgtaatattctaaatcctttgttcttgactgggcactggttcatgcctgtaatcccgccgaggcgggcggatcgctgaggccaggagttcgagaccagcttggccaacatggtgaaaccccatctctactaaaaatacaaaaattagccaggtgtggtggtgcgcacctgtaatcccagctactgggggtcggggtgggcacctgtaatcccagctactgggggagtgatggtgacaggggtgaggactcagggacaaaaatcacttgaacctgggaggcggaggttacagtgagccaagattgtgccactgcactccaaccagagtctcactctgtctcaaaaaaagaaaaaaattcttttttgtcttttcagcagtgttaatagcatctctaccagaagtagattccatctcaataaaacagtttctttgttcatccataagaaacacttcctcattcattcaagtttgattatgaggttacaacatttcagtcacatcttcaggctctacttccctttttatttattaaaaaatttttttttctttagagacagagtcttactctgtcacccaggatggagtttagtggtgtgatcatagctcactgtaaccttgaactcctgggctcaagcaatcctcgtgcctcagcctcccaagtagctgggactacaagcgtgccatcaagtccagctagttttttagtttttgtaaagaagggcatgatatggtgcccaggctggtcttgaactcctggcctctacaatcctcctgccttggcctctcaaatcactgggattacaggcatcagccaccacgcccggctatgtttcttatttctttgtatgaacctagtgtgacactaaatcctaattagtatttacatttttcttagtttgatgtaaaataaagtagcatgttatttaaatagaatatgaaattttaaaataatgctattcctttcatatgaaacaaaagtttgctttatacttaccttacccaattggggtacttatattccacagaaaatttacaagtagtacagttttaaacaatatgccaaattaaatatgatacaaaaattgattcaaagaatggatatcatatagacatcaattttccaaggtctgatttggaataatgtagattatatttagtaaaaaaggaatcatacaagccattatgccattattgaacataaatagcacagtaccatgtaaatgaggcatttaccaagtgagtattaccagtgagttatatgtgaacttcattttacatagacaaatgacttactgacaaatatttaacacaatagtatttatattatttataattttccctttgctctaagttgccagtacaatttttgaagagacttgttaatgaaaattcatgatatccttgttttctttctttagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggtactgtgtgtgacactgccaacttcacctttgaaaactctgctctttattttcctgtcctcgcttaagaatatataccagcacaggccagcgcggtggctcatgcctgtaatcccagcactttgggaggccgaggcgggcggatcatgaggttaggagtttgagaccagcctggccaacatggtgaaaccctgtctctactaaaaatacaaaacttagccaggcatggtggcacgcgcctgtaatcccagctactcaggaggccgaggcaggagaattgcttgaacccaggaggtggaagttgcagtgagctgagatcgcgccaccgcactccagcctgggtgatacagtgagactccgtctaaaaatatatatatatacgtgcacacgcacacacacacacacacacacacacacacacacgtgcacacaggctgtgtgcggtggctcatgcctgcaatcccagcactttgggttgaggtcaggagtttgagaccagcttggccaacatggtgaaaccctgtctctactaaaaatacaaaaattagccaggcatggtggtgcacacatgtaatcccagctactcaggaggctgaggcacgagaatcgcttcaacctgggaggcagaggttgcagtgagctgagattgcaccactgcactccagcctgggtgacagaaggagactccatctcaaaaaaaaaaagaatatatacgagcacagaaagaggtctagtttagatcaaatagcatctggctcatgtggaatgtcattcttggaaaagaacattgccaaagaggaattctgctgtttttcttctatattactttaactgtctggcttgtccagctacactgataaaccaaaaaatatgagtgcctccttttttatatgtataatacatttggaccaaaactacaggtgatctttggaatgttcttccaaatttatttgttggttttcgtttttgtttgtgttttttgagatgggggtctcactctgttgcccaggctggcgtgcagtggtgtgatcatggctcactgcagtcctgacttcccaggctcaagcaagctacccaccttggcctcccaaagtgctggaattacaggtgtgagccaccattcctgacctgtttttcacatttaaagttgagtgcagagtagggcttattatttctttaaaacaaggtctcaaaatcagatggtattcataatgtcaaattgagttctgaatgatatatgttatattcctgaacttatgaaatagaattgttgttaatttgtttgtttttaatccactgtgtttatctattgctgcataacaaaatacctgcaaagcttagtgatttaaaataagaagaaacatttattaattcacatagtttctgtgggtcaggaatttagaagtagcttagctgggtagttctggcttgggttctctgatggcagtcagataattggccaaagtttcagtcatccgaaggcttgactgggactgcaggatctacttccaaggtggctcactcttggtttgctagggctgctgtaacaaagtatcacagactggttggcttaaacaacagagatttatttcctcacagttctggaggcaagaagtgcaacatcaaggtatctgctggttgtttcttctgaggcctctctccttggcttgtagacagccatatcctctctaggtctttatatgatcttctcgttgtgcatgtctgtgtccacatttcccccctcttttttttcaagacagggttccattctgtcgcccaggctgaggtacggtggtacaaacatagctcactatagcctcagcctcctgggcttgaaccatcctcctgcctcagcctccagagtagttgggactgtaggcgtgtaccacaacatgtggctaatttttaaaaaatttttttggagtgatggggtcttgccatgttgcccaggctcctcttataaggacaccagtcatatcagatttgggcctacctgaaagacctcacttaaacttaattacctttttaaagaccctatcttcagatactgtcacaccgtgaaagtctgggggctaggacttcaatataggagttttgggggacacagttgaacccatcacactcactcacagggttggcatatttgtactggctgttggcaagaggcacctcaattcccttttacagaggctccttccttgggcctttccagagggttgtttgaatagcctcgggacatggcagttgacttccaccagaaccagtcccgtactcatgggatacgcatctccacattaccacatcaaccaaattatgacaaactaaaatttaaatactttagcaaatgttttaaaatattatgatctaaaccattacatgtacaaggaaataacttcataaaatatttttaaatagtcattatcatcagataagtaaatatataatatacaataatggaaatgaaaaataaattgaataggcttaataaaattcagtgctcatttgtgatttgatgaactaaaaaaaacaaacattgatttcttaaaaaacttatgataaagcctcttggctgaatgcagtggctcacacctataatcccagcactttgggagggcaaggcaggaggatcgcttgatcccaggagtttgagaccagcttggcaacatggtgaaaccccacctctacagaaaatacaaaaattaattgggcatcgtggtgctcacctatagtcccagccactcgggaggctgaggtgggaggattgcttgagcccaggaggtcgaggctgcagtgagccaagatagtgccaccactactgtacttcagcttaggtgacctagtgagaccctatctaaaaacaaaaacaaaagtaaaacaaaacaaaaacttagcaaataggaataaaaagaaacttccctaacctacataattcatattaatgtgaattagtacgaaaacctatataattcatattaatgtgaaatatcagaagtaatatcagtacaaattgtttgaaaaccccaaatgcctgctagcagtcctgctgattaggattgcattggggatacttactactgctataagacagaaacctaagaaatgagtgttattagacaaaatgagctgaaatagcccacatttgtagattaaatgattatgtaaattcacacaaagaaatactttattatatacaaatacatccatatacaaaaatatttttaaaggcctggaaagatacacccaaaatccatgatagccatgggttctggggaggagggtaggcgaatcagaaggggtgttgggtcttgggtacagtcccacggatggttattactgtctggttttatatgacaaaatgtccatcatttttttctgagtggcaaaaatatggtatttgttttatccttcaaaaatatggtatttgttttgttttgttttgagatggattcttgctctgttgccaggctggagtgcagtggcgcgatctcagctcaccacaacctctgcctcctgggttcaagcgattcttctgcttcagcctcccgagtagctgggattacaggcatgtaccaccacgcctggctaattttgcatttttagtagagacggggtttctccatgttggtcaggctggtctcgaactcccgacctcaggtgatccaccagtctcagcctcccaaagtgctgggattacaggcgtgagccaccgtgcccggcctactgtactcttttaattgggaaagcaaaagctttctcacatcccatccagaatgcatagggtttcttctcgttgatcagaagtgtaccacatggcacccctagctgcagggaggctgggaaactgattacttagctgagcattttatattcctgtgtaaaagctgactctgtgaatgaagaggtagagaaggagggctttcagctactcagcttaccgtgtgtctgccacatgcagtatctactgtgtgttgggcagtgctccaccttaggcaaagatggagcaaaaatgaatgagaagaggagtcccatggaagacttgaagaaaattgaaaaattcatttagcacaaaattgttaaactcctgttgtatttcatgatcgggacaaaatagatgtcttacaatatactcaggaagaccaacagattcaagaagttacaacatcaagtatgctaagtcctatgatgggggaatattgggtcctgtgggagcctagataagccacactggagaagtatcacaaaagtcttcccaagtcattgagacctcaagaatgagagaaaattatttttttaaaagggggggtggggggaaatgctccagggagtaagaaatagtacgtatgaagccctggaggcgagagagagtgtgtgagggcctaactggggctgagtaactgaaagaagtgtaggtggctggagcgtggattacgagtggggcagaggagggacgtgaggctagcaggtgaagtcgtgaagccagatgaaggagcgtgtatatcttgaagactagaaggtcatgaaggattttcagcagaattgttgatgtgatcaaatttttggaactggctgattagcagaagagtggagacgattgaagaggtcaagactggacaccaggtggccagttagaaggtcaatacagtcatcttggttagaggttagaaggtcagtgcagtcatgttggttagaagtggtggtggcctgacaggaaaatagctttggggatggatgtaagtggatacagtcaagggacatgtaggaagcaggctctatagaaactggtgactgggcatgagggtggagggaggagtaaaaaatggggaagagtccaggctaactcctgggattctggcttaaatgtatagtggtggtgccatgtaccatgtaccatgtcaaggaggggaaaatcacaggcttaggggtaaagctgaattcagtctggggcatgatgacttttagtcaattgaatatttgcatttaaatctcaaaacagaggtgcaggctaatgatttggaatggttagtctacagatggcaattgaaactctttagagggagaagaaaagaggtcctcatttagggcaccgagaaaccatggcatataaaggatgggccctggaataggatcttacaaaaaagtctgaggagccaccagagaaatagggtagaaaccaggagaatgtagaaaatatctgaaaccaagggaaagatctaaagaagcagaagcacgtatcaagaagtctggagtgtgatgattccagagctctttcaatggctcaacattgtacccaagaaattcagatgttttctatgattttcatgctgagcggttagcattgtttttgtcctcaaatgtgtcacctaatgaccaccttatggctacttcacctccaggcattacgtccatgttcaaggagggaagagggcagaataatacgagcaaactcttctcatcttttatcagctagtgataattcttccccagaagtcctcaaggacatccccttacatcttactggctagtattgggtcacgtggtctctcttccaaaggaggctgagagagtgagtatttactcttccagtctctatattaggaggcagaaggaaaggggctggaaatggccttgtgatatttcaacaatatcatcggctgtggtgttccttgggtttggggaatatgacataactggcggccacggtgagcactgttccagtggaatagtggaagccagactgcagtgggacaaggagtagcgggaagtacggcagtggaggcatggagctttggagagttgtgaaggatgagttactgagttgttaagaaagccacaaaggggttgcccagtgtcaggaagagtccgcctgaaattacatggacgaatgtgaaagtggagccgctgggagcattttcatgactttgctttccacctccacccatctgtatggagaggggagactggaggatgacaaggcaggagaggggagactggaggatgacaaggcaggagcagtggaacggtgggagaaggggatgttcagaacgtgtgtgtgatcttgagagtgtagtgggtgaaaggctgatggtggggccaagctggatgaggaggcaaaccacgccacacaggtggttgtaggaatagccacaagttgaacaagaaagaggttgtataaagaagttttgagggtagcgacggtgaaaaggataggaggttatgatcaagagtctgaagttaggttgttaggtcttggacagtaggaccattcctcataacaaggagtttatggtaactgtggtaagacagaggtgaacatctcttaggagttaagcaactgtgaagccaggctactggcagggttatcagtttaacctacattgaatattcactatagccgttactcctcaagtctgaatgagacagtgattgttatctacaagagtcatacaagcaggctttgccatctctttaaagcccgatatagagggataaactttacctgaaaattacagatattagagtcttcattctcccttctcatttttttttttgtttgttaccaaaacaattcacatcccataatatcctatcaatcttttgcttggtgatataaaattttaggcatttccaatttaggctataaatattctaggtataacttgttagataccgctttaagatccatcgatacttttcccctaaaattaaaaataaattccaggccgggtgtggtggctgatgcctgtaatcccagcactttgggaggccaagtggggtggatcacctgaggtcaggagtttgagaccagcctggccaacaaggtgaaatcccatctctactaaaaatacaaaaattagccgggtgtggtcgtgtgtgcctgtaatcccagcaactcaggaggctgaagcaggagaatcacttgaacccaggaggcggaggttgcagtgagctgagatcacaccactgcattccagcccaggcaacagagtgagactctgtctctaaataaataaataaatacgttctacattgaatacattttgtggagtagctgaagaagagctgcctattcttaattttcagagtgggcagtaaacatgtccccttaaagggaaattgattacctggaaggtgttttcattctaaaaaccttttaaacaaaagagccggtgtcgggggctgggagtgggggtttctattggaattagagaagttcagctatggaatttaacaagttccatgtgttattagatatggaatttaacaagttccatatggaatttaacaagtaggaagtaaacaagttcagaattacgttgagaagcagagaagaagctgaatgctggccctctgcttttgggagttggcctgaagaagcaagggcatggcatggcagttggtagatgatggacagggtggtgtaatctgctaatgtaaacatggagaagaaagtctgtgcttaattcagcaggcaaaccttttgagcggtctagaaatgcagtcaaaactggctaggatgtgttggagggggaatggttagaagttgggagaacactacactgaacaaaataagaggtttctttgaatgtttcctttggggagttttaatttagatcactgaaatcttgtcttttctgcaattttttttaaaaaaagttatttactttatgatagaggatggtagaaagattccctcacttaattaagttaataaatatctattaagccctctgccctttaagaacttgagaggtagttctatttctgaagttgatttcctgtgtcagatgggaacaccatggtaccatctcttatttgttcattgccctggcatggagtggatattgacgaattaataaatgacaaaagatggcaaggaacctaaaaggaaatgccttttcttagctattctaagcaattggtttacctttgggataatcattttgtaaggaaacttctgtatttgttgtaaatagatacatgcattgccttagggaagggaagtactgctgagaagtggtaattgctggaaagaagaagagatgaagagagtacatctggatggatgaagagaatacagattttttttttttttgagacggagttttgctcttgttgctcaggctggagtgcaatggcgcgatctcggctcactgcaacttctgcctcccaggttcaagcgattctcctgcctccgtctcccaagtagctgggattataggcatgcgccaccatgcccagctcatttttgtatttttagtagagacggggtttctccatgttggttagactggtcttgaactcctggccgcaggtgatccacctgcctcagcttctgaaagtgctgcgattacaggtgtgagccaccgcacccggccagcttttttttttttttttttttttgagacggagtctcgctctgttgcccaggctggagtgcagtggtgcgatctcagctcactgcaagctctgcctcccgagttcacgccattctcctgcctcagcctcccaagtagctgggactacaggcgcccgccaccacgcctggctaattttttgtattttcagtagagatggggtttcaccctgttacccaggagggtctccatctcctgacctcgtgatccgcccgccttggcctcccaaagtgctgggattacaggtgtgagccaccgtgcccggcctcagatttttttttttttaagagacaaagtctccctgtgttgcccaggctggagtgcagtggctattcacaggctcggttatagcacactacagcctctaacttttgagctcaagcagtccgcctgcctcagcctccagagtagctgggactacaggcgcacaccagcatgccagtgagagtgcagattttacaggtagaatgaaagtttcagttatcactgaagcttgaaaagtaacttgaacgtatttttatttggcttctaaaagattggatacttttaaaattctagacctggagtggtggctcatgcctgtaatcccagcactttgggaggctgaggtgggcggattacctgaggtcaggaattcgagaccagcctggccaacatggcaaaaccgcatctgtactaaaaatacaaaaattagtcgagcttggtggcacacacctgtcatcccagctacttgggaggctgaggtaggagaatcgcttgaacctgggagacagaggtaacagtgagccgagatcacgccattgcagtccagcctgggtgacagagcgaggctccatctcaaaaatgaaataaaattctgaaattacgtttcaagaatcatagcaggctgggtgtggtggctcatgcctgtaatcccagcactttgagaggccgaggtgggcagattgcttgagcccaggagtttgagactagcatgagcaacatggtgaaaccccatctctacaaaaaatacaagaagttgctgggcgtggtggcatgtacctatagtcccagctacccaggaggcagaggtgggaggatcacctgagcccaggaggtcaaggctacagtgagccatgatcaggccactgcactccagtctgggtgacagaatgagaccatgtctcaaaaaaaataaaataaataaaaagaatcatagcagattatatgtgcagtttcacatggatatgatcattttattaatcaacttttctttcatagctgtatttgaattggcttctgttttattttaaattcatcattgtgctagatttacattttacattttagcaagacattttataaatctatggcactgaaaagtatcttttaataagctagtaaacccccatttcatcacgcttcttcataaatatctagtacctgagtaactgcaaatgaaattctgattcactaaggatattttagaaataatagcagtgatgcccttgaggtcatctcagtgatgtcctttatttcgtcttatagtcaatcatagatattggtaaacatgaaaacatctagtagttattgagtgctgaactaagcagtttgcaagatgcttttcttatgcagtagtttctactgtatggctagctaaggaatttgaggcacagacaggtcattaggtgacttgtccaaagtcatatggtgagtgactgggcaaggatttgaatccaggcagtgcggttccacagcctctgttcttggctgtgatgttgtgctgccaatttttactcatttcctcacctgtgtattatacccccatagagcctctggatcttaaggattattgtaattaataaagacaacgctaagcttcccaaggatcttctggaacatctcgataggagattataatactaaatgaaagcagcatggcatatttggtttttctttttcacagcccagccttataattcccatgcctgaagaaacattttttagaatatgaatcctgttttttttaaatttttttttttgagacagagtctcactctgccacccaggctggagtgcagtggcgcgatctcggctcactgcaagctccacctcccgggttcacgcccttctcctgcctcagccacccaagtagctgggactacaggtgcccgccaccacgcctggctaattttttgtatttttagtagagatgaggtttcactgtgttagcgaggatggtctcgatctcctgacctcatgatccacccgcctccgcctcccaaagtgctgggcttacaggtgtgagccaccgcgcccggccatgaatcctgtttattatcccctgttttgtatggtgactaaaaatctgttcatataaaaacacatgttcatataaaaacaacaactaactggtgtatatagtggaaatagtttttactcttaaatacacttttggtatatttatctctaatagaaaccaacattgggatgaaagaggggaagtaaagaacaaaattcaagaaagccatttctcatctgtcgcccaggctggagtgcagtggcgcaatcttggctcactacaacctctgcctcctgggttcaagtgattctcctgcctcagcctcccaagtagctgggactacaggcgcctgccaccacgcccagctaattgttttgtatttttagtagagacggggtttcaccatgttagccaggatggtcttgaactcctgaccttgtgatccgcccacctcaacctcccaaagtgctgggattacaggcgtgagccaccgttcccggccaagaaagccatttctaacgtttgtagttacttctgaatttttgccaacttaaatcatttaagtagggagacatttaactttatgggcctcttaagttctaaaaagagagaatcttgaaaaggaccctttaagaaaggcacaattaaactgattagagaaatgttaagaactcacccagaaaagaagattaatggtaattttttcacttttgattaaagctgaattttggatgtgacgtaggcctaccaagtagccttgaggtataggaggtgatttccttataaggatgaggacagagaaagatagctcgcccaaagtgaaccagtagtggagtaagaaagccaacagtgtaatgtgtgtctttgaatcctcaatccctgaacactaaactttccctaatttattttaggatgaagagaaagttctattcttgggatgaatgcatgaacttgagagaagttaaggtaaaatcctaaagatgaaaagaacctgagaaggccttaacactacctgaggaccgtagttaagatgattttattctctgtgggaagcattctgaagataattttgtttgtttttcctttatattcctaaattaatttctcatttcttctggttctgatgtcagtggagaacagcgtataattatatcctcacatttgaaaattcactttcacttttaaaagagcatcttaaaatcatattatgcaaagacaactttttttttttttttttgtgacagagtcttactctgtcacccaggctggagtgcagtggtgtgatctcagctcactgcaacctccacctcctgggttcaagtgattctcctgcttcagcttcccgagtagctgggactacaggtgtgtgtcaccatgcccagctaatttttgtatttttagtagagacaaggtttcaccatgttggccaggctggtctgcaactcctgacctcaggtgatctgcccgcctcagcctcccaaagtgctgggatagcaggcaagagccaccacgctcagccaccaaagacaactttttaaattactacataccatttccttagattttatgcttaaagacttggatacaattttggatacctttgcatggttaagtcagacaaaagttagacctatttataaaccaagggaaaaacgtaacagattgaaatgtttaatagctattgttggcttgatttattgtttgcacttaacgttcattacttaaagcaattatgtagatattaaaatgtaattaattaatgaacccaggagaaatggaaaattacataaggtaattattacacttagcattgatgcaattttgccaaattctgtaagttttttttaagaaattttaaggcatatttgttatttttcagtctctgaagaaacttaatcatgccaatgttattaaattgaaagaagttatcagagaaaatgaccatctttattttatatttgaatatatgaaagaaaacctctatcaattaatgaaagacaggtatgtttttattcatgtttttccctgttattctctccatgagttctttggatccttttgatatgtcatactttatgagagaaagattgattgctccaaaaggtaaatttaaattaaccagttctgttacctttatcaaagggtaacatttaacactgaagaaccagctgtgacatagccagcatttttctgttgtaaatccttgaaagtgaaggccagtatctcatataaatacacatactatctatttatgctttttaaaatacaaatttatgtatagtttattactcaataataaagctggccttgggcattattgagaaaattatcttggttgctctcccaagcatcttgtgaaggttaatgaaagaatggagaaaggaatgaagttgctttcaagaaaggatctaaaaagctcagtcattagaatgcacaagtcagtgataagacttgatgtgttaccaatcccaaggaaattcacaatttttaaatatgtgtgggcagaatctgtaaagggagagctttggtcttccgccctgggcttggggagataatgttttggtggtggttctggtcacgtctgggagattaacatccattttgcctgcttttaaagtgagaaatgttcaacaacaaactctgaaatacttagaaataattttccgaagtaatgatgttgatttctctttgattcttacacacacacacacacacacacacacacacactctcgctcaaggtctgaggatgttacttgaattattctttaatcatatttttccctttctcaaaacatatttattgaatgcctcttatgttccaggccgaaatcatcataacattaatgtcaattaaaataaaagtaaatttctgcccctcaaatcagtttttactttttcagagtcccttctaggccttctatatagacatgcacgcctttttacttagttgtaattttagtgggacaaagttttttatttgattaatttacttacaagtattttttatgtggatacttagtctttatagttataaataatatattctgttaaatggctatactaagcttcactttttgaactatttaaaataaataattagtgtgaaaataggttggtaattattgtatataatattgatggaattattaccattaaaggtgataattataagggttatgaaaacgcttgtaagtgaaaaaacaaaccaaattgtgtgtatgtgactttcattcctaatataaaagttatgtatgcagatggattaggactggattagaatactgaaaaattaaaagtttcttaatcaggtggtgggattatgggtaatcttaattttcagcctctaataaattttgtcctttaaaatattgaaatgatatatacttacatgaaatatcaagatacccttgttgaagaaaaaaatgaaatacatgtaaattcatgaaatattaaattttcatctatttttgaaatatatataaatctggatggatgtggtagttcctgcctttaatccagtactttgcgaggctgaggtgggaggatcacttgagcccaggaatttgagaccagcctaggcaacatagtgagactccatctctacaaaaaaattaaaaaattagccaggtgtggtggcacacacctgtagtcctagctacttggaggctgaggtgagaagattgcttgagcccaggaggttgaggccacccataatcccagccactcgggaaggtaagacagaagaattgcttgaacccaggaggccagctaatttttgtatttttagtagagacagggtttcactgcgttggccaggagggagaggttgcagtgagccaagattgcaccactgcactgcagcctgggcaacagaagaagactccatctcaaacaaaaaagaaaacatacatatatatatatatatatatatatatatatatatactgtataaagctacactaatacagtacccattagtcagatgtggctattgaagtcctgaaatgtttgcattgaagagtgttgtaaatgtaaaataaattgcacatcagattttgaaaacttgttacaaaacaaatttattaataatttttactccaagcttgatggctcatgcttgtaatctcagcactttgagaggccaaggcgggaggattgcttgagccccaggagtttgagaccagcctaggcaacatagcgagaccatgtgtctctcttttttttcagagacagggtcttgctctttcaccttggctggagggccagagtgcagtggtgcaaacatggctcactgtagcctcgacctcttgggctccagcaattcccctgcctcggtgccccaagtagctgggactgcaggcacgtgccaccatgcctggctaatttttgtatttttagtagagacagggtctcaccatgtttcccaggctggtcttgaactcctgaactcaagggatccacctgccttggcctcccagagtgctgggattacaggggggagccaccgcacccagcccgcatctctttttcaaaaaataaaaattaaaaaggtaaaattttaaaaataaataattaaaaaaacattgttttagaggcatagtcttgctgtgtcacccaagctggagtacagtggtacagtcagctcatttttatactgattacatgttgaaataatatttggcatatattaggttaaattaaatatattgttaaaaattaattttacctgtttgatttattttaacatggctgctagaaaaatgatgttaagtacacaagtggctctcatatatatttctttctttattttttttttttttgagatggagtctcgctctttcacccaggctggagtgaagtggtgtaatctcagctcactgcaacctccaccctccgggttcaagcgatttttctgcctcagcctcctgagtagctgggattacaggcatgtgccatcacgccagctaatttttgtatttgtagtagagatgaggtttcaccatgttggcgaggctgctctcgaactcctgacctccacccaccttggcctcccaaagtgctgggattacaggcatgagccaccatgcccagccggctcttatatttctactggacaacaccaatatgcagaatagaactgaagcatttatttatatctctaaatttatttcccccccgcttttttttttggaggcaggatctcactctgtcaccaggctggagtggagtggcacagtcacagctcactgcagcctcgaattcccaggctcaagtgatcctcccacctcagcctctccagcagctggactacaggcatgcgctaccacacctggctaatttttgtattttttgtagacacaaggtttcaccatgttgcccaggctggtcttgaactcttgggcttaagcgatcctcccaccttggcctcccaaagtgctggtattataggcattagccaccacatccggccatctctcaaattcttcaagcctgcataatacagatttgcatgcttggcttatctgttagtaattcagtttttcaacttgctttgctcttcttgggacagtttaaaatttagctatttaggccaggtgcagtggctcatgcccgtaatcccagcactttgggaggccgaggtgggcagatcgcctgaggtcaggagttcaagaccagcctgaccaacatggcgaaaccctgtctctactaaaaatacaaaattagccaggcatcgtggtgcatgcctataatcccagctacttgggaggctgaagcaggagaatcacttgaacccgggaggtggaggtttcagtgacccgagattgcgccactgcactccagcctgtgcaacaaagagtgaaactctgtctcaaaagaaaaaaaaaattagctatttaatatgtgtgcaatatattcagttttggatttgagtttttacctcacatcaaaacaaaaaaaaatctaattttcatgttttaaatgtgtgagctttaagagcataaatctataaatcataggtttaaccagtatcgtgaggccagtagaggctccaaggcagggggaatataaaccttctttggattggttggctggttgcttaacagaattatgtgactgttcatttctttacagaaacaagttgttccctgaatcagtcatcagaaatattatgtatcaaatattgcaagggctggcttttatccataaacatggtaggtttcttttaagtttaatttccctacctctttagattactgtccagattgtgcatacaaatttattaaactgttaaataactgttatattggataactatgaatctggagtatgtgcctatacacactgacatttttatttaaaaactttatcaatttctgtgattctgtataaaatggaatttctggctggcacggtggctcacgtgtgtaatctcagcactttgggaggccaaggcaggcggatcacctgaggtcaaacgagtttgagaccagcctggccaacatggtgaaaccctgtctctgttaaaaaaaaatacaaaaattagctgggcgtggtggcgggcgcctgtaatcccagctactcaggaggttgaggcaggagaattgcttgaaccccagaggtggaggttgcagtgagctgagatcatgccattgcactccagcctgggcaacagagtgagactccatctcaaaaaaaaaaaaaaaaaaaaaaaaaaaaaatttatatatatatatatatatatatatatatatatatatatatatatataaaaatacataacatacatacataccaggccggactcacacctgtaatcccagcactttgggaggccgaggcggggggggggatcaccttaggtcaggagttcgagaccagcctggccaacatggtgaaaccccatctctactaaaaatgtaaaaaattagccaggcttggtggcgcgcgcctataatcccagctacttgagagtctgaggcaggagaatcgcttgaacgcaggaggcagagattgcagtgagctgatattgtggcattgcactccagcctaggcaaaaagaacgaagctccatctcaaaaaataaaaaaatagaatttctataatctataattatcttccaccacagcagaattttttaacagtttaatcatcatcagcctttagtctcagtcatcatatacccatcttgcaacctcattctccctaattttatcgtggaaatgaaaaaaaaaggaccttcttttggaaaagattagattattttgatctagcatgaccaattattaacacttaaatagtttgtagcacccacggagcagtgttttatagttttccttagtttttacatttagttgtttctattctgtgaatgaaattaaagcaagtattaatacttgatctattttctatgaattatgtacttcaattaatgtagtttttcatatctatcaaatcaaaataattattagtccaaaaagttaatatgattattttttaaaaacatttgtttagaatcactagatgtttagatactaaattagaaaagtttgtcccataccattgctgtgttctgaacataggcactggaaaatcaccattagtttcccttcatgtctcatcctgtattttattttattgctattattattattatttgagacaggatctcactctgatgcccaggctggagtgcagtggtgccatcatggctcactgcagcctccacttcctgggctcaggtgatcctcccacctcagcctccctagtagctgggactacaggcgcacgcttccacacccagctaatttttttcttttttgtagagatgaggtttcgccatttttcccaggctggtcttgaactcctggactcaagtgatcctccaacctcagcctccggaagtgctgggattacaggcaggagccatcacacccatcctcctcctgtagtttatattttgttttttttattttcttaactgctacaggaattatttgccttccaaaaatgctatgcaggattccatataaatattttaagaacacttcttaaacttataaaaagggtatgtttagaatgttttaagaacattaaaaaaaaactttttatttgcaccatatgtaaactattggggtcttttaaaagtctaaatcctgtaatgatatactacactttattggcaaacagcagtaatgtattaattatatggaaataagggacatctgctattttaattattcataatggattcctgatttttaattgttttaaactctggtcagcatggtaacacttgacatttgcctgggttgatttatgctgtcagcaacgtctgaagcataagggattgaaggaggaagttcgattacgatttaaaaattgtgactgaaagaaataacatgaataatcagcagttgactgtagagttggctacatagtaatttgggaaaccagcctataaggatgattagacgtttttacgaaagccacataattcttgctgctaagcatctcagatgtaatacttcaagaaatagatattttaaaatagttgtttggccgggcgtggtggctcacgcctgcaatcccagcactttgggaggccaaggcaggcggatcacttgaggtgaggagttcaagagcagcctggccaacgtggtgaaaacctatctctaccaaaaatacaaaaattagctgggtatcatggcacatgcctgtaatcccagctacttgggacgctgaggcaggagaattgcttgaacccgggaggcggagattacagtgagctgagatcatgccactgcactccagcctgggtgacagagcaagactctgtctcaaaaaataaataaataaaataaaatagttgctgtcaaaaaaatgaaaatatttagttcaaataggactgaattattaatatatgtatattaggatggggaaaacctcagctgtacaaatatgtaattggtttagttctctaagactttatggattagtgtcactctgctgtgcatcacatggtcccattcctgtcgttacattacaaaagtatctgaatgtctcttggacatagtgaaatggatgttacttactatttagagtaagaagtactggataaactcagattacaaaactgttaaacagatgtcacaaacagagcccactctggctttgaagtgattaaaaacatttaggcttaaaaaggcttcccaaccccagctggccgtggtggctcacacctgtaatcccagcactttgggagggtgaagcaggtggatcacaaggtcagaagtttgagaccaccctggccaacatggcaaaatccagtttctactaaaaatacaaacaattagccgagtgtggtggcagacgcctgtaatcccagctattccagaggctgaggcaggagaatcgcttgaacccaggaggcggaggttgcaatgagcccagattgcgccactacactccagagcaagactccgtctcaaaacaaaaaaaaaaaaaaaaaaagaaaaagataaaagaaagtcttcccagctccaaagctacatgaaaaccctcttcaagtgatcacctgcagtctccctgcctcccaaggcctttggaacccaagccatttggatataaccagaatgctgtagactgcccttagaaaaagcctcccttaagacaaatctcatctgccaggagggctttaatgtttgttcttttccccctgggttttctttttcttttctttcttttttttttttttttttgagacagtgtcttgctctgttgcccaggctggagtgcggtggcatgatctcagctcactgcaacctccgcctcccaggttcaagtgattcttctgcctcagcctcctgagtagctgggactacaggcgcacaccaccatgcccggctaattttggtatttttagtatagacggggtttcatcatattggccaggctggtctcaaactcctgacctcatgatccacctacctcggcctcccaaagtgctgggattataggcgtgagccaccacgcctggcccccactgggctttctgcctcattttctttggtttcccttttagcttcataaccatttattttatagattgaattgctaatataaacattataattattgggattttgcaacgacacagctattgaggaaaactgaacattagataaaataattttaaatgaagaaattagttctgatgtgtggagttccatttttattgaatggactttttaaacaagtgatttttctcaagaagtcagctgcactgactcaagcctgattaaaaagtgctcttctcagcctgggtgacgtggcaaaaccctgtctctatcaaaaataccaaaaattaggtgggagtggtggcatgcacctgtggtcccagctacttagtgggccgagaggattgcttgagccgagatcgagccactacgctctggcctggacaacagagcaagacctatcttaaaaacaaaaacacttctcacacgttaattaggtgacttcactctggccctcaacctcctcctctattgcacaatagtgataacagtacctccttcaggttgttgtgcaaatgaatggagataatcatagtgtggtaatacctagcccagtgcctgaacacccactggagtcacaaataaaaataaatgttaaatgggtggttatttttaattatctcatacactgtgtgaactttcttgccaaagcattttaaaagcagggtccctacgccccatttacttcttagacaataaatatggtttacttttttcctaagatgatgttttgaattataaaagagggggttcatttatattttgtttataaatcaaataaagctatgtttaaacgtaatgatttactgtatttttttttctccgtatatcatcaaggcttttttcatagggacatgaaaccagaaaacttgctttgtatgggtccagagcttgtgaaaattgctgattttggacttgcaagagaattaaggtcacagccaccatacactgattatgtatctaccagatggtgagtaggggttatgcagccctcctgaggcataagcctatggtgaaattttcctacgatggattgttacatatttctggaagttccatattgaatatttaaaacacagaattgaattttatattctttaaagaaagcgaaggattggtttattgctattctgatcactgaaaaaaaaaggaaaaagaatttcatttattcactcattcattcattcaacaaatatttattgaacacctactatgtgccaaacatcattttaggcacagagaacacagcagtgaaataaaaaaagaaaagaaaaatctctgccttatgctgcttacatgacagccaatagacagataaacaagttaaaaatattatggatcaccaacagaaagacatacacgtgttcaccagaagacatgaatcctctctactgcacgccacccaaacgtccatgaacagtagcatcgtatactcacccagtggaatgctttgcaacaatgagaacgaagggtctatgactgcatgcagcaatgtggacgaatcttagacaatgttgagatcaagagcccaaagagaaaaagagcacataccatatgatttcatttatgcaaagtacaaaaaaagagaaaactaatctgtgccatgaaagtcaggatagcaagcagttctatggggtggggatgtgtgtagtgcctggactagtgcacaaggggccttctgggtgctgatagcatgtctttcttttttttttgagatggagtttcgctctctcgcccaggctggagtgcaatggcgtgatctcggctcactgcaacctctgcctcccggtttcaagtgattctcctgcctcagcctcccgagtagctgggattacaggcacccatcaccatgcccagctaatttttgtatttttagtagagacgtggtttcaccgtgttagccaggctggtctcaaattcctgacctccggtgatcctcccaccttggcctcctatgcatagtgctgggattacaggcgtgagccaccgggcccggccgataacatgtctttcttgatctgggtgctgggtctgtggatgtgttgtatttgtgaaaattcatcaagctctactcttacaacacatgcctctgcctgtgtgaatattatactccagtgaaaacaagaacatatgtgtatcaggctgggcatggtggctcacgcctgtaatcccagcactttgggaggccgaggtgggggatcacttgagaccaggagttcgagaccagcctggccaacatggctaaaccccgtttctactaaaaatacaaaattagccgggtgtggtgtcacgcgccttggtgccagttacttgggaggctgaggcatgagaatcacttgaacctcgggggcagaggttgcagtgagccgagattgcgccactgaactccagcctgggcaacagagcaagactctttctcaaaaaaaaaaaaaaaaaaaaaggaatatatgtgtatcagatgttgatacattattataaagaaaaataaaataggaaagggggcagggagttgggggagatggggagagaaaggaatgttacatggagggtctgactgagagtagccctgatggagatgccagggccagcaggattttttttaggcagagtaaaagccttgagacaggtgcacgccacacgtgaattctgcacagtgcagaatgaataaggagggcagtcgtaggaaacaagggcagagtttgtagagtggccagaaatgatagtgacttggacctgctggccatgcaggtagtgagaaatgtgggattctaatgaatcagatgtgggggctgaaagaaaggagtccgtgtcttagtgtgtttttttgtgttgctgtaaaggaacacctgcggctgggaagttggtaaagaaaggaggtttatttggcttccagttctgcaggctgtacaagaagcatggcactggcatccgcttggcttctgatgtgggtttttatgctgcatcaaaacatggtggagaaggtcaggccgggcgtggtggctcacacctgaatcccagcactgtgggaggccaggacgggtggatcacctgaggtcaggagttcgagaccagactggccaacgtggtgaaacccagtctctactaaaaatacaaaaattaggccgggcacagtggctcacgcctgtaatcccagcactttgggaatccgaggcaggtggatcacgaggtcaggaaatcaagaccattttggctaacacagtgaaaccccgtctctactaaatatacaaaaaaaaaaaaaaaaaaaaaaaattagacgggtgtggtggcgggcacctgtagtcccagctagtcccagctacttgggaggctgaggcaggagaatggcgttaacctgggaggcggagcttgcagtgagcgaagatcgcgccactgcactccagcctgggtgacagagcaagactctgtctcaaaaacaaaaaacaaaaacaaaaaaaattagccaggcatggtggcacatacttgtaacttgggaggctgaggcaggagaatcacttgaacccgggaggtggaggttgcagtgacccgagatcgcgccattgcactccagcctgggcaacaagagcaaaactccgtctcaaaaaaaaaaaaaaagaaaagatggcggggtgaaggtcaaaggggaaatgggcacgtgcgagaagggaacaaacaagaggaggaagcttgccgtggagcaacccactctctcaggaactaatttcatcttgcctgaaaaagaactcattcactacgtgagaacagcaccaagcctttcatgagggatccgccctggttacctgcgaatgtgaccttattttgaaatagggtctttgcaaatgtaatcagattaagatgaggtcagaccacagcctggctggtcttaatccagtaagactgatgtccttataaaaagaaggcagacagagagatggaagagggaagacacgtgaaggcaccttgggagaaagcagtgtgatgtacactttaaatggatcaactgtatattatgtgaattatatatcaataaagcttgtaaaaatattcgtcaaagtatagtaagttctcacttaacatcatcagtaggttcttggaaagtttcactttaagtgaaacaacatatgatgaaaccaattcgaccataggctaattaaagtaaacaattttatggcacgtttctggtcacaaaaacatcaccaaacttcttttttttttttttttcctgtcacccaggctgtagtgcagtggcacgatctcggctcactgcaacctctgcctcccggattcaagtgattctcctgcctcagcctctcgagtagctgagcttacagacgcccaccactacacccagctaagtttttgtatttttagtagagacggggtttcaccatgttggccaggccggtctcgaactcctgacctcatgattcacccgccttggtctcccaaagtgctggaattacaggtgtgagccactgtgcctggccaccaaacttctaaatagtgaccaaaacactaatattgaacattgaaatacatgtaagctatacatacatttgagaaacattaataaaaacaaggaagataattattcgccaagttattctagttcagggtcacaggtggcaacagcgtgtcctggaagctgggggtgcaaggtgagcaccaaccatggacgggacagcctcccatggcagcacgccccctccccaccccccccgacacacacatgcacacactcatcctggggccacacaggcaccccagttcacctgacatgcacatatctaggatatgggaggaagctggagtcctggagaaaacttgtagacttggggagaatgtgcaaaccccacacattggcccagccagaaatgcctttctttttttttctttctcatcaacattacaatgaaacaacattgagcaaaaacaacagtgaacaaaactagtttatttgagggcttgcagtattctcaatgaaagcaaaaagacagtatgccaaacatttggactgaaatatttacacattttggttggaaaaaaagagaattgagagtgtcttccatttagcagactttgtgttggactcaccagctcactttgctcttgtaaattgagtatttttctcaattaaaaatattgttaggctgggtgcagtggctcatgcctgtaatctcagcacttcgggaggctaaggcaggctgatcacctgaggtcaggagttcgagaccagcctggccaacatggggaaaccccgtctctactaaaaatacaaaaattagctgggcatggtggtgtgcccctgtaatccccgctgctcgggaggctgaggcaggagaatcacttgaacccaagaggcggaggttgcagtgagccgggactgcgccattgcactccagcctgggcaacaagagcaaaactccactcaataaatatagttgactacagaagaggagtcagttgaggatatcagtactttcaaactgataaaaaaaaactccactactcaggatataatcctgttcatcttttgttttctgtgcttccttgtgaatagatgctgaatataatgctttgtaacatagtttttctactttttttcttaatatatcagatggcacttatttccatatctattcagttgagttcctgtcttaggcttgatggacatttcatagacatttgtctccagccccactcattgtctgtgatcagggaacatgtgttgtgtcctattatccccagaacattgtacaaatgcctgacacacagatggaacagggtctgaatacctgttccttgatggaaatgcatgaccacacagcgtagaatgctactgcccatccacctttgaaattgcaatcaaaattacctcttttgttctctattttcataggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaagtaagtactcttgtccctaagttgctataacttttgattatttctatcttgctactttgcttttaattttataattttgattatttacaacttttgcctagatatctgatattttcattttgaaataggctcatactttaatgattaattttcttataattctttttttttttttgagatggagtcttgctctgttgcccaggttggagtgcagtggctcaatctcagctcactgcaacctccacctcccaggtttaagcaattctcatgcctcagcctcccaagtagctgggattacaggtgtgcaccaccacgcctggtcaatttttctattgttagtagagaggagatttcaccatgttggccaggctggtcttgaactcttgagctcaagcgatctgcgatctgcccacctcagcctcccaaagtgctgggattacttggtgtgagccaccacgcccggctgtaatccttatttttttaatcggagtgggttaaggattgcaagaagccagaatcccaccagctgaagaaaaacaggtgcttgcctttccttaagaacttcaggaaaaattctgtgtgtttagagtgtaacttgggggtgatgcccagctgacactgtacagacagccttgcttgagctctttcctgctcattctgtggctggccattggcatcacctgttaacccctggtgtcttgaaccttgttttttcttaaccgtttcttgtttccttttttatatctcccctgtggatatttgacttcttgaactgagtgcttttcaattaactatatttcatctacacctttctttctgaaatgtgctttataagtgtgtatataatgacatcctaattaaattagtaagtgccttgtagttaacattacacaagtaaatgtagatattaaagctttaatgtaattgtcatttcccagatatgtgcatttttaacattggatgcaatgggtaatatacacgacaaggatctttgttcgcagtcagcctctttgtaaagcacttttccttatttgttcagagttaacccagatatcatcacagcaacatcaccatcaggatctaaaaccagacaagagcttaatattgtaaaatttataaaggcgggcatggtggctcatgcctgtagtcccagcactttgggaagcccaggcaggaggatcacttgagcccaggagttcaagaccagcctgggcaacatagtgaaaccccgtctccacaaaaaaaaattagccaggtgtgatggtgcgcacctgtagtcccagctactcaggagtctgaggtaggaggatcttttgagcccgggagggtgaggctgtagtgagccatgattgctccactgcactccaacctggataacagagccagatcctgtctcaaaaaaaacacaaaaaaacaaacaaaaaaaagctataaaagtgcttttcgcattgtttcctaactctcagcttaatgttctttctatactgtcgtagcactaaattatagacgtggtctggtatttcattttcatgtttatatggatcaacatgaaaatgttcaaacataaatgatgtttatattactgctgtgttttttaaatggattactaaaaacaatttgttttgccctccccacctgcacttatatattcctgaaacagagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggtaagaggagtcttcctgttagatctttaaaaatgtttaggttttgtaatatcagggatgttttcatttacaaaggcagctctattctcaaccaggattttactaagagaattaaacacaaagtcctaggcatccagcgtatgtaataaattaatttctaggcatataatatcattgggagaaatgcagaaatagccacaccaatgattttctgagttttgtggttcaaatgaagaaccctgaggttgcaacaaggaatcaatctgcaatgataaaaattcagacctgcgacagactagttatgaaggaatctgtcatggaagcaaaaaggcatctcatgaatcattccacatagtagactttcctatgctgcctttacagtttaggggtgggattctggttcactttatacaacagtatcatcccttgctgggactggagtgtgcagcctctggctgccacaagagggcagcattgtggcacccaggctttgttcctttgtgactacacctgacatatctacagatgtattccaagtctagggcctttaaacccagtgcttttgtctgcaaggcttcaataaaaaggcaataataaactttattgtattctcatcatttaaatataaattccatgtgaaaattacaaaaatttattttgctttttttaaaattaatcttgagaaaatgttttctaaatgtcatctggaagaacaaatgggaaaggatagtcaagacatgttaaaacaagaataaggaattagagagcggtgatagggatggacagcttgccccatcagatattaaagtaatctttaaattgatgatggtaacagtggaagtactggcataagaattgacaaatagctgaatgttgcagaacgtatgagtcagcacaaggtaaacaaacgtggcatcacaaagaggggaggacggctcagtgggtgatactgggaaaattcattagctcttagggaaaaaaataaattgaggtccttactgctcaccatactttacaactcacagaagggttacattttgttgttgttgttgagatggagtttcactcttgttgcccaggctggagtgcaatggcatgatctcggctcaccgcaacctctgcctcctgggttcaagtgattctcccaccctcagcctcccgagtagctgagattacaggcatgagccaccacgcctggctaattttgtatttttagtagagacagggtttctccatgttggtgaggctggtctcgacctcccgacctcaggtgatctgccctccttggcctcccaaagtgctgggattacaggtgtgagccaccgcgcccgaccaggattacattttcaaagtgtaaaaaaaaaagcaccctaaactgttagaaacaaaaggaaagcatacatgtgtatttgatctcaaggtgaaaaaacacgggtataaaaataatagaagaaaccacaaaaggaagattcaaacaatttgattacataaaaagtaaaatttttctctatgtaaaaatcttaaaatggaaagataagacagagaaaattatttttaattattaatataatactcctacagaaacacaagaaaaatactgaaatgtgtatgtgtattttcttttttttttgagatggagtttctgttgcccaggctggagtgtagtggcatgatctccactcactgcaacctccgcctcctgggttcaggcgattctcctgcctcagcctcccgagttgctgggattgcaggtgcccgccaccacgcttggcttatttttgtatttttgtagagaccagaggggtttttttgtttagtttttttttgtttttgtttttgtttttgaaacggagtctcgctccatcgcccaggctggagtgcagtagcgtgatctcggttcactacaccctccgcctcccagatacaagcaattcttctgtctcagcctccctagtagctgggactacaggtgcctgccaccacacctggctaatttttgtatttttagtagagatggggtttcaccttgttggtcaggctgatcttgaactcctgaccttaggtgatccacccacctcggcctccctaagttctgggattacaggaatgtgccactgtgcctggccagagacggagttttaccatgttggccaggctgctgttgatctcctgacctcaggtgatctgcctgccttggcctcccaaagtgctgggattacaggcatgaaccactgtgcccagccgtttaagtgtattttctaatttttcttttttaaaattttttgaaagttttgtttctttaaagatggggtcttactatgttgtcctgactggtctcaaactcctggtctcgtgcagttctcctgccttggcctcccaaagtgctgaaataatataggcgtgagccaccacacctggcccatattttctaatttttctaaacattcattaccttcataataaagacataataagtttttcaaatgtattttaaaaagaaaagtagtaatgggacatgaaaaagaaacacaggaaaagaaatacagattacaaaaaatattttttaaatgttcagtctttgtttactattataaaatgcaagtagaaatgagataccgtttttcatttatctctcttagtaagagaaagtaattttgtagtatataaaaagagccttgaagacaatcagaaattatgctcaaagatgttcaattccaatagaaaactgtacattgaaagttaatcaaaatgtttccaaccatgtgcggtggctctgcagtgccgcacacctgtaatcccagcactttccgaggcaggcggatcacttgaggtcaggagtttgagatcagcctggccaacgtggcagaaccccatctctactaaaaatacaaaaaattagctaggcatggtgacacacacctgtaatctcagctactcgggaggctgaggcagaaggatagcttgaacccaggaggcggaggttgcaatgagccaagatcgtgccactgcactccagcctgggtgacagagtgagactctgtctcaaaaataaataaataaataaataaataaataaataaataaataaataatgtttctaaacttaggttatgtgcatctttaatttggaatatactgccagcattaacagtgaatttgtaaaataaaatttttaaataatttgggagaaatctcatgctaaaatactattatacaaataatatgattttgtttttgaaaaatatattttatatgatgagaaaaaaataccgaaaagtataaaaaatgttagtcttggttgtctctgggtgttaaatttttatttttgtcttgagaactctatacgtttctcattctctacaatgatcactgcttcccttaagtaaataggaaaaaataaatgctattaatttttaaagttttccctcttcttgaaggatagtaactggtatcttaaagtatcttaaaagggaagagttggccgggcacagtggctcatacctgtaatcctagcactttgagaggccaaggtgggcggatcacgaggtcaggagcttgagaccggcctgaccaacatggtgaaaccctgtctctattaaaaatacaaaaattagctgggcatggtggcgtgtgcctgtaatcccagctactcgggaggctgaggcaggagaattgcttgaacccaggaggcggatgcagtgagccaagatcgtgccactgcactccagtctgggtgacagagcgagactccatctcaaaaaaaaaaaaaaaaaaaaagggaagagttgttataaataaagccttgaaattacaaaacacatcctcaaagtttccagctccaaaatatgcatcattaatttaggaatattgacatactaattacttaatgtgacttaattcagaatttgagtaccttcagtgtgctaggcattgaagtattcaaattatgtatatttgtgtattccactgagaatgcaagtaacccttaacaaactctttcttgtgctctgtttcacagccctgctttttagtggaagtggaaagacctaattagggagagaggttggttaagttgtagaatatgaagaccatttaaagtaccaagctgccttctgttcctctaaaaactgcccttacacatgggaggagttaactgttggtcagggctatgttcccacctatgtggggactggctaaaggcaggaggttcaggggaacagagcttgaccatcttaaggaacccatccccccaaaaatgaccagctactttgcccaggtatttgatgccaataagggaatttttccatagctgagctacacaggctttagacattctgtagaatattttttcggttttagccttactgacgttgtgaaccagataactctttgctgtggggtgctattgtgtgcattatgggatagttagcaatgtccctggccctctagacactagacactagtagcgtcccccaacccctgtcattataataagaaatgtctccagacattgccagatatctcccaaggggcaaacttgcctccatttgggaagcactgctattagatggtgccacccatacaccagggggtcctttccctctcatgcaagcagtcaggtgactgatctagataaaactcaaacagtgatcatttttcataatatttttatattttcttcccataaatgtcttctctttgctggtataccgatgaaataaacttcaacagtatgtgtttgttgtcccctctttagattttttttttattactagtaggtatattgttgtactcaggctgagagtaacccggaattttacatacagctctggttaatcatttcaaataatctatatggaagattttcttaattcactttttaatgtctttgagtgtactctaaaccattattggtgtgtagtattttagcttgaagtaatcacattaatttagccaatgtctataaattacattttattttcactaacaaatctttaaataaatagaacagctgttttgcttagatgttataataacaagtgagctttctattttttcctactagtacttttttttttttttttgaggtggagtctcgctgtgttgcctaggttgaagtgcagtggcacaatcttggctcactacaatctcctcctcccaggttcaagcgattctcatgcctcaccctcccgtataactggggttacaggcatccaccaacacgcctggctaatttttgtatttttagtagagactgggtttcaccatgttggtcgggctggtcttgaactcctgaccgcaagtgatcctcccacctcatcctcccaaagtgctaggattataggcgtgagccaccatgcccagccacttttaattttttaatgcaatttatttctcaaatcatttttttctggttatcttttaaaagaggcactgtatagggaatgatggctgctttctaaatctttgaagctcatgtgggctaatgataaatgcctcgcacagggccaaccatagtttatgtgcaatacatttaggtggaactgttttccatttgttgttttctctgtgtttttataggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactgtgagtagccagtcatgacacttgcaatgaaatagtttgactcgtgcaattaagatttttttcgaggcatttctaataatgttggaaaagatataaaagatttttctttgttaaagaccctgagtcctctggttggagcttgacatgagatcacttaaaattctaatatggtttataaaaagaaaaactttcaggataaaagtaaccaagtttacatgctacagtcttcagtcttttttctttttctttttttgagacggaggttcgcttttgttgcctaggctggagtgcagtggcacgaccttagctcactgcaatctctgactcctgggttcaagcgattctcctgcctcagcctcccaagtagctgggattacagacgcccaccaccacgcctggatatttttttgtatttttagtagagatggggtttcaccatgttgtccaggctggtcttgagttcctgactgcaagtgatacacccgccttggcctcccaaagttctgggattacaggcatgagccactgcacctgggcttttcttttttatttcttgagacggagtttcactctatttgcccaggctggagtgcaatggcacgatcttggctcactgcaacctccacctcccaggttcaagcagttctcttgcctcagcttcctgagtggctgggattataggcacccaccaccacacccagctaatttttgtatttttagtggagaccatgttggccaggctggtctcgaactcctgacctcagatgatccacccatctcggcctcccaaagtgctgggattacaggcgtgagccaccaagcccggcctaaaattctttcaatgcagaagaattcaaagaaagaatttaaaagaatcgggtactccagagtactgatcctaaatcttaagaatttttaacagtactttcattttacagtgttcttaaatgctaaggaacatggagagaatgggtttttatttattattattattattattattttgagacagagttttgctcttgttgcccaggctggagtgcaatggtgtgatctcagctcaccacaacctccacctcccaggttcaagcaatcctcctgcctcagcctcctgagtagctcggattacaggcatgtgccaccatgcccagctaattttgtatttttagtagagatggggtttctccatgttggtcaggctggtcttgaactcctgacctcaggtgatccaccctccttggcctcccaaagtgcttggattacaggcctgagccaccgcacctggccagaataggtttttaaagtgtcaggcatagtataaaactttttcttccatcttttgttcagctccaggagctcttcagttgctgtagtattttagctgtcccactgggtatacactcccaaatgtgtttgcattatggcattttaggatggaaatcggtcttatacagcactgtatctatttccttccagtccccaactgccccaccaacctagataagcaaggcctcctcgtcccccaatagcactaatcacattctaacatactgttaattacttcttatgtttattgtttatttgtctcttcctctggaatgcagcaagctcagtgaggtcaggaatgtttgtgtgtttatcagtacagcctcagcaccccgaccagtgcctgccacatggtagattctcagtaggtatttgttcagtgaatgaaggaatgaataattgcccacatgacttgtaaaccacctctggggtcctggggagtccacttttatctttggaacagttctgaatattagaaagttcttccttaatactgggtaaaatctggttttctagcttttaatgaaggctaatcacttttctagaaaggcagccttttagatatttgaaaatagcccttatattatctgcccttttctctagagaaacttctccaattcccttaagggctctgcatataacaccattcaccaatgactgataactctcagttcctattatgaatgtgtctttaagtcccctctcatcttgctttccacttagaatgaggttgccagagctagaggcagacagcaggcagggaatatagagcagggcgaatcacctccgacattctaaaccatatgtgcactcgtgccaccaacgatgacagtcctccccatgaccccttggaagatgcatcaattgttgactcatattgtgagggaaggaaaggaagttaatatttattgagtagcttccaagtgccatgcatatgcgagggacgctgtgtgcattctctaagttaaagagaataacctagcccccagccccgccacacacacatttttatataggtgagttccagagctgggattaagtactgtgttaactaaaatttctaagtatacctgttttttcacaaatgcttctcctaaattgcatattctgtacctctgacttgtgtatttcatctctaggattcaaaaagttgcaagatctcttacctcttcaatttctaattatttttgaatctgtattttttcttctcagtttacccattctgcccagcttgttgccagctgtgtatttgtttagttgtctgttttgctcctgaatcttcatgatgaatagaacgaccgtgagatcttgggcaggctactagaacctttctctagattgacgttgatccatttgtcagtactgttggtcaagttcttcaactatgtgctgatcccctttgctgccttcacccactgggctgaagtccacatacactacactgaatgaattcattgtttgccttttatgaaaaagtgtggtctatatgagctatcactgtttttccttagtgctcacaaacatcccctttaataattgattttagaatctttgccctcatcctctaccaaacttactgatgtggagtttgcaaaaataaatctactttattaaaagtattatatttgcccctttccagtcttctcagccataccagattcttgcatatcactgatattgttcagcagtgttcaggatcagtaccctaaaatacaattcaacagaagggaggctcaaactcagctaagggtaaccttttattaaccctactcatctggagcttaacattttttttattctctttattctggagattgttgtgcctggcagagaaagtaatagtgtagagaagctggcaaatactgctttttgttatcatccatcactatcactgtaataccgtcagcttcaagcaatagcatgtccattctttaagcatctccctgcacccaacataggtgtattttctgaaaattttccatgctctcttccctagttttgagttgccttttggatttttctgtttatgtgcccccaaaccactttctgtaaatttgtataaaaccaattcattgtgtgctctaagccaggacttctttcccattccttatttctgttaatgatgcctccattctgtgacagtcagactcatacttccctctctgtttccgttaggattacattcagggacttatgacaaaaactcgaccactgtggcttaaacaatagggattgttgttctcagataacaagaaatcgggtggtgggtagctggagctcatgaagcttgcagaggaggcaggctgctgctggcttcccgctccaccaccctgagcaggtggctttcattcctgtggccacaggatgactggtgttcctttggatgtcgtgtctgcattcaaggagggggaagagtaaaagatgctggcacatgccagccttagtgtccttctcattaaggctgtccccacttaaggaggacactaaggctttgagaagttaagtcacttgcccaaagagacatagccaagtctcaggtttccagatccttcctgtcaatgaagagtcaactcagatcctaaatattcaagtctctcaccaacctagttcacagagatctctcctctgaacacctatcatatttttggcatgtaccgcccatttttgttcatgcttttaaatgtgtatatatgttatgcccttacgtgtatggaacgctccttgagaatggggactgttagtgtcttacatagatagtagcttgtgcatgaaaggcattcagtacatgattaaagattatgatgactgattttccaccacagaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggtaagatttcaaattcctcagaaaaatatttttgccatgcattaactttattttactcattaaatataaatgcatgtagaccctaaaagaagaaaagtttgcttaacaggccaggtgtagtggctcaggcctgtaatcccagcactttgggaggccgaggcgggttgatcacttgaggccaggagtttgaaactagcctggctgacatggtgaaaccccgtctctactaaaaatacaaaaattagctgggtgtggtggtgtgcacctgtaatcccagctactcgggaagctgagacatgagaatttcttgaacctgggaggtgaatgttgcagtgagccaagattgtgccattgcattccagcctgggtaacaaagtgagactctgtctcaaaaaaaagaaaaaaagaaaaaaatttgcttaatattggtgccttccacaaaacacaaatctttccacatacttctgaaaaggtaagaatcttctcacagtaacagttctcagtattaacagatgagtggggtgtgtgtgtctgtgtgtgtgtgtagagagtgtgtcagtccgtttttacattgctataaagaatgtgttggcccatggttctgcaggttgtacaggaagcatagtgccagcatgtgcttctggtgagggcttttggaaacttagaataatggcagaaggtggcagaggatccagcctgtcacatggcaagagagggagcaagagagagagggaggaggtcccagactcttttaaacgatcaagtcttgcatgaactcagagtgagaactcactcgttaccgcaaggatagtaccaagccatttgtgagggatctgctcccatggtccaaacacctcccgccaggccccacctcaaaactggggattacatttcaacatgagatttagagaggacagatgtccaaaacgtatcagaggggatcttgttccatttttacgatgctcttgtgaatgacaatcattattcccatttgaaattgacatgcctcgttgcaggaagtagagcaccacgtgccaagttaacagcttcttctgatggtgttaagatttcactaactgcctcctcgctattctaaacttttttcaatcattttctgagccttttctggaagtttaatatctctagcagttcctttcctttttataagtgaggtcatccttagtacattattcgactttgaagttaggatgggttaagttttggtgaatattttggaaagatactttcttttttttttgttttcctctttgaaacagaagaatagaaagaacaagtgtgttatgagtcaggaaaacttatacaagtagctatttggcatgacatagtatggaagtcttcactttggagcacgaggaatctctaaggagtacatatgcttggataattctttttttgcttggataactcttatgcaatccgtttccaggtcttcacattccataggtactctttcctaaaaatacatgaactggaggaaaagcccactcaagtcctcttccactctaggcaagaaagtcacacctctcagttatttcaactcttacatggcatagggttactaaataaagggacaaatcagaaaactggctttctgttggttcttgtcttacagaaattgggtacagtagtcccctgaatctgcagtttcaccttccatggtttcatttacctgcagtacggtgcaataagatattttgggctgggtgcggaggctcaatgcctgtaatcccagcactttgggaggctgaggtaggtggatcacctgagttcaggagattgagaccagcctggccaacatggtgaaacctcgtctttactaaaaatacaaaaattagctgggtgtggtggcgggcgcctgtaatcccagctactcaggaggctgaggcaggagaaacttgaacccaggaggcagaggttgtggtgagccgagattgtgccactgcactccagcctgagtgagagtgagactccgtctcaaaacaaaaaaaagatatttttgagagcacattcacataacttttattacaatatattgttttaattgttctattttagtattagttattaatgttaatctcttgctgtgcccaacttataaattaaacttcctcataggtatctatgcacatacatataggaaaagatgggctgtatagggtttgatactatctgtggtttcaggcatcctctgggggtcttagaacatatcccccacacgtaatgggggctactgtattttagcccatgttggaaagcatggtgatttggaaacactgaagcaccaggcgttagtgatgtgtattctttcaaatatactaaaatgctctgtttcctctttgaaacagaagaataggaagaacagttgtgttatgagtcaggaaaacttatccaggagctctttggcatggtatagtatggaagtcttcactttggggcacgaggaatctctaaggagtgcatatgcttggataattcttttttttttttttttcttttttgcttggataactcttaggcaatccgtttccaggtcttcacattccataggtactccttcctaatctgtgtgtttaatccatgggttttcaaaacacatggattaaaattttacttatttgaggatcagagtgtattatggataaggtagttaaaacttattttatcaagccataccatgaaatactccaattgcagtcaatcctcacaatatttcatcttataaaatactgtttctatctgctgttaacaagaaataaggaacaaatttatgatgaaaaattatagatgtctatttaaagatgtgcagggagttacataatttaaaaaacaattatttgggtctaggaacagaagagtttgaagaccactgatgtagtatatgggagatttgaaacattttttttcttttttttctttttgagacggaatgtcgcttcattgcccaggctggagtgcagtgatgtgatctcggctcactgcaacctctgcctccagggttcaagcaattctcctgtctcagtctccttagtagctcagattgttacaggcgtgtgccaccacgcctggctaattttttgtatttttaatagagacagtgtttcaccatgttggccaggctagtcttgaactcctgacctcaggtgatccacctgcctcggcctccaaaagtgttgggattacaggcatgagccaccgcacctggcgacttgaaaacattttttaaaacccatgtcattctgatttcagctaaattttattcataattatttataattattcataatttattcataaattttagtcatatatttttgaggatggtagaggtttgaatcaaaacctatagttaagatcaaggttgtggctgttcatggtggcttatacttataaacctagcactttaggaggccgaggtaggtgggttgcttgagcttaggagtttgagaccagcctgggcaatacggcaaaactccatctctacaaaaaaatacaaaaattagccagatgtggtagcccacacctgtagttcgagctactcaggaggctgaggtgagaggattgcttgagcttggaaggccgagccactgcaccccagcctgggcaacagagcgagacactgtctcaaaaaatcaaaaaaagatcaaggttgtagtctatatacctgtttctagcaagggaacaattagtaaatttcttcaacattaattatcccttttctcttgaaattctttagaaaaactgtatgacagtgaatttttcatgtgggtatttcttctactttttttttttttttgagacagtctcgctctgtcacccaggctggagtgcagtggcgcgatctcagctcactgcaagctccgcctcctgggttcacgccattctcctgcctcagcctcccgagtagctgggactgcaggtgcccaccaccacactcggctaattttttgtattttttttagtagagacagggtttcaccatgttagccaggatggtctcgatctcccgacctcgtgatccacctgcctcagcctcccaaagtgctgggattacaggcgtgagccactgcgcccagccatttcttctacatttttattttttggtatctttcaatggtcctgtacaattctaggcatatggttattattatgatcatcattattattaatatactaccatctgttaagctcctgcctaaactttataattttcatacttcagtaaaaatatctgcagagtaggatgctgagacttggataggctgggtttcttgcccaagatcaggtaaggattaattcaaatccaggtctttctctcttctaccccacactgcttctttagcaataggagctgaattggtgaattgttggatttgtgaataggagctgaattggtgaattggtggatttgtgaataggaggtgaattggtgaattagcggagtggtgaacaggaggtgaactggtgaattagcggagtggtgaacaggaggtgaactggtgaattagcggagtggtgaataggaggtgaactggtgcattagcggagtggtgaataggaggtgaactggtgaagtagcggagtggtgaataggaggtgaactggtgcattagcggagtggtgaataggaggtgaactggtgcattagcggagtggtgaataggaggtgaactggtgcattagcggagtggtgaataggaggtgaactggtgcattagcggagtggtgaataggaggtgaactggtgaattagcggagtggtgaataggaggtgaactggtgaattagcggagtggtgaataggaggtgaactggtgaattagcggagtggtgaataggaggtgaactggtgaattagtggagtggtgaataggaggtgaactggtgcattagtggagtggtgaataggaggtgaactggtgcattagtggagtggtgaataggaggtgaactggtgcattagtggagtggtgaataggaggtgaactggtgaattagtggagtggtgaataggaggtgaactggtgcattagtggagtggtgaataggaggtgaactggtgaattagtggagtggtgaataggaggtgaactggtgaattagtggagtggtgaataggaggtgaactggtgaattagtggagtggtgaataggaggtgaactggtgcattagtggagtggtgaataggaggtgaactggtgcattagtggagtggtgaataggaggtgaactggtgcattagtggagtggtgaataggaggtgaactggtgcattgaacagaccctgccatcccctgcttggtctctcaggcagccagggcctccccataaagaatacagagtaccaaatactaacatgtataccttttatttaatggttgtcttattttttaaattattattatgattgagatggagctttgctcttgtcgcccaggctgagtgcagtggtgcgatcttggctcactgcaacctctgcctcccgggttcaagtgatcctcctgtctcagcctcccaagtagctgggattacaggtggccgccaccatgcccagctaatttttgtatttttagtagagacagggtttcaccatgttggccaggctggtctcaaactcctgatctcaggtgatccacctgcctttgcctctcaaagtgctagaattacaggcgtgagccactgcacccagcctggttgtcttcttaaaagtgaacaaaaagcaagatatttatatttagatttatacttgtatttatattcagtagatgtttactaaatacctagttggaattaagcctctcttcaactcatcaaatatatggcaacagaaataagacctccagaggactataacacatgacaagtgtgtgcatttagtgccactagtgacagctgcaaggagctctgggagttctgtctatgggcagagatccctctgatgaggacagaaaagtctttttagagtgagtagttttgggaatgggtagaatttcagttagtgatataacagcagtgggctcaggggaagggaaagttgccagaaatggcgggactgttcccattgaagcagacgcacctgtgcctagaactgcccccaagcaggtggccagcagttcaaagggccacccaagtgagtatccatttccaagggagccaacttggtgagtagggtttggtagcatgaatttctaggtggaaaccatggatgcttggagttaacaagtgatggaaattgggcagtatattcaggccccagcaaagaaggagcccagtcggagggtggtggggagaaggttggtcgtggagggctcattacagcacacagagggatgggcagcaacacaaagcaatggccgcctcacgcactgctgcctggtcaaacaggcctcagggacaggcctcgggaatgagacagaactaagcctcgaagcagaaagtcctcagtccgtacacagaaacaggactgtgggagttagggaccaacaggcagagagtcagtcttaatactaacaaacaccactaaacagctagcgaggtgcttagccactgcacaagtctgttctggctgagacacaggcatgtctccacaaatacctattttctgtgcctgacactagggtgaccggaaattgtatacgggagcttttctagcactttccccatttcagttttttaggccatccaaaccatgccccaaacaacctcattgattgtaaattattttagtcaacaggtgaagatggctgttatttccctctcagcacaccagtttcccacgttatgaatccaactgcagccgttgcaggacagatagaaacatgttacacacaagtaaattgctgctcagttataaaggttcctgtcacatactgtctggtatcagaaatgagtctgtgcacgacccaatatctacgcgggtggaggggaagttgtcacttagccaaaagactgatggaaaccatttaagtgaggtcagattgactggcttaggaagatgtgcagagggtgggcgagatgtgcagagggtgggcgagatcctctcgttgttcgtgctgtaatgctacctttcattggctttcaaggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtaagtagagcaaagaaaatgtttgctgctaactagagtatagataggtcaggttcaagtgtcttggaatctccaaagaaagggcagcagtgaagcaaaaaatctaatcacagagctctttggtagctcagtctgtcgccaaggacttttctggacctcctgtttctaccactagtagaattctgctcaagaaatgcttaggagcaaaaatcaagatgatgaatatgcttccagaaaacaccaacccccaccccccaccaaagctatgcattcagtaaatcctaaattttattaagccaattctatgcccccattacaactttttataaaatgtagattttcaaatactctttcctaaatgatctggtgtacatttttttgtttgtttgtttttttgttttttttgagacagattctcgctctgtcgcccaggctggagtgcagtggcgtgatctcggctcactgcaacctccacctcccaggtttaagccattctcctgcctcagcctcccgagtagctgggactacaggtgcgagccaccacgcctggctaatttttgcatttttagtagagatggtgtttcaccgtgttagccgggatggtctcgatctcctgaccttgtgatccgcccgccttggcctcccaaagtgctgagatgacaggcgtgagccactgtgcccagccaatctggtgtatatttttaaaagattctgcctgctcggaagagcatgctgggaactcaagagaggcaaagacactggctaagaggccactgcttatgtccggatggggtggggtaatgtaaatggctggttccagagtggaagtggcagaggtacaagtgggcaaaacctagacatgttttggtactggaaccaataggacttgtgggtagattggtggaaagaattagtggcagcatctgaggttttgacttgggaactgggtgaacggtggtgactttagctgagaaagggaagattagaagaggagaagattgtggaagtagagaatggagagctgagtgcgggatgcctgttaaacatctgaattgatccatctaatgggcgcctgggtatatgaatctggagcttgggagaaagatctggacagacagtggggagtttatcatgtgcctgcaaatagcattttctcctctaaatccaaataaaaaggaaatgtttcaattcaatttaatctaaaagataatccatttttaaatcgtcctgtatctacacagatacatctttaatccagtgagggagaagatgatctttttcttttgtgtttttgtgggcatggtcatttataactttctaaacacgagtgggccactgtttaactgaggaagatttgcttttcacatctaagtctcctgaagcaagacacagtctccatttcccagaagcttgtttgggaagatggggcatggcaaacaagagaaaaggttgagacaggattgccagcaaaagatggatctgtaacacacttccctgtgtaccttttaggcaaacatagaaatttcagttctaagaatccagctagggctgggcacagtggctcacacctgtaatcccagcactttgggaggccgaggtgggcggatcacctgagttcaggagtttgagaccagcctgaccaacatggtgaaaccccgtctctactaaaaatataaaaattagctggacgtggtggtgggcatctgtaatcccagctactcgggaggctgaggcaggagaattgcttgacccaggaggtggaggttgcagtgagccgagatggcaccgctgcactccagcatgggcaacagagcaagactgtgtcaaaaaaaaaaaaaaaaaaaaatccagttgggaccctctcttgctgttagtaattggggaaaagaaaaaaaatgaaagcaagtagagggtttagagatgaatgggagagaaaacagaaggcacggtgggtgtataggtttagccacaggtgttgaataagttgatataaacttacagggggtgaattgaggctttaggactgcagtcctgtgctgatttgtaaggaggaagacacgtatttgtatttgagaggttgaagaaattggcatgaagccatcaagaacagcaaaaactttataaccctgggtatttggcgatctaaataggttaaatagttttggtgtgtgtctgtgtgtgtgtgtgtgtgtgtgtgtgtgtgtgtgacagagtttcactcgttgcccaggctggagtgtagtggcacgatcttggctcactgcaacctcatcctcctgggttgaagcgattctcctgcctcagcctcccaagtagctggaattacaggcgctcaccaccacacccggctaatttttgtatgttttagtagagacggggtttcaccatgttggccaggttggtcttgaactcctgacctcaggtgatccacccacctcgttcccaaagtggtgggattacaggcgtgaaccacaacacccagccctataatattttttgtcgttgttgatgtaagcacatttttaggctctgtggcaccagagtgagacatgggaagtgggcctgaaaaaacctgggtcttgtttgtgtgtgtctggatagagaaacagatgaaaaaatgtatacatatcttattggtagtatatgccaagtcaatttacaagtatcttattaaaatagttaatgaggccaggtgcagtggctcatgcctgtaatcccagcactttgggaggctgaggcaggcggatcacttgaagtcaggagttcgagactagcctgtccaacatggcaaaaccctgtctctactaaaaatacagtaattagccgggcgtggtgttgggtgcctgtaatcccagctactcaggagggtgaggcaggagaatcacttgaacccaggaggcagaggttgcagtgagccaagattgtgacattgcactccagcctgggtgacagagtgagactctgtctcaaaaaaaaaaaaaaaaaaaatctacttttgaccttgaagtctgtattttcttcctcacgaggtcaaattttcctgactatagtttcacctacagtttgaaaactgttctatttgtgacattatgctttgattcttgaaagtgagagaaaataagttattctaacatttttgtataggaagttgtcacatcatgacactcacagaatgagaaatctgcccatatttcttgataatcagactgtaaacatggcaggcctcattttggctgcttcatcttagatggctgtgaagaggagcttagaaatggaatgaagcatttcagcagtgctccgagcaggtttgcgtgtagaggagcaagatcccttacagaggaggaactagtaacacaggaggtgaagggggatgagtgagggactgaagagcttaggaaggtgggagaggagttgggatcaagaccagggttggggcacacttttgaaagcagcagaaatccttgttattgtaatctttagactcctgtgtgtaaattttggtgttgaaatcatgagagagagagaaaaagaaaaaagaaattctgagagagttttaatctgactgcaaaagcaaggatggaagaaagttttcaaaacataggttcatgagagatagttttcactgtgttttttgtttttttgtttgtttaaattggtacattttgccgggtgctgtcgcctataatcccagcactttgggaggctaaggcgggtggatcacgagatcaagagattgagaccatcctggccaacatggtgaaattccgtctctactaaaaatacaaaaattagctgggcgtggtggtgtgtgcctgtaatcccagctactcaggaggctgaggcaggagaatggcttgaacccgggaggtggaggctgcagtgagctgagatcgccccactgcactccagcctggaaacagaacaagactctgtctcaaaaaaaaaaaaaaaaaaaccagtacatttcactgactgaaatattgcaaatcagtatcttcttacttacagaagtgagtagtaggaaacactactgcaaacttttgtcaaaggatatttatcctttgagccaaagcaccctgttttcatagttctgcttcctaatgtggttttctgagacctgtttgatcatttcctttttaactagaaatctaacaaagtctgcaaattacttgggatcagaaggatggctataattgagatttaaaaagtaaactcaattacaaagaattgtttggaatgtaaacttgagccttactgtcacctattggcggtcgtggttttgaagatgacccctctggagctggatgaaatttaaaactagaatcaggctcagttcagtcacctggacagacatttattgagcacctattgtgaaccagcaactatgcagaggatagaaacctgaataagaagcaatctttggccgggtgcggtggctcacgcctgtaatcccagcactttggggaggccaaagccggtggatcacctgaggtcaggaattcgagaccagcctggccaacataatgaaaccccgtctctactaaaaatacaaaaaaattagccaggcatggtggcgggtgcctgtaatcccagctacacaggaggctgaggcaggagaatcacttgaatccagaaggcagatgttgcagtgagccaagatagtgccattgcactccagcctgggcaacaagagtgaaactgtctcaaaaaataaaaaaatttaaaaaaagaaacaatccttgacatttatttatgatccatagttatttttgtaattgagtatcttcaggaataaaaaatactaatatcttttggggccccctctttaccctaaagccaagtataaaaggtcttattaagcatcgacttttaggattctgggagctctagaaatgtaccatataattgcagggcagcatgacattatactacaaggactggcggatctgtgacactggccttcagggaaagagacgcaagagtcatagttactgacctgctactactaaccggctgtgtacttggagcaagattctgttttctgtaacttacgatgggactgcaccatctgtcagctcactctgtaagccttaggtactttaattatcacaagatagttgcaaatacagtatgcaattgaaagctaatctctcagcagtgccctctggtctcaccccctgctcctagagccgggactctgggcatgaatcgatgccaccactgctggccggagcagctcactccatagcacttctttttttttttttttttttttttttttgagacgaagtgttgctgtgttgcccaggctggagtgcagtggtaccacctcagctcactgcaacctccacctcctgggttcaggtgattctcctgcctcagactcccaagtagctgggactacaggcacacgccaccatgcccagctaatttttgtatttttagtagagatggggtttcaccatgttggccaggctgatcacaaactcctgacctcaagtgatccgcccacctcagcctcccaaagtgctgggattacaggcatgagccaccgcacctggcctccatagcacttatgaaactgatctgtgcatccttctctcttcccattcattattcaccatctttccttccaccctgtttattcaacatcctgtgtcatttctacattagcctctgctttttcactttcttaacacggcacacaaaatcctgtgtggcctgcccctcctcccctctccagcctcattttataccaccccgtgttcttgctgcagccttactggccatctctgagttctttcccatctcaggtcctctgcccaaactgttgcctcttcaaggatcgcacctccccaccccttaaaacacatttatgcctagtgttccattattggaacgctaagcatgtgggagttgtatcctactgctgaaggtcatcgccaaggtctgattgcaaaatttcaaaaaattgcaacctcaggcataaatgagggttaatcatgattcacatttcagcttaaaattgcttatttgaaagaaagactggctgagttgcttctgttatttgccccctccaccccagattcttctaaacatgatgcaccctgctcattatgtatttacttagttatgactaaaactgtctcccttctcattagattctaagagccaaagagtagaaactggtctattttgtttagcactttttctccaatgccacgcactgcctggcactggtaggtgctcagtaaatatttgctaactgacttttttatgtcctttgaggcaagtgattatcatcatgtaatgacatctatcattataatatcaaattaatttatgcttcttcctaacagtgtttggtttgtaggaggtacccagtgaaaacttataaacaaataaataacaaaattctaggatatatctatttccaacaaaattggaatctttatcttaaatagaccttgaggccaggcgaggtggctcatacctgtaatcccagcactttgggaggctgaggcaggcggatcacctgaggttgggagtccgagactagcctgaccaacatggagaaaccctgtctctactaaaaatacaaaattagccgggcgtgatggtgcatgcctgtaatcccagctactcaggaggctgaggcaagagaatcacttgaacctgggaggtggaggttttggtgagctgagatcacgccattgcactccagcctgggcaacaatagcaaaagtctgtctcaaaacaaaagaaaacaaaacaaaccttgaattaaactagttatcttcaataatttacttaccttttactttaaaatacttaaaaaaaaagcctatttaggaatattgccaaggccaactggattaacaacatcatttaaatattcagaactcattctttgttatgacaactgtgttcacacagatttttaatgttttacccctaccttgcacttcctttttgggtaaatacattttttttttttttgtgacagtcttgctctgtagaccaggctggatgcagtggcacagtctcagctcattgcaacttccacaacttgggttcaagtgattctcgtgcctcagcctcccaagtagctggaattacaggcaggcaccaccacacccagctaattttttttgtattcttttagtagagacggggtctcaccatgttggccaggcttgtctcgaactcctgacctcaggtgatccacctccctcagcctcccaaagtgctgggattacaggcatgagccactgtgcctggcctaaagatgttttaatatgagtaattgccaccaagtgcatctttatggttaggtagttgccttttttttttttcttttgaaatggagtctcactctgttgcccaggctagagtgcagtggtgcgatctcgggctcaccacaacctctgcctcccaggttcaagcgattctcctgtctcatgcctggctaatttttgtgtttttagtagagatggggtttcactatgttggccaagctggtctcaaactcctgacctcgtgatccgcccgcctcggcctcccaaagtgctgggattacaggcatgagccaccgcacccagctggtagttgcctataatagttcgatttgtaggtgttttattagggaagttatatcctataaagaaagggaaattacttgcctgatgaagtgtttccttagagaactgataatgggtaacttttgaggtgcagtatttctggtttcaaaataagggatattattatatatctcatacatatgaaacctttctaaggaatccagctcgcggaaagcaaaagctcaactgcctggagacagttctgacttcctaaatcagtggagtcctcagtgatgatttctacactagataaagaaaactctccgtgaatgaccaaaaggcatagactgctcaagttcactctaatttaattatcagtgaaaagaaaacaagctcaagaagttttcagtctcttaagaacaggttgaaacaactccctttgaccactagtatcacggcccaaggctgaatggacatttcacagatttcagaaaatcataagtaatttaaactgttctttttccaagtacatttgcaatgacttctttctggcgcacaggggataaactgtttccattttactgtatctcatatacaaataagcgtttcaggtggagcttcatacctccgaacttcaaaggttttcctgagttcttagtcacgtgtctgttttccctgctacaccaagggttgggccaagaatatacgctcaaaacaagtgacatgaaaatgtcatgttgggtcgggtgtggtggcttacacctgtaatctcagcactttgggaggccaaggtgaacggatcacttgaggccaggagtttgagacagcctggccaacatggtgaaatcccctctctactaaaaatacaaaaattagccaagcatggtggtgggtgcctgtaatcccagctactcgggaggctgagacacaagaatcacttgaacctgggaggtggaggctgcagtgagccaagatcacaccatggcactccagcctggacgacagagagagaccctgtctcaaaacaaaacaaaacaaaacaaaaaaaacgttgtgttgttgaagaaaaatttttgtgccatctcaatttttacaagacccttagcaagaacatcaagtgttattattatattgtagaaaatatcttctgcctataaagtacactgtcaacattccaggtggttgtgctaagggcttggtatcatgttagggttcatcagaaagcaagtatctgctacattttcacctagatttatttccattctcctgtccaaggtgtctctagtctttgtttgaatgtattacataagtttcctttaagtttatgatctgctctaacctttgaagtggttgttttgttcttctcaggtgtgaatcccaagaaggtgtccttgatagccagtggaaaggaaataaacccccacacttggagcaaccagttattccccaagtcactgggacccgttggggcagaacttgctttcaaaaggagcaatgcaggtaacgcaagaatacaaaatgtacatgtacggggttttcctttatagaggtctacttttaaatatattgcagtgctcttccaaccaagatacatgtgcacttgggagatacacagaggttttccactacactctgcctatgggtagccctgctctgctggagcagtcatggagttgtaacactgcctcttcaataaaactgtttgtagctggatgagcatggtggttcacacctgtaatcccagcactttgggaggcggaggtgggcaggtcccttgagcctaggagttcgagatcaacctggccaacatggtggaactgtgcctctatattaaaaagtacaataataaaaaaaaggttttcccactaattcttgagtacagctagttttaagggaattctcgacctccatctgaatctttcctgaaatgggtctgccctagcaaggagtttctattctgaaaagaagacttctcactggctaccatggtgtgttttctttttccccaaaatgtaaaaatatctggggtgccaatgaaatggaaattctggtatgttgatgtcactgttgagaaagtaagtaactttgatttgatgactgaggaacaggtcctttttaaagtcagggagtcttaacagttctcagcatttagaaaattgaaggaggacctacttgaattgttagctgacaggtaatttaaaaagtttttttaatttttttttatgagatcagtatatgaattttggtctgtaattttgaagagcgtttgaagaatagagtggcaaagctatcacaaaaccgcttttgttcccaactatctatttgtattagcaagatttcttaatgcttctgtctccaaaaaggaagaaaaaagaaaagagagagaaaatagccctgatgctgtgattccagcaataaatattcatttgttgatacatgaactacttgaaaataaccccacctttctcattaagagatgtgtttgcaaaaaacttaattttcgtgtttagtaatcaaaatatataatactcaacttttttgattaattatatacaatgaatcattgtaattataactaactttgtacagtatgttaatatccttatggttacaagaaattaaaaaaagttttaatttacacatattttagagtgaccaattttagacttttaagcctaagattacatttggataaaatttggaagctgaggtataaataaagatataattttaagggaaaaaagaattaatgtgaaatgtccaagcatcaaaaaggaacttgttcatgtatttttatgtcaatattggaggacataaaatcactaatagttttggccaggtgcagtggcccactcctgtaatcccagcactttgggaggccgaggtgggcgaatcacaaggtccggagttcgagacccgcctgaccaacatggtgaaaccctgtctctactaaaaatacacacacacaaaaaaaaatccaggcatggtggcatgcgcctataaatccagctgctcaggagactgagacaggagaatcgcttgaacccaggaagtggaggttgcagtgagccgagatcacaccactgcactccagcctgggcgacagagcgagattctgtctcaaaaaaaaaaaaaaaaaaatcactaatagttttattttttaaatgcctatagttacaatatgtcagaaataacatcctttgcaactgttaaacttatgattaaaaattttaaatatcaacttaaaagtgtgtgaagaggtacagtttgttttttaatgtaggtgatattggatcaaaaaactttgacaattaccattataagtgagtagtttagtgagatattctgatgtgacatcaatatatttgggctttttacaagttttccagattctttaaaaactcagtttatccatttaatgtcgctgcggtgtcatacactgcagcactgtaatttacttattttttcttcagataattaaaattaatattcactgaaccaaccagttacacaaattcaattaaatgacagtagaacaactttgagtctcaagggaatatacagttggcatcaaataaatgctgtgacaacaatggggacatttttgcatttttaagggctctttctggatcttttcattaatcatctaatccattttttctctgcttttcctataacattctcccttactattattctttctttccatctgtcttctctttagaagaaagcataattaaaccaatcgaaaaactatcatgcaatgaaacttttcctgaaaaattagaggacccacaaggtaatttctgggcgtcagatgaatgcagtttgttctttgaatctcttgtctgattttcttctcaacatttgcccctaatcctgacataaaaggccgagatgatccgctttgagaagtcagatcaggactaagataaagaaaagcattctgtctcatcaagaatatcttccttcagtaactgagattttaagatgaatatgctctcaaaaagctctgtgctggtcttcttaaattaattacggaaatttatagaggaaatcaagcaaataattctaatgaaaagaatcaaaagagtattttctaattttgcgatctatattcctggaatttttttttcaaagttctgaaactcatttcttaagcatgaacaaccacttttttaaaaaggttaggctgggcgcggtggctcacacctgaaatcccagcacttcaggaggccgagccgggcagatcatgagatcaagagatagagaccatcctggccaacatgatgaaacccgtgtctctactaaaaatacaaaaattagctgtgtgtggtggcatgcacctgtaatcccagctactcaggaggctgaggcaggagaatcgcttgaacccgggaggcggaggttgcagtgaaccaagattgcgccactgcactccagcctggcaacagagcaagactccatctcaaataaataaataaaaattaaaaaaaaaaaaaggttaactgggttaatagagatggtggatttcctaggggttcagtgttactggtttcaacagtgctaacaactggctgcaatctgaaaattcacagcatacaaggtacttcaaataataagccaaaataatttaagaagacttaattttctgttcatgttttttccctaacaacttctttctccaataagaagcatcataatgcatgaatcctagagtctgatatatcccattttgtcactcaccagcttttgtggtttgggacaagttgtttaagccagctttcccgtccataaaacggacgaaatttccttaggtattcttacataaccctacctggaattttaacacatgctaagcatttaataagtgtttgctctgctgatgaggatgagagcaagagacatgactgaagctgctagtgaatgcaatcactgctttgaatttccttccgaaaatttttctgaagtaaagaactgattagtgtttcagaatgagtttctgagatgggaaaaaggttaaagtaggcagctgaacttacacaaaattcagtagggttaaacatgtatagactgagagcatgtgctcactgtatgtaaccctttaggggctgataacataatattgcgctttgacatttgttgcttcaagagcagacacctgttgaagcctgatatgccgtgagagacaacggacacagagcccagtgtcgagacgtgtaaacagataacgctatagagaaaacactgtttactgaacagtgctttgaaaccacgagggtgatcagagccccatttcgccttctagagataaacctgtctcccttcctgcagagctagctcctcctattgcttctggttgtcgtttgtcttcagtctgcttcctgccagtgcagcagctcctgctagatcttgacatcctagtggccagatcccaggggcggtgctggtcctatccgagctctctgcctcatctcccattccttttttccacactcagtgtgtattctcttggatttccataccctgttcctcctaccatccacctctctacctgttctcttcctccatgaggtccttttctctcctgtcccttaatgctggtgttccttgggggtctactccaggtctctgcacattcgcagtgcctctgagctggctccttcagcccacaactctgtaaccaccacaccctgatcatcaccaatctccacgcctgcccacttgccctctgcctgccacaacatgaatgtcctctgggtaccatgtctttcccccaatcctgattctcctcctatgttgctattcatggacaacgcaccccccagtcacctgagctgcaaacttaggagtttatatttccctctttccctaccacctccaccccgtgaacctgcttagttcccttcttcttcaccctctgccactgctgtggttcagaccctcatcctccctcatttcagctcttagcagtgacttcctcactggtctccagactttagatttttcctcatcaatgcatccctatgctaacgccagattgagcattcaccaatagtgatgatgatgatggtgttgataatgatggcaattatgctagctgacgtttaatgcgtacagattctatgccacgtgctctgaagagtctcatcaatccctacaacaaccctacgagaataggtccacttacaaccattttacagaatgaagacagacacagagagcacttcagagataggggcttcgcagtgggaaatacacccccatgtgaagaagtggggtcgtgagaaagcctggcgtgttcagggtgaactgaacacccctgggccttgagttcagaccccagctcagtctcttactaactgtgagaagttaggcaagttactcaacattggagagccacacgatatggatactaatatgatctaagcgggctgttgtatggatggaataagaatatctgtaacaagtgcagctcagtgcctaaaacatagtagatgctgaaaaatagtatttagaagtaatggggtagtattcaatgttattctactgtgcctaaaatattcaccttctgactgtgaaactttatgatatgtcactaggaaatcttggaagttatgctacttacaatcagtcaggatatattccttcctttctcaaaaaagaagtgcagtcagctggccagaggatccacttagcacctctcaatgcaacggcttcaggtaggaacaacttcagatacagttttctagattcctagcagaaaggaacattttcctttttaagtttatgcagtcacttttcccaagcgaagacttttagtcagcctcacctcattaacgcatttctttttgtttttaccgaaatgtcctatttttcttccaaaaatgaggatttgagggtctaataattataagagctaccactaattaagtggtgactctctgccaggcacagtgtaaagggcttactggaattatatcatttaatcctcatgataacctgatgatgtagctagatctcttctttacagatgatgaaatgtaggtgaagtaacttacctgaggtcacacagctagtggagctgggatagaaacccaacttaatccacttccaaagagtgtgctgtgctgcacagagagatgtgagaaaatgccttttccagagccctctgcccaggacctggcacagggtgaaagcttaataaatgctgacactctatttatgaatgagttaacatgaggtgtgtctctacagttccatcttagggcgtagaaattagcggtggcaggactttcacaccctgccttttgctttgcaatagtattcagggggaagggtttatccctccaccctccagcgttatgcctaactgaggtaagcttgctccccagtggtgtggcatgtgacagccacatgtgggggtacacacttgaaatggagggtgatgattctgtacttaagccaatcagatttgaccatgaatggtcttcgaatcatttgaatctgaaatagatattcttagtgaagcaccaaaaataaacattaaagccaatcattagaactttaataagatacctaattgtagtttaatttatttattttaattcttttttacagagaaaaagccttgctctgtcacccaggctggagtgcagggatgcaatcatggttcactgcagcctcgaactcctgggctcaagtgatcctcctgcctccgccttctgagtagatgggactacaggcacacacgaccgtgcccagctaattaaaaaaaatgttttttgtagggacagggtcttgctatgttgcccaagctggatcttgactcgtgggcgcaagcaatcctcccaccttggcctcccaaaactctgggattataggcatgaaccactatgcccggcctgtagtttaatttaaaagttgactctgaaagtgtgctcacagcctatcctaaccactatcttatattaaaacccctgattagatgtgccagtctttaaagttcacactattggagctaaaaatgtataaagcctggacttctttatttttttatttcttgccgcaatagaactgcttaaatagtactacagttaccttatctgtgaaaagaattgcttcattatcttttcgctgaaacaaaataagtaaacattttatatacagcagtgatttttataaggcctcaaatatttaagccagccttatgagccattcatttatatgaaatataaaattttatttattttgagatggagtcttgctctgttgcccaggctggagtgcagtggtgtgatctcagctcactgcaacctccacctcccgggttcaaacgattctcctgcctcagcctcccaagcagctgggattacaggcatgcaccaccatgcccagctaattttttttgtatttttagtagagacgcagtttcactgtgttggtcaggctggtcttgaactcgtgacctcaaatgattcacctgcctcagcctcccacaagtgctgggattacaggcatgaaccactgcacccggccacattttatatttttaatataaaggcagaaaatcataatgtttcaaattattttgttacctaggtatctactcttataaatcaagagtgggtcttttaaaaaatatttttgtaagatattgaaggcctttatatattaattattctatccaattagcatgcatattcctgttttcattttttttaagtaaatgctttttcttaactttttatttctttactctgcttatcagatttttctacagatggtgataggaggaaaggtaaaaaatgaagtaaatattaatcactctcaagtggtcaatgcaaatccttagaaaaaacactgttctgtaagagatgtgtcttccagtcatgccagttgggtgacagtttcccacaagaaaataaaaccaggtcattaccatatttactcaactatttcccccttcttgcatagtctcgtctttgctcttctttctccccttcaagatttttgtttttgtttttgtttttttttttttttgagacaaagtctcgctctgtcaccagcctggagtgcagtggcgtgatctcagctccctgctgcaacctctgccacccgggttcaagcgattctcctgcctcagcctccggagtagctgggactacaggtgcgtgccaccacgcccagctaatttatgtatttttagtagagatggggcaggatgatctcgatctcttgacctcgtgatctgcctgcctcgacctctcaaagtgctgggattacaggcatgagccaccgcacctggcctctaccctttaagttttgagaaggaaaatcaatgtcttccctcccatgtaatctctccttcccctaatacttccttatcccctgccttgaaactaacaaggacttcgaggagtgacttctgttctacacagcaccctttaggatcactttagaagtgcaggatcctgttttaagcactctgtgtacattaactcattaatcctcccagggctgtattccaggaggtactattatgatccgcatctcacacaagttttatatgttgctaaaagttgtatcacagtggcatcaattaaatccataactagaggcaaacttctttcctttagcatagattttctacaagaagttaaatgtccttgataggacagatgcagtttttaaacacagagcaagcattgcaaggctcactatccctcccgctcttgcagggcagtgaggtgtggggtggtcccactaaggcacaaaagcacttcttgccctgccacgagatctgggctcctctcagctgttaggttcttcaccaaaggtacttgagtcctgaaattctagtatatctaggaaaggaatcctaaatctcaacactacccccttcttagcaaaatgattccctcttgaaaaagttttacaaaatattgtcctggacacaatttcatttaaaaccatttaggacttaggtgatatcatgacctggaaaaaggcttctctttttgttactccccaaagctctcacttcttgccctcagagccacacccattagcctaatgccacgttcccttttccctccctgaataagcggggcttattgcctctctccccgctctctactcccctcccacgctgtctcttctacccctgctaccagtttgacctgtggcccacatgggtgagctcactaatttagcagacagatgctcgtttctattccaatggctataactaaagggctctttctggaaaacatggtgccctgactggcccttgtagacacattgtccctgactttgttagatagctttttagtggctttgactttgagaattttaagcccagtaaaaagagtggaatgaaaggacctgtcaaaccatggagtggggagctcttggcctccctgcctccaccaaactacacggcagccaggcggctgtcttacccagagtgtccacacttaataccttgttcacccatgctgaagttagtagcttgtcaggaccacatgctcacagaattccctcctcactcccagttatacagtgaaaatttaagaaaaactgtgcaaaccatgccagtaaatatgggatagctagggctaggggtacaaaatggtcagattcatttcagtattaacacttagagtttaatccaagaatggcagctactacacagtgtgaagagatatttaaaccccagatggaaaaagcagacatccctcctcagatacaatacctgtgataccttagctctcaattcgaggtgaggaaagcgtgaaggagggactgaagaaggcatcaaaagttgtctgtaaaatgatctcctgctttgtcctttgaaatgttgaagcagttttagctcataaattgttcagataacaaatgttcaagaaattttaaatttttcacaaatttttaaacagtcagatatatgaatgaaacaaccttgtggttaaaagtttaggatcctaccatttaagggaattgtgttcccacccatgattttcccaatgagaaatgaagtatgggccgggtgcgatggctcacacctgtaatcctagcactttgggaggctgaggtgggtggatcattggcaaggctgaggtgggtggatcaccttaggtcaggagttccagaccagcctggccaacatggcaaaaccccatctctactaaaaatacaaaaactagctgggcgtggtggtgcgcccctgtaatcccagctgctcagaaggctgaggcaggagaatcacttgaacccgggaggtggaggttgcagtgagccgagatcgctccattgcactccagcctgggcaacaagggcgaaactctgcctcattaaaaaaaaaaaaaaatcttcattctaaaacccacattttaatgtttaaaaagaaatctattataggaccccatgtgtgttcttccatgaagccacagttttatagattcacaattccaaatacatttttctgtagtgatattgtgtcaatattatttagatgtaaccacagtgtgatattacaaagtcaccaacactgtgggtgttgcccattgaatttgagccaataaattttcttggtcttcttacctggcgttgcctatctaaatgtaaaatattaaaaatagcagcagtgtcagcactataaaccaggaataatattggctcttcagctactgaaaattctttttttttttttttgagatggagtttcactcttgtcgcccaggctggtgtgcaatggtatgatctcggctcactgcaaccactgcctcccgggttcaagtgattctcttgcctcagcctcctgagtagctgggattacagtcacccgccaccacgctcagctggctttttttgtatttttagtagagacagggtttcaccatgttggccaggctggtctcgaactcctgacctcaggtgatccacttgcttcagcctcccaaagtgctaggattacaggcaggagccactgcgcacggccagctactggaaattctaatggatgtcaacataatactacactagaatttttggttttaacatttaaaaagcctcagagagtactgagttaatcttttaaacataaattcagattttccccatcaaatgagaggatgaatttctttattttgagtttgataagcaaatgagtaaaaccctgttttccaaatctgatttctttcagaatatacctggaacacaaaaactggtcgggggcagttttcaggacgtacttataatcctacagcaaaaaacctaaatattgtgaaccgtgcacagcccattccctcagtgcacgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatcttttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagcttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatttgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggaaacttttaaactctgaataggcattaaaaaaaatatggctaactagtgtgttttcattatgtttttaaaccttatatcctgaattctatttgttgttgttgttttaattagtagtctttaaaaaaagcagttttagggccaggcacagtggctcacacctgtaatcccagaactctgggagtcataggtgggtggatcacttgaggtcaagagttcaagaccaacctggccaagatggcaaaaccctgtctctactaaaaatacacaaaaattagctgggcacggtggcgggcacctgtaatcccagctacttgggcggctgaggtaggagaattgcttgaacctgggaggcagaggttacagtacagtgagatcgtgccactgcactccagcctgggcgacagagcgagactctgtctcaaaaaaaaaaaataaaagcccttttaggtttatgaaaatattgatcagaaagtagagttcccatatgccccttcatctgcccctccccgattttccctattatcaacatcttgcattcatgtagataattcattacaactgataagccagtattgatacattgttattaattaaagtccatagtttatattagggttcactcttgtgttgtacactatgggttttgacaaaatgtataaggacatgtatccaccataatagtatcataagaatcattttactccctcaaaatcctgtcctctccctattcatccttccctatcttgccctgaacctctggccaccattgaccttgttactgtctccacagtttttctttttccagaattacctggggtcaggagttcaagaccagcctggccaacatggtgaaaccccatctccactaataatacaaaaacattatgagccatggtggtgcatgtctgtaatcccagctacttgggaggctgagacaggagaatcgcttgaacccgggaggtggaggttgcagtgagccaagattgtgccattgcacatctagccaaaacagatctcagaaaaaaagtatgcacatggtttatttgtggaaaaaaaaaaaaaaaaaaaaaaaaaaacgagcatggaaaatatgctgaatttgagcatttaatttaggaagctagaaaaagaataacgtaaaaaaatgttttaagtagatttcagcccagtagcaataagcatacctagcactcagatattggtgtccagatattggtgtgcagtaccactgttcaataaaaggaaccagagctacttggagaaatggctgattctagtactaggacaggaaatatacaagatgagcctagaacgtcttgtagtgccagacaataaggaagttctacaaacacacaaaccctttggctatgccagagggacacagaggtcaactgagtttccaatggccaaagctgcaacaatttgagcaagaaaattaagtattgcccggcgcggtggctgatgcctgtaatcccagcactttgggaggccaaggtgggcagatcatgaggtcaggagatcgagaccatcctggctaacatggtgaaaccctgtctgtactaaaaatacaaaaaaattagccgggcatggtggcaggcacctgtagtcccagctcctcaggaggctgaggcaggagaatggcgtgaacccatgaggcggagcttgcagtgagccgagaccatgccactgcactccagcctgggtgacagagcaagactccgtctcaaaaaaaaaaaaaaaaaataagtattacaacccaaagaaaaaagaaatatccatgagtccatactaagatgaatgcatgaatgaatgcatgaatgatcaggtgcggcagtgactcacgcttgtaatcccagcactttgagaggccgaggtgggtggatcacctgaggtcaggaggttgagaccagcctggccaacatggtgaaacaccgtctctgctaaaaatacaaaattagccgggtgtggtggcacacgcctatagttccagctactcgggaggctgagacagaagaatcacttgaacccagaaggaggaggctg

SEQ ID NO: 16019 - DNA, 13938 bp, Human
tgatgggaacagtcatcccttaggaactgccctggaaagcatcagccagccagaaaacagggaaagaggctgagaaaccgtggtaaccaagttttgctggcactttgtaaaatggtaactgcaactgccgaggctgtgcagagaatgctaataagcctaggacaacctgtaaagagtggacctagaaaatgtccacccaccgaccagaccggtagccctaaagagccccactctgtagattcctgaggatctgcccaccgtactcattcacaaggaagcccctaaacatggctacattgtgccttagcttcacagccctcaaaatacttctgactcaaatgtcttagggtcagagtaatgacatttagcacatctgcctagaaactcacagttttccaatttgtaacaaacattttgcaccttttaaaaatctcattctaaaatccaaatggtaaacagctttaagaatcaatatgaaatgttttaagtgttctctgtggcttcatataaattctccctgcccctctcatcagaatttattctgactttcagggagcatattaaaggtagaaaccactgatgtacaataataagtgtgcaaccatattcttaagaatctaaattcaatcttggttagctgagaatgcttgaaacagtaataaagtgctcctctgaaagtcacactcaaattttgaattcctctttctaatgagagctcttcacccattcccatgtctcaagtacgcaaatgaaaacaaaacaaaaaaactgtaactgggatttaaaagtataacagtctttcttctctcatgtatttctttcttgtcatacttcattctggaaaaaaataatccaatctgaaatataaagtgggaaaagggaggcatccgtaggtaatgtgagttattatcattgttctagatgttgggttgagtggtgggttcatagatgttcattacattatttaaaagccattataattaactattagaaaataagagggccatacatgcacgagtgatgacagagtgtcataaatcaggaattctgattattccaatcccatgcacctaagatctgtttaaagaaaaaataataatgagatggtgatgcaggtagctaatggttagacccttctagagttcaccaaactccttcggcagggacgtcttcataagcatgcagcctgcgcagctgcacaaggtcctgcctttaggagcacccagcctttatttatgctctgctgtcgcaatcttgaaatttaaatagtgttttaccaaggtgtcctgcattcattttgcactgggaccagtaaattataaaatcagtcctgtccctaagtttccagaggttaaatttacctacagttccccataatttcgtccccatccaactttgatattttttaagtttgctacttcttatccccagattattaatgtaacagtcaggtgagcaccctagagcagtcttttttcctgtatttcctatgtttccttatttttattgtccaaatcagtgctgcctgtgctataaatggagctgcagttatatattgttcttataatgcttcttctcagatcaaaaacttcaaacagaattcattggctaaaaactaaatgcactgaagtctctatctaaattcatgttaactgctggattatacaaattcattttctaataattgcccaatttcaactacaacatataaccaaacaagacaaattctgaacaattcttcatggtagaaagaattcaaataaagatttaaggaaatcctcattttcaaaaattactgtctcaaaaaaaaaaaaattaagtaaatgtttttgcattcctgaaatgccctgtgtctacagtgatcaggtacagaaaagctacttcaagttcaaatataacttagcgattgccacatggtgcagaatctttccacccctaacactccaaaaacccaatcagacaagtggccgtaatctgactcccagcacacagggagctgcggggcaggcaatgagagctgcactctggctggggaaggcatgagtgacagacccacagcaaggcggtgggggtaagtccttctttgccttaagggaacaacgcttagggccaaaagatgaaactgtctcttttattatagatgtttgtgccttcttaggcagaatctggaaggcagctatagggcaggtgggtggttcttttagatctgagtactgggcattttcagaagagaggcatagagaaggtagaagaaaagggatgctttttagccaaatcctccatatgtttcagatctgcaaaagcccaggaaaattaccctatggaggtgaatctagctatagtacatttcttcggaaaaattactcacccagacgctcagctgtcctggagtggatgaagctgagtgttcagctagaaagtaatgtgtccgattcagtacatcaacaaacccgctttgttctggggcaaaagaagcaaatctaattgtgttgatcatttccagtgactgtgaacatataagggaacactgacaataaaagcagggtgctatgggtgacgctagggtgagccctcataaggccagagatatgtatatgctgccagcaaacttcacggttcacagccaagtgaggctggtccatctgccttggaagaagatcagatttttgtggatttaaaaaaaaaaaaaagctaaaaacattcttaaagagcatgtttatgttttgtgttggtgttttgcactgttttaaatttctctggttgatgaatatttgaagctgaaagagcaactacctctggagaggtaaacaggtgcatgacaggccaagcagggagagaactccggaaatggcagaagtgagaggtgaagggggtgagcagcggggctggccttttctgggtcccacctcttctggtgtctcctgcggggctgaaaaggacgtttcctgcccacctagcttccttagcctactgttttgtcctcctccttctcccctaaccctgaccacaaacgacagcacctatgatcgcattttgccccctttgccatcccggctacagccctgggctgccggtgagttcagaagtgactctcctaacttcttcaatatgtgacttttctgagtttaccgtctttgggaatatttttagtgtctcctccagggtgccctccctgccccattgcaaccatcgtttttgtctctttacattcttttcctctagagagtatgatgtcgttgtcatcccacctggggtttttcatacttctgagattcgcttcactggggcaggggatgcgtgggatgtggctggccacccccctgtggagccagctcttcctttatcctgccacccgggcctgggcaagaaagggtttttctctctccacctctaaagcaaagccccatagcaaactaagggctaggctgagctggaaattcccctcaccctttttggcactgcatttcctcactacccacgcagaaagcaggttcccgggaacattcagtgacatggggaaatgagggccccgcaatttgtcaaagggaaagccacaataatactaatctcttaaagtacttggctttcttgcctaaccccttacgtggtcctctgcaattagattctctggtaaatactctccatacttcttggctctcatgactatcacaggcaaaggacaagggcaaaagtcttagatgatagggtaactggggtaattgccccccccccccaaaaggggaatcctagccatttcctgccagaatgagcagttggcatcaatatcgtcaaaccaccccttctctgctccaaagatctaatgacagcaagagggatatagacgggaggagaaggcgtcctccctctcccagactccctgcccaccaccctccccagagaagctccacaaggtgagacacactgtcctataggcccatgtaacagaaagccatcaaaaagaccgtagagaaaagccgttttccatagagccttctgctcaggggcccacagtttccctaaccacacccgcttttcctgacttcccgagctctgcaccatgaaggcaggaaaggtaccggggcattgctggcacaccccagcctccaggctccctttggcaggtttatctgcattgtacggtcagggtcaaggggtgagagagggtcgggcacgaggagaggctgtccttcctcccctaaaagcatcccccactcccatctctccccacctccagcggccaggatgcaccgggccggcgggcaggcgggcgagctcgcggggccgcttctgcgtgtgcacctggccgccgcccgggagcctgccacgggccgggaatggccgctgctccgccctctgagaggtgctccaggctccctggggacggaggtttacacgtccccgtgccgcgctcccagatctgggcggtgcgcgtgtcccttgggcaggctcagctcccggactcctcccgctggcagcctgctcgttcctggcgcaaaggagagggagggagtgtcgctgtcccagctgaggccctgcctgttcccatcgcccttgctagtcaccagaagctcctctcccctcaatgagttcactttctcaaaagacagccttcagcaccctggtttcctagaaggcttccccctaatccagagtctggggggagggggagattttcagaatgccatttcaaagcaatcaaatgcaaagctagaaaagacgaccccccccccccacgcacaccttgttttaatgctttatgttcgaaatgtaagtagcatataaaatgtactcgaaacttaaaaacttgctctaagggaattaagtacaaggtaaatatattttattcttaatattttaaggaatttgatttagacatttttcctttctagggacagtttggataattttccgtgaaactggatgatctttgaatattaaatgaaaggagactagaataacagtctcttgactattcatgaaggagctttagcagaagcattctttcttggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggtagcatctttagctattttcaaactaggactccaagcttcttgcaaactctttgctaaataatgccttggtggcatgaggcacatccctaaaatagctaatttactcctagggaatttttgatgattcttaatagtgtgaaaactgattctggcagtatttaggtatatctgtaagaaatcattgtttgctcttgagtgccttaaaaataacaaaatctaggtggcccgaaaattgtgttggttttttcctccccttctcccattccaattactatattgactttatatttagcttaatgcattttccttacagttatttgttcactagcagaaaaaaactattttcttgtcatgttcataagatgtacaatgatctacataaagggttatgcttaaaaaaatagacatccgatcctagttttgttcttagctgattaggagtatcaattgttaactcagcaccagggctgattaaaaaaaaacacacatggcttaaattttaattgaaatatatattaattaatttaaacctaattaatggatttaatcattgccttataaaatcacaaggctctcaagaaattcttttacgagttaagtgctgcagtggcacattttgcttcctttgtagaaaaggacattcagcacaaactcctgtttggtcgttgtaagagtaatcacagtcatctgtgatgacccaaaatgaatataaatttattccttctttttggggggtgagagaaggaaattctcagttgaaggtggggtagaagacttacctttactttttacacagataaaatgtgcctttcacaatgatattaatacattgtcatcgaaaatactcttgcttcaattctgatggaatatttttctttctctaggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcagtaagtttccaagtccatttaaataatcaatcccacctcatttatcctcactctagctggcctgaagatgttgtgttttacagcagtagctctttagtatccagccatgactgtccattttaggttataatttttccaactgctcaatgagaatgttgatatagctgctaatatcttgaggttcctctaagtgacaaatgacagcaaattgcaatgaatgatacttgctagtagccctgtttcagcaatgtctgaagttgttttcttgtttcctatagatcaattatactggtgccagcatgaatcccgcccgatcctttggacctgcagttatcatgggaaattgggaaaaccattgggtaaccctcatattgatagttcccatcttcctacagttgaggacaattacctgtggggctcttttatttttcattattttgcctactactttctcttgcatttctccaaccttgaccctcactttattacatctttcataaagactagggaaagaatagcacagatctgctgtaaaaagataagagatgtaaaacatctctaactgaaggttctaggcctccaataatagtcttttccttttttgaagcactattttagacactgtatctaacagattgcagcagaatacactgtatatagaggttgcctatgtggaacaagttaaagtcagcatggtgtagtgaatatggtgtttaaataattgaaagtaaagtcttcccagctataatggaaaaaaattgcaaaaaaaagagaaagaatgaaatacttaaaagcgctgcccatagcaaagatatttaccctttttttgtttacaaatgcatgaactcaattaatagtatgtaagttgcaagtatttgaactgcagatggtgtcgaataaatagtgcaaaggtttatgttattatcaccataactgttaccggaaaaataaatgactcacagaaaaggctcacttttcagtctcaaacctaaactattataaataaatatttattaatgtagtggcagtgcttccagagaatagcagtgtccattttaaaatattataattaattttgtttcagttgtttctcacagcaaaggaatttaaatcctttaaaattaaataagtaatgcagcagttgtgaaggccaccaacatgctaacttacaatagccaataaaaatatgagacctgtaagccagcttcaaagagcgctagcttttattataatttatatattgcaaatgtcacttacaactttaaaaaattcatgaatataacagaatatgccccttgtgtttattcagacagtgattaccaacctagtcacagccattcatctatggtgtacactgcaaatgacaagaaaatgcaccgctgctatgtgcattcacttctaagaaaagtataccaaatctttaaaagtaatctacagcattaaataacagaataagagtcagcgttcaaaccaagacttagccaaaaatgccatccatgagattagtcattttgtcactgatacctccatttatgtctcaaaaactgttaccacattaacagaaatggaaatttttagtgagtagtatatgattttgttttcttctttttgagatggagtcttgctctgttgcccaggctggagtgcagtggcatgatctcggcttgctgcaacctccttctcctgggttgaagagattctccaacctcagcctcccgagtagctgggattacaggtgcatgccaccacactcagctaatttttgtattttttcatagagacagggtttcaccatgttggccaggctagtctcgaactcctgaccttaggtgatccacctgcctcagcctcccaaagtgctgggattacaggcgtgagccacagtgcccagccctgatcttacaatgaaaatacaactttcagttcaacatattaaattgaaactattttgtcattaacaacttttagttaaatttataagcacttgaaaatgtagatgaaaaaatatattttactaattacttgtcagttgcagtaaactagttaagatttaaatagtaggaacattcttagcttgttgattaaactaaaagttgccccatgttatattataccaatcttaattctactaaaaatagcaatggttgtatgaaatttagaactaatttaaagtatatttgtaggtagaaagattaggaataacattaaaatattaattgggttttttgtatagtgtaatgatattattttagttttctttatacttttacacattttctagatttttagcaataaagattctttactttaaagtacatatgacttcattttgaaatagcaacttgacactgagatttgtttatttttgagaacatgcagctgggtatcttattcacagatgttttggaaagggtagtaattattttgctgttctagtctcccttgtgggatttgtagcctgtggaatagtacatgtctaatgagaccttactaacaaagagcaaagacatttagaggagggctctcatttctcctttaaaagggcatagagaagataaaggctcatatgggttttttcatgttcaagagaggaacttgattcttccagccacactagcaacagtttccccgtaaatgttatgtcttcagcctcagcttaaattttgaattttatttaaatcttacaatgaggatgcaaactgagattaatttgcagagggtgttttaaacaaaaagcatccatcatgttttttttcaaatgagtgtgtagtacagtggaaaacagtatactgcagtgtttggaacagtgtttcaaaagagaggttttcattttgtttgtttgtttttttcttttttttgagacagggtcttactctgttgcccaggctggagtagagtgtcacgatcatggctcactgcagccgagacctccctgggctcaagtgatcctcctatctcagcctcccaagtagctgggactacaggtgcacaccaccaagcccagctaatttttttttgtattttgtagagacagggtttcaccatgttgctcaggctgaatcgaactcctgggctcaagcaatccacccaccttggcctcttaaagtgctgggattacaggtgtgagccactgtgcccagcctcaaatgagaggtttgaagtcagacaggtctgaaatctcagctcaaccatttgataagcacaaaatcttaagcaagcttattaccctctcagagtgtcactcttcttttcataaaatgggaagaataataatatttatctcattggttattgttagaattaaatgagattatacaagaaaagtgccaagtacggctggcccggggacagtgctcaacaagcagggtttctgttgcccaagtgcgtctgttaaataaatgtctaatattctacagcacacatgtgctctaaagcaaatgtctgcacttcattcaaactcaaaactttattctaggggcatagctaatatgtaataataatttccggctgggcacggtggctcacacctgtaatcccagcactttgggaggctgaggcaggtggatcacgaggtcaggagattgagaccatcctggctaacacagtgaaaccccatctctactaaaaatacaaaaaattagccaggcgtggtggcgggcacctgtagtcccagctactcaggaggctgaggcaggagaatggcgtgaacccgggaggcagagcttgcagtgagtggcgatcgcccactgcactccagcctaggtgacagagcaagactccgtctcaaaattaataataataataataataataataatttccatttattgaaatcctatggaattgctacttctcaactagccataaactcatattttttcaccaagccatcgtgagaaccgcatagatgaaagctatctgcacagtaatgaacacgaggttttcatttaaatcaaatcaccaaattttggaagcctggaatggagcagattactacgagctaaaaactatcaagtactttacaagtattgttgcatttaatccttttaccccgtgaggtttgtattattataatccccactttacagatgaggaaattaagacttggaaagttacgtaactgatacaagcactcataactctgctaagtggtggagctgggttggttttgatcatgcttacctgaataacggaatccccaaaagataaaaactgtgttatgatcatgattgtgcaggaaaccagtgtaaaatggcaatattgagaaaataagagaaggactctccagaaattttttttttattttagttaaagaattcttagtgcgcttaatttgtagtaccaccaaagaggatctatctttacattaacgattatcataagatggaaagaacataattaatgaaaagaggataggagatgaaacagttctttttgttttctgttcaaatgcagtttaataatttatggatctctgatgaggctttggtgtgttttcttatttcctctccaattcccctctttttgatgcatgacacaaatacactcttaatttaacccagctagattctacattcatgagctgctcaatggaatagcttttctctacttacactctatcctcttccatcttttccttagatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagctgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatt

SEQ ID NO: 16020 - DNA, 13938 bp, Human; identical to SEQ ID NO: 16019

SEQ ID NO: 16021 - DNA, 77994 bp, Human; identical to SEQ ID NO: 12517

SEQ ID NO: 16022 - DNA, 16712 bp, Human
actgtgtctcaaaaaaaattaattaattaattaaataaaaaaggaaatggaactatttttgtgaatctgtggattatatcagaaaaaaaagacacaatggggaaagtcctaggcaaatcaggatgagttagtcatccttcctagatgagtgtttggtgctaaatacatgctcagcagacatgattattgcttcccctttctttcgtccatttggcaacaaaaaggtggcaagcacccactctgtgccctgtcctagggtccgggaaccctgtaagcagtagatggaggtgggggtgggggtgggggcggggatgctgttcagagcaccttgctccaagggttcattaaaaaatccaccagtggaccgggcgcggtggctcatgcctttaatcccagcactttgggaggccgaggcgggcggatcacaaggtcaggagatcgagaccatcctggctaacacggtgaaaccccgtctctactaaaaatacaaaaaaaattagccgggcgtggcagcgtgcgcctgtagccccagctgctggggaggctgaggcaggagaatggcgtgaacccgggaggcggggcttgcagggagccgagatcgcgccactgcactccagcctgggggacagagcgagactccgtctcaaaaaataaaaataaaaaaaatagaaaaaacaatccaccagccacgataaatggcagacctccttctgatttcagccggtgtggtatgttcctgggctgacagcacttgtctagtcttgctttcccaagtgggaaaggtctctgggaccttaaggtccccaggtggtgacacagagacaggtaggggggcccatagcaaagccaggcaaggaggtcccgagatgattgtgggtggcagggaaagaaaaaatattccttgactttgtgcctggacctggttgtaataaaggcccaagaggtagttcctatcatcgtgcacatttcgctgaaggaagaaactgagggtcagtgacccaagtgaagtgacttgcccaagatcatgcaggaagacatggataattgtaatttgaaccaaggtcccagcaaagtgggattgttggggctgagtgggccggctcctgcatttccttccctctccctgggcttgggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctgggtaaggcgcaggggcagacagggacggacgggagcggacggggttggggtcgccccaacagtgggcacgggagctaagtaagggtttctctgctgcttcagtgaagcaggaggggctgcgctttctggagcaagagctggagactatcaccattccggacctgcggggcaaagaaggccacttctactacaacatctctgagtaagtggggggcggggcctcgcgatccggggcggggcctcggcggtggaggcggggcccgagaaatctcagggtctcgggagactggaggctgagtgggatggggcgtggccaaatcgatgaggcaagacttaagaaaccggatggggccgaaaagataaaggccaagccagtcatcataggcgggaccaggcagatgggcgtggccttgaaaatgtagagggggccaagaaggaagcaggaccagtggatgtgaggcgtggtcgaagaacaacagaaaggtggagtcaaggaacttcccaatagatgagagtggagtctcgggcacggggtggagttaatcggaggggtggagaaactgaaggctctaagtatggtttaggatgagggagggggaataaggaattgagatgtgagacggagcttaggtgatggaggcaaagtgaacggactctattaaaagaccgggtgtagcaaccccagggtgtgggaggggagggggtgcaagcaaacaagactttttttttttttttttctgagagggagtcttgttctgttgcccaggctagagtgcagtggcgcgatcttggctcactgcaacctccgcatcccgagttcaagcgattttcctgcctcagcctcccgagtagctaggactacaggcgcgtgccaccacggtctgctaagttttgtatttttggtagagacgggtttcactatgttggccagactggtctcgaactcctgacctcaagtgatccgccctcctcggcctcctaaagtgctgggattacaggcatgagccaccaccgcacctggcaaacaaacaaacaagacttttaagcgatggggtgaagctcatttttaacacctggatcaggaagacctcctctctcagccacccaagttcaactttgagccacccaagtctaagttgggcacttgagggacaatggaagaattcattccacccactcccgcttccccaggcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttgtaaggacccagcaccctcaggggagtggagagtgggtcaggagggctggaggtgctgtggggctgtgggcagcccccttagccttcctgagtttcagtttcttcatctgtgtaacagaaacaggcatatgcatttcatacgagttgataggagggtttggtaggatgtgtggaaagaggtgaaaccttattaagaggtatggtgatgcatgggggcactgaagactcaattgagctcctacctggagtgaatattaacccccctggcagctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagtaagccccagccccaaccccagctcacccttttcgagccccacagctcatctgcctagcgcaatgcaaagtgcataggcctgggaatcagaccaactgggtccaaagctcagctctgtcacttcctggctgtgtgaacgtggccaagtcactgaagcttggtgcctcaatatcctcattttataagatcctattttataagatcgttgtcaggattatttgtgttggtatatgtaaaaaatatttagaacaaggctggctgtggtggctcatgcctgaaatcccagcaatttgggaggtctgggcgggcggatcacaaggttaacagatcgagatcatcctggccaacatggtgaaaccccatctctactaaaaatacaaaaattagctgggcgtggtggcacgtgcctgtagtcccagctacgtgggaggctgaggcaggagaatcgcttgaacccgggaggcggaggttgcagtgagctgagatcgtgccactgcactccagcctggtgacagagcaagattccatctcaaaaaaaaaaaaaaaaaaaaatttagaacagcacctggcatatgataaatgtatatttaagtgctggccacttagataagagtaactgtgaggactatctgatatgcacatttggccatgtactggattctcaataattggtatctctaaataataataacaaaaataataattttttttttgagagggagtctcactgtgtcacccagcctggagtgcagtggcgccatctcggtttactgcaacctccacctcctgggttcaaacgattctcctgcctcagcctcccaagtagctgggactacaggcatgcaccaccatgcccaactactttttttgtatttttagtagagacagggtttcgccatattggccacgctggtctcaaactcctgatctcaggtggtctgtccgcctcggcctaccaaagtgctgggattacaggcctgagcaactgtgcccggcctatttttttatttttgctgctgagaaggggatattgttcttgttctggaagaggatgggggagagaagatgatggattataacctggtgttggtacactgtcagtattatttattcatcaaacaaagtgtatgccagtccctgaggatgcaggaaggagctcagagcctatctggagcaaaaaacatttgatatcagggcctggagagaaggactaagaaaatgctttggggattcagaggaggggaatctgggaagactgcctggaagaggaagcatctgagctcagatgggaaaatacagagtaggaatgcagagggcggaagggagggcatcagtaagccgatggatgtggggatgctcagagtgggtttgaggcaatgtgggtggattcatttgactgatgggaccagagagtaggtcaggaggtcttgagaattagactggagagggaatttgggcctggttcttggaaaacctacgtggaggagctgttattcaggctgaagctgaggactcctactgccactatttccctagtcactgatttctcctggacctggactggggtggaggcaggttctgggctcatccggcctctcctctcctcacaggaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctggtgagttggtggcgggtgagtctgggtgtgcagctgtcatgcagcacctcagagcaggccccttccgagccctgctgttgaacagtcctgggttcaaatgtggcccctggagctgacttgttgtgcgattttgggtgaagtgctcatttctgtctgggcaaagtgcttgtttcctcacttggctggcagtgcctcctcctggggttgctgtgaggattatctgagagaatagttgtcaaggtcctcaatatgtgcatgctgatcactggcatcccatttgtcttcatcacctagcatctaataggtgctcaattaacatgaattccctttttctttttctttctttttttttttttttgcacggagtcttacagtctcactctgttgccaggctggagtccagtggcgcgatctcagctcactgcaatctccacctcccgggttcaagcaattctcctgcctcagcatctcgagtagctgggactacaggcgtgcaccaccatgcccaactagttttttgtgttttagtagagacggggtttcaccatgttggccgggatggtctcgatctcctgacctcctgatctgcccaccttggcctcccaaagtgctgggattataggcatgagccactgtgcctggccatgaattccctttttctaagccatgacctctgtctactgtggggcaaaggtattttcccatcacacctaacacacaggcatgggaagcgaaggaggaggtaggagaaaccaagggaaaggaacctcatgccatcttttttttttttttttttttttgagatggagtctcgctctgtcacccaggctggagtgcagtggtgcaatcctggctccctgcaacctccacctcccaggatcaagcgattctcctgcctcagcctcctgagtagctgggattacaggcgcccaccaccatgcccaactaatttttgtatttttagtagagacggggtttcaccgtggtggaccaggctggtctcgaacacctgacctcaggtgatccgcccgccttgacctccctaagtgctgggattacaggtgtgagccaccatgcgcggcccccccatgccatcttgtttagttatttttttgaaacctctatagtggtagtaataataataactaacattaatgagcacctaactacacaccaggccctaagtgctttccacataaaactaatttgaccctcatgacaaccctgtgaaggatgtatcctcattttatgggtgggcctctgagcctggagaggttaagcaccttatcccacatcacacagccgtgagtgacttgagccccttcctgcagtgcgcagttctgtggacgagcttgttggcattgactattccctcatgaaggatcctgtggcttccaccagcaacctggacatggacttccgggtgagctgcttgggctggtgtatgacctctgacttcctaacaagacctctttctctgctaagttgcaagattttacttcttaaagcacagctctgatgaggccactcccattactgagaatgctatggctccctgttactacagaattaggttcagcctcctgggtctggcatttgagcccctgttaatcttacctggccccaccttttatatctcatcctgtttctttgcagctgctctttcccaaattggaccctggcttcccacctcagggcctttgctcatgcacggcctttccccaactcccccgaaggagctggacataaatttctatacaaataatctcatttcattctctcacaaccctgtgagtcaggtactaacatcatcctaattttaggaatgtggagacttactcatagaggtgacgtcacttgcccaaggccacatagccagtgtgtagccactacctttggtctcccagaggagtatagcagtttcagagtgcagactcgggagctagaatcagtcgggtgcagtggctcatgcctgtaatcccaatactttgggaggcccaggcgagaggatcgcttgagcccaggagtttgagaccagcttgggcatcatagtgagacctccttctctacaaagagaaaaagaatgcctgaagttcaaatcctagctctgccactgactagctgcacggccctaagcataagttttcagttggccagtttcctaacatgtaaatggaaataatctagtaagaaaacacacgttgttatgcagattaaagaagtcgatctatgtgaagagcttagagtacttggcaaagaagcatgagtatgcacaatatatgtaaacagtagctgttgttactgcctctagctttcaaggcccactcagatgtcacctcttccctgaaacctttcctgaccctccctcctccagtctgacgggctcgccccctggtagcaggtgtcctccttccaatgccttttaagagatgtgcttgtgaatcctccaagaacagcagctgggttcccaccatccccccacagtgcctagcacggggctgggagacacctgctgtcagtccaggtgccaggccagtctgccttgaccctgactgtgaatgccccaccccagggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtatgtcatggcctgtttgtgggatgggcaagagaaggtctgtgacagagctcactccctcactcctgattcccctgttcaggtgccccacgacctggacatgctgctgagggccacctactttgggagcattgtcctgctggtgagtgctggcgggggcagggatagggccacctgcacaccagtgagaccaaggaggggtgcaggtggggcccccagtggcagccacgcagacagggccctggcctcttgtctgtggccaatccccctcgccttgtcatggctgttcctgtctgtgaagcggtctgctccttcctgctccttcctgccccatctccttcgcagagctgctgtgaggattagtgagaacccaagctttgcaagtgtgagggctttaataataattcacatatacttttgtttatttgtgtattggggaggagagtaagagttacacattttatttatttttttttttgagacaagagtctcactttgtcacccaagttggaatgcagtggcacaatctaggctcactgcaacctctgcctcccagggctcaagccatcctcctgcttcagcctcttgagtagctggaattacaggcttgtgccaccacaccccgctaatttttatattttgttgagacagagtttcattatgttgctcaggctgtccttgaactcctgggctcaagtgatcacccatttttggcctcccaaagtgctaggattacaggtgtgagccaccgcacctagcagaattacaaattttaaaagaaataattcagtcattatcatcatccaatttatggcagggcagggtctctattgtcagactgcctgggcttcaagcctagttctgaaactgagtaactacataacctctacaagttacttaacctatctgtgcctcaatttccccatctcaaaaatggggatatggctgggcatgatggctcacgcctatactctgagaactttgagaggtcaaggtaggaaaattgcttgagcccaggagtttgagaccagcctgggcaacacagtgagacactgtctctattgaaaaataaatttttagtcagatctttttttttgggtggggggacaaagtctcactctgtcacccaggctggagtgcagtggcgcaatcttggctcactgcaattgaacctcccgggttcaagcaattctctgccatgacgactcagcctgaaaaataaatttgtaaaaaataacaacaacaaaattggcagtaataatatcggcctcacatggttattatgaggtttaaaggaaccaacacatatacagtgtttagaatcatgtttggtgaagattaggcagttgcatcttatagtattccttcactgcctatagaagaaggcatagcagtttagagaaagaagatatggccaggcacggtggctcacgcctgtaatcccaacactgtgggaggctgaagccggcagatcacttgagcccaggagtttgagaccagcatgggcaacatggccaaaccccgtctctacgaaaacacaaaagcaaaaaccaaaacaaaaaacaaatacaaaaataagccaggcgtgatggcatgaacctgtggtctcagctgttcaggaggctgatgtggcaggataatttgagctgaggaggttgaggctgcagtgagccgtgatcatgccactgcactccagcctgggcaacagagaccctgtctcaaaaaaaaaggagagagagagcaaaaagatatggcaaggggtttgggtgtggtggctcatgcctgtaatcccagcactttgggaggccgaggtgggcgaatcactagcctggccaatatggcgaaaccccgtttctattaaaaatacaaaacttagccgggcatggcggcaggtgcctgtaatctcagctacttgggaggctgaggcgggagaatcgcctgaacctgggagacagagttgcagtgagccgagattgtgccactgcactccagcctgggcaacaaagtgagactccatatcaaaaacagaagacatggcaagggctgagatactaatgcaaaaaggacatccacaaagagtctggattggagatagacctgaatattgagatgtatttaggaagcagaaagagaagaacacattcctgtttctttgtgtggcaaaggcatgaaggctagatgcagatgtgagagttttggaagccagagctccctctgtatttgcaatatgagagtccccagaggacagaagctgcacctgccttccttccccttcttccctgggggctccaaaggaaatggcagggacttgacccgcccctgctgctcatcccccagagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggtacgggtcccagagtgggggctgctggctgggggtcagggaaaaatgggctgtgggttactgaccttctgggtcagtaacatcctcctccccatgttcctgcaggacgcccgtctcagcgccaagatggctctccgggggaaggccctgcgcacgcagctggacctgcgcaggtaggcaggcgcacttccctgcacctcagtgattggaggacaatcacacctgtccacagggatgttgagcttaaagtacagtgatacctgtaagccactgagagctggggtctgtctttgttaatgcatgccaaagtgctttggtaaagtctgactcctctgcattctcacatgtcccagaggcaggcagggcaggtattatgagagatgaacaaatgggtccagcaatgttaaataacatgcccacagtcacacagcaaagatcagaacatgggttttgacaaaaacctcagcacaacacagctttgtgaccttgaggccattttatcttttttaaaaatgttattattctttttttttttttttgagaaggagtttcgctcttgttgcccaggctggagtgcaatagcgtggtcttgactcactgccacctctgcctcccgggtttaggcaattctgcctcagcttcctgagtagctgggattacaggtgtgcgccaccacgcccggctaatttttgcatttttagtagagacagggtttcaccatattggtcaggctggtctcaaactcctgacctcaggtgattcacctgccccggcctcccaaagtgctgggattataggtatgagccactgtgcttggccttattttattgtatttatttatttttgagacagagtctcactctgttgcccaagctggagtgcagtggtgcaatcatagctcactgcagccttgacctcctgggctcaagtgatcgtccagcctcagcctcccgagtaactgggactgcatgcatgcactaccatgcctgactattttattttttgtagagatggggtctcactttgttgtccaggctggtctccaattctcgggctcaagtgatcgtcccaccttagcctcccaaagtgctaggattacaggcgtgagccaccgcacccagcccattttgtctttctaggcctcattttctccatgtgtttaatacaggcaaaagtagcatctgccttctagggctgtgctatccaatatggtagatactagccacatgtgactatttacatttaaattaattataattaaatagtttttcagttgcactaagccacatttcattagccacatgtggctagtgactaccatagtagacggtgcagatacaaaacgtttcacagaaaatctgactggacagtgctgttctaaggttaaaggagataatgtaggttaggaccctaggttctagaggcagcttctgacactttccagctgtgtgacttcaggcaaattacttaaccttgcagggcctcattttcctcatctataaattagtgcaaatcctaatagtgcccactccttgggcttgttttgaggactaaaccagttggtactgtattttaaaacagtttactaatattaactttttaaacacgttggctgggtgcagtggctcacacctgtaatctcaacactttgggagaccaaggcgggtagatcgcttgaggccaggagttcgataccagcctgagctacaaagtgagatcctgtctctacaaaaaaatttaaaagttagttggtcatagtgatgcacgcctgtggtcccagctacttggaagcctgaggtgggaggctgacttgagccctggaggtcaaagccacagtgagtaaaattacaccactgccctccagcctgggcaacacagtgagacgctgtctcaaaaataaataaaaataaaaaaagaaaataaatatgcttagtgtctgacaggaactaagcaatgtgaagttttgttacataaaataaataacacctgcaaagctaccagcagaagtctggcacattagaagtgctcaataaaggccgggcgtggtggctcacgcctgtaatcccagcactttgggaggccgagacgggcggatcacaaggtcaggaaatccgagaccatcctggctaacacggtgaaaccccgtctctactaaaaacacaaaaaattagctgggcttggtggcgggcacctatagtcccagttactcgggaggctgagccaggagaatggcgtgaacccgggagacggagcagtgagccgagatcgcgccactgcactccagtgtgggcgacacagcgagactctgtctcaaaaaaaaaaaaaaaaaaaaaaaaaaagaggtgctcaataaataaaaagtagcagtcttggagaaaaggagacccaagtggcagcaatgactgccccgaggatacctggaaagttgtagcacttggaaaggtgcctaggtgggcatctgagcctgcaactcagacacctctggcaggtaggcctgggtggcctgaggaaggggagcttccaggcttcctgcccacagggctcctttctttcccgcaggttccgaatctattccaaccattctgcactggagtcgctggctgtgagtggggaagggtgggtgggctgggctgggttcgtgagatcctgaccctcaccatccccccctcctcatataactgctcacctgcgggcagctaaaggcaaacccaaccctgactcactgccctgtttccgccctcgcccctcccagctgatcccattacaggcccctctgaagaccatgctgcagattggggtgatgcccatgctcaatggtaaggctggggtgtgaggatggaggaagaaaggaggggtgaactgggcgggcccagactgagcggggtgctcccacccacagagcggacctggcgtggggtgcagatcccactacctgagggcatcaactttgtgcatgaggtggtgacgaaccatgcggtgagtgggggcaggatggggaaggagggagggccttcccctctctctatagctccccagtgccctccattacctgaccccagctcccccattaccagtcgcccctcccattttaatcttagactcctaaaagccgttgcacacactgtgacttcttggagcactcttctcccatcccaatacctactaattgttcaggtcttagctcagaggtcacctcctccaagaagccctccttgacacccatagtctacactcctacagcctcattttaacaccttgacatggaattatccattagattgagttcctgaaagacaaacactctgtctcttgatctctaaactctggcctcaataactgaatgaataaatgaggctcccctctccccaacacagggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcacc

SEQ ID NO: 16023 - DNA, 59140 bp, Human
aagcaaagaagccagatgagaactgtgtactgtacatccccacttgtttaaaacgtttgtatattatattcacatatgtatgctttccactacatagaagttttctggaaggtatttctgcacatttataaagatgcacatctaataatttcatttccccccattttctacttattgctctgaggtcaacactgaatagtccttatgaagatggtattgaatattctttcaacaaaaaagtctccggatctcaactactggagctcagaaaacgataccccaaagtaggaggctttggcatgctaagtactttgaactaaaggagattaggtctcagtagcagcctcagaaacaaagtctacccatgactttctcctgccctcctgtctccagcggtcttgcacccctgaagtaagtcacaggaaccagaattcttcttccccaaggagggttatggaaacttagaaccttcaaagtaatttataaacttggaaatcttactgtaacattttcttctacctctctctgtctttgagacagggtcttgctctatcacccaggctggagtgcagcagcatgatcatagacaactgtagcctcctgggctcaagcaatcctcctgcctcagcctccttagtagctgagactacaggtgtgtgccactatgcccagctaacttaaaaaaaattttttttttgtatagagggagtcttgctacattgccctggctgagaatttacatttctaacaagttccaaggagatgctcctgctgctggtctggggatggccgtttgaggatccctgcatgaaggcatacacaggacttgatcctcagtgggggcaccaggagctggagcctggggagtgggaagcgagagcacagagctgactgaggaccacgaggtcgtcgtggaggacctaggctgaaggtcctgaagaaatccccatagtttcactgccaggccagccaggtggacatctcagggctgaggaggtgagaaggcaagacagaaagtgaaacagcactttataggatagggatgggaaggtcatctgcatcatgggactccttggggaggggttcggtcattgctccagatgaaggtttagtcttttcatcgtaaatttgctttcactgttgggaaagagatcttcacctccattttcttaacttcaaaatggaaatgacagatgcttttgagtggtctgaatacttgaaatttgagggaaaacgttaccagaaacacatacaactagagttaaagataaatacatatatcaaacgcatggctcaaaaatgacaacgcgtcttctttatctgccttcacgtagaacttaaaacagaccctggtccccacctcggggtttcctcgcgcccacgggctgcgctgcgcagctgggccagcaggtggcgaggctcccgcactttttttcccgggcctggccgcaccgccaccgcccaccccgcgctccgccccgccccgccccgccgcactcgcggatcgtcacacggtcaggccaccgcgcgtcaccgccccgggctctgctagaaagtgccggggtccagattcctttcaggtgactgggttgggaggagaagtcgctcagcgtaattgtcggagccgaaataaacagagactccgcggccgggcgggaccttacccggaagtcccccagaacagcactacccttcgctgaaacctcgcccgccccctccaacccagagacgaaaagggaaagcatcacggccagaaaccgttggcacaactccacagatactctcccgggccgagccagactccataagtcccgcgcctggcccccggggattgcaggggctgaggagaagggcaacacggggaccttgaagcggggtcgcggcggcgccccagcccgggccagggagtcccggcagcggcacctcccagaaagggcggagccgacgacgccttcttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgagcggtcgccggccaccgggacgccctgtggggacgtggcggggccgagagccggggaaggcgacgggcccagcgacggctcaggcccgggtcctggggaagttggtctggcgatggagagctcggaggttcctcacttgtcctgtttctgtctccggccacgctctctttcctgtggtctggaagagggtggcagtgggggcttgggtgacctgttctgagcttgttccatctgtggtcacctaatttctctgtgtaggatgtggcaccagaagaagggaggaaagtgggtagagtgggatagggacactacttgctttttaaaaaattctgctacatgcgcacgaactccaaaatttaggagctctaaccactttatttcctcttctcatcacctgaggatggaggtggaagcagaggtaaagagacacaaacttcctcaagcacccggtgaaactgccttgagtacttgacataagtcagcttggtcttctaaagagggcaggttacttttcatcaactcctttttacacctcaggacactgagactcacagggcggtattgaatttccccttgtcactattagccagcgacaggatggggcctggaactcggtgtcctgctgactccttctgggggcttttgcttggtttaatagctttgggaaagagcacctcagtatttgtgtgtctgtagtttcctcttttaaaactggagtggggcagtgtcacgctgtgactcgttaaaccaaatcaggatgagagtgcctccggggaattgtgtccttgtgcacattaacgcccctcacataggtgtggcgtcaataggaagtggtgaatcaggggagagggggttccgtggactagaaaaaactctccttcgacttctatttagttctcagaaggggataggtgatgttgatccaataatggactaagagccaggagaagggctccgcgggaggatctcttgagctcagcagttcaagaccagccggggcaacatggtgaaacaccgtcttaaaaacattttgtttttcttttcattgttgaggttgaggctgctgtgagctgtgatcacgccagtgtactccagcctgggcaacagagcaagaccctgtgtcaaaacaaaaaagagagagaaataaataatagcaattatgtgccgtagagaaaatgtggctattctgtttccctagagttttttaaaatttatttttaaaatttatttattttagagacaggttcttgctctgttgcccaggcgtgggggcagtgtcgccatcatagctcactgcagcctggaactcctggcctcaagcagtccttccaccttggcctcccaaagcactgggattattgtgagcaccactcctggcccctcctagagttttagatcaggaccttaaataggcttcccttttttttggagacagagtctctgttgcccagtctggagtgtagtggcgcaatctcggctcactgcaacctctgcctcctggattcaagcaattctggtgcctcagcctcccaggtagctaggattacaggtgcccaccaccacgcccagctaatttttgtattttccgtggagatggggtttcaccgtgttggtcaggctggtctcgaaatcctgacctctagcgatccgccctcctcttttggggattacaggtgtgagccacctcgcccagccaggcttcacattattaagtagccatctcttaagtattttttaaatctcaagtacccaaggctgatggccaatgagtgcttcttttatgacatttgggataggtcagaggtttgttgtaagtctcttgcaaaaatgcctggaggccttttcaaggtctgtaaaccttaactggaaataatcctattattattttaaaaattcctcatgtctgaaagctttcagtgcacctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtcatctaaaaactatatgcagttttgagacatagcctttatttttcccggctgtaattttggtaagctttatcttgagggacttggaacatagagaagcctgggtagaaattaagcattaaaatggcttttcctcagaagactgggaatggttaatcttttgacctgtgagtgattaagaacaaccatctgaaattggaatgactgtgggaaatctttccccatctttcccactccttgactgatgctgtgatcagaaattttactaacataagtaatcaaggggaaaatgagatttttttaaatttgagccagtgggcagagggaaaaggactcgctgaataggcctttgtattcctccagtgtttgttatattacccagaacaaagaatcactctggtcatgaagacagtgtgctctctctttcctgggtaaccctccactcctaaaagggatgcagtattctaagcatggcagattacctacagcggaagcctggatcagtcatctctgatctcgggtgcccctttctgccctttgacctccagctctgtgaagggcatcagctctccagtcaaattgaactgcttgctagcaaaatcctgcccatcttccagggccccatttcacatgctacattatctacgacattcttgtcctgttcccctaactagaatgccttccctctgaagttctgaatctttatttaaactgctgcaacagcatttgctgcctcattaaaagaccttggtgtgggtcttgactcttctctgttcccaagagtgatcttgggtaagccagttatcctctggagcctcagtttcctcctctgtaaaattggattaactgtgccaactatgcttgtgaaagacaaatatttcctaattgaactaccgaattgcaggctccttaagagcaataactgttgctctccaatatcatctacaaatgtggccaggacacttgacttgggactctttttttttttttttttttttgaaacagggtcttgcactgtcccccaggctgaagtgtagtggtttgattgtggctcactgaagtgttgaccctgggctcaagctatccttccacctcagcctcccacgtagctgggactgcaggtgcatgccaccatgcccaactaatttttaaattttttgtagacacaaggtcttgctgtgttgcccaaggtggtcttgaattcctgggctggagatcctcccaccttggcctcccaaagtgctgggattacaagcatgagccaccgtgctggccctggaatcttttttttttttttcaagaccaggtcttactttggttgcccaggctggagcgcagtggcacgatcttggctcactacagcctcgacctcccgggctcaggtgattctcccacatcaagcctcccgagtagctgggactataggtgtgcaccatcatgccctgctaattttttgtatttttagtagagaaggggttttgccagcttgcccaggctggtctcgaactcctgagctcaagtgataccatccacctccgcctcccaaagtgctgggattacaggtgtgagccaccatgcctggcccactgggattctttgatcataagatatttgggccttgaaatggattttggggagagacttagaaactagtggcaatcaaaattggatttgcagttggtttctaggtgatggcagtgatcagctgcggccagccaggtttttcttcatctggactgtgcctctcactttcaaatttttggaacatttgctttggcaacaaaacttttaaaaaaccaactctctctggtgcaggtgttctgttggaggatttgagagaagctttaaaattttatcttattactgtcccttgcttaggtcacaagaggagctcaaaataatttcataaacatgaattggcttccctagacacaacaaaggataagatcaaaagaattaacccatttaaaaaaatcagtctaggctggtcctaaggtagtgtgttatcaattgatcaaagtcagttacagatcgaactccttgatctactctttcctcctgctcactactgcacttgactagtccaaaacaataagtaagtagtaaaaaaaagaaaaaaagtccgtctatacactgtaaagtgctgtgtaaatgttcataattactatcactgtcttcttcatagttgatggggggaaggctggatacataaaaaaatggtaatacagtaagaagtgctcagataagaataaagataaaatgttatggagagtccatttttgagctgagctatggaggatgaattaatgtatcaggtggacaagaggaaaactagagaaaatagtcgggagagttgcctaattgttgccctaaactattgaactgttcacttgaaaagggtgaattttatggtatgtaaattacatgagtaaagctcttaaaaaaatttgcagggtgctatatactagattacataagactagagacaaaagctacccaaattttgcatagtactccattgctatcacatccgatcttgttttatcctcacagagcccctttaaggtaggtgtaatgctgtttttcctattttatagatgcagacatcaagggtcaaatttgtcccaaggtcacatagctagtagatggcacattgggtgcttcaactgccatcttctgacttctgtgccctagttttttgaaattcaaggctagattattggtgtttagcaagcttaattgaatgggtgttcagcagatattccacttggttagtagagcagtctcattcaaggcctggttccgtccccagtgtggctcttccagtagtccgtaatagatcaggaatgggtttagcctgctggcctgacccctgattcagtcaccacactgtgaacattccatagggaaaaaactgcagacagtgtatactgacacccactttcatagttttgttttagttttgtggctcctaaatgtctaagactaactagtaatatgaccttgggtgagtcacataaaaaaccagaagctaaaggggttatctgtaaaacgaagagttggactagctgagcacacctagcactcaaaatatatgacttaaacacccacatgcaggcaggcctggtgcacacacaaattatcctttgttatgtagatacgttcatgccaggttggctataaaacacttccagagatttccgtcaatagaagtcagaccagcccggcagcctccaccctaaatgccctgccatatttgtttggtctgcctccctgactccaaagaagcagcaggcagcttaatctctggacaggattcttcatgccactccctccactccagcctgtgttgtcctgactggccaggccagcctctgctctctggagaagcaatgaggtagggaagttaaccagcaagcccctctcctccatcgcctcactggagcttgagctgggtatctctccatgttttgccattagctttacccatccaggacaggggcacaagtgttggtgccaagccctgcactcccagctctggtggatggccaagtcctaccctggggttgaggactgtcagtgatactgagtaagggagtcattgcttgacaactgcctagagagatactttaaaagataggaatgggaggcattatttctacaagtgaacaagtttatattgaaggaacacttgtataggatcatcatggatgggacagttcatctccagtgcattctccaattctgaggatacatcactgcacaaactggactagagtttaaatggtacagaagctgggggtaggggaggcaggaggacaagggggatgggtggagaatgcttaacttggtgttcaaaatcatgttatttatgagccatgtgacctcagagtatctttgagcctgagttcacttacctgtaaaattctgctgtgctactgcatagagtatctgagaaaatgaggcatgcagtcgatgtttggtatttttgtttcatttatttattttactgccatgcctcgagaacaatagatgttcagtaagtatttgaatatgttagttaatgctttaggatttcctaaaggcagtggaatagaattctcactgagttcagagcttttctgataataatgtgtgcttatggagctcctgaatggggtccaatttagcagttgctatagttgctgagatatagcacaaggggcatttttttttttttttagatggagtctctctctgttacccaggctggagtgcagcggtgcgatctcagcttactgcaacctccgcctcccgggttcacgccattctcctgtctcagcctgtagctgggactacaggcacctgccaccatgcccggctaattttttgtatttttagtagagacggggtttcactgtgttaggcaggatggtctcgatctcctgacctcgtgatccgcccacctcggcctcccaaagtgctgggattacaggcatgagccactgcacctggcctagaaggggcttttttttaacctttcctgaactgttcctatcgttgaaagaagcttccctatccagtcattttcttagtaattaaactctagagcatgttgtgaaatatccatatgatctaacctttaaaaatagaaactctttagctgtgtaactactaaattctgggtagaagccaaaacaatcagcacttctcatttctgaacttagataatccagttgtactccctcagctcattgtgagttttgacaagttctgcatccatgaacaccagatgtaatacaatagggaatttcaaaggaaggattacacacctaggctctgccctctaggattttaccgtcttacaagggagttgagacaaaagtgagaaaatactctggcaacttctcccaacatcacaactttgcaattctcataaattttgcttgatcctagggcatgaccaaggcagaggcaggcaggtcctacttcatgtgggagagaaggaaggaagggtaggcagttagagtgataggtttggaatactgtagaaaggagagtgggcagagccagagtgaggtgtctgaagcttgtcgcacaggcagtgggaagggtgggttggaggtttctgagcaccagaaaactttgagcattgttccggaagaggcaagcggcaggcatctgcaccagagacactgccgggtccgagtgagggcaggaggctgcacgagggagcctccctgggagtgagcgataggttcgctatgggaggtgggttcgaaaggtgcctgagattttcatttgaaactctgttgaagaggaattggcaatagaggaggaaatacaaatagaggaaagattggtttcgtcttaagcactgaggctgttgggcagctagtggaaagtgctgctggagagaagctggagatcactgaagctgagagaggggtttgtggatataattagagcagtgtttctagggaggtgcaggtgaagggactgagagagagatgaggttaaaaacacagaagagaaagagatggaggtgtggaggcccctgaggtggagcagctgcagaggcaggcctgggggccaggaggctggctctccactttcagctgttggtgagaagggagtgaaggctgagcagctcccattgtgcagctgttgagtgcacaggtgctcgtgctcttgcacacggtggggtttggggagggtgtgatgctacagggaggactttcatgatgcagctgattctcttttattgagagtctgtttctggagtcacctgctctgttttgaatcctggctttgccactgtgaccttggacaagttgtttagcctcagtgccttcgtttctgcatctgtaaaaggggtataataacgcctccctcatcaaactgttgtaggattaattgggttaacatattgagaggtgacagcgtgctggcagtcctcagagcccttgcttgctctcggcacctcccctgcctgggctcccactttggtggcatttgaggagcccttcagtcccccactgcactgtgggagcccctttctgggctggccaaggccggagcccactccctcagcttgcagggaggtgtggagggagagacacgagcaggaaccggggctgtgtgcggcacttgcgggccagctggagttccgggtgggcgtgggcttggtgggccccacactcggagcagccagccagccctgctggccccgggcaatgggggacttagcacccgggccagtggctgcagagggtgtactgggtccccccagcagtgccggcccaccggcgctgcgctcgatttctcgctgggccttggctgccttcccacggggcagggctcgggacctgcagcccgccatgccagagcctcccaccccctccgtggcctcctgtgcagcctgagcctccccgacgagcgccaccccctgctccacggcgcccagtcccatcgaccacccaagggctgaggaatgcaggcgcacggcgcaggactggcaggcagctccacctgcagccccggtgcgggatccactaggtgaagccagctgggcttctgagtctggtggggacgtggagagtctttatatctagctcagggattgtaaatacaccaatcagcaccctgtgtttagctcaaggtttgtgagtgcaccaatcaacactctgtatctagctgctctggtgaggacgtggagaacctttatgtctagctcaaggattgtaaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtgagtgcaccaatcgacactctagctgctctggtgaggacgtggagaacctttatgtctagctcaaggattgtaaatacaccaatcggcactctgtatctagctcaaggtttgtaaacacaccaatcagcaccctgtgtttagctcaaggtttgtgagtgcaccaatcgacactctgtatctagctgctctggtggggccttggagaacctgtgtgtggaaactctgtatctaactaatctgatggggacgtggagaacctttgtatctagctcagggattataaacgcaccaatcagcaccctgacaaaacaggccactcggctctaccaatcagcaggatgtgggtggggccagataaaagaataaaagcaggctgcccaagccagcattagcaacccgcccgggtcctcttccatgctgtggaagcgttgttctttcgctctttgcaataaatcttgctactgctcactctttgggtccacactgcttttatgagctgtaacactcaccgcgaagatctgcagcttcactcctgagcccagcgagaccacgagcccactgggaggaacgaacaactccagacgcgctgccttaagagctgtaacactcaccgcgaaggtctgcagcttcactcctgagccagcgagatcacgaacccaccagaaggaagaaactccgaaaacatctgaacatcagaagggacagattccagacgcgccaccttaagagctgtaacgctcaccgccagggtccgcggcttcattcttgaagtcagtgagaccaagaacccaccaattccggacacaatgtgaagagcatttaaaatagtgcctaagcctaggacaccgccagtgctttgtaagtctttgggtcctgctggcttaggttgcttctttcggcaggatgactttttttttgagaccagttttcactttgttgtccaggctggagtgcagaggtgctatctcagctcactgcagcctcaacctcctgggttcaagctgatcttcccagctcagcctccggagtagctgggactatgggcatgtgccactaggctcggctaatttttggctgttgttgtttttgtttgttttgtttttttgtttgttttttgagacagtttagctcttgttgcccaggctggagtgtaatggcacaatcttggctcaccacaacctccgcctctcgggttcaagcaattctcttgcctcagcctcctaagtagctgggattacaggcatgcaccccccacacctggctaattttgtattttcagtagagacagggtttctccatgtcggtcaggctggtctcgaactcctgacctcaggtgattcacctgcctcagcctcccaaagtgctgggattacaggtgtgagccaccgtgcccggcctgttgttgttgttgtttttaagagacagggtttcactgtgttgcccaggctggtctcaaactcctgggctcaagcgacccacctgccttggcttcccaaagtgctggggattataggcgtgagccaccacttccagccaggatgactttttttttttttttttttttttttttggtcttctctgctgtgtctctagaagatgaccttttgagaagcaaacctgaatgttgattcaagcccaaatttcctgggctcaggtgttaattttttaagtctttggaacctctttgccgaggtctcaagcaggtagaagacattaataataattccttatatttgattgcgtggtgctctgtagtttactgagtacttactatatatgtacagataggcccttatttgatcttcacaggaacctgtgaggtaggcagagcttatgagcttcatttcccaggtaggaaaactcctacgtggttacgtaacctgctccaggtgtgatcccaggtgcaatccagctcaacaagcacactgagcctcaggagctcttgggatcagaacccaggactcgatcccactccgtgccgccttctcacccacccctcttccaccaagtgggtggaaatagcacttgctttgaaataagtaacgaatgatctttgtgaaaaggaacctaaacagcagtgggccatctttattcacatctatagtaccaagtgctgagtaaggggattttagactccagacacccgtcctgtttgtcaggccagagctgcagtgtgttgactgcacatctgtctcttgtcactcctgctcctgtgggtaaccagccagagtgcccctgaggcagagacaggccaatccctggagagttctgcgaggtctagggaagagttctttgtatttaaaatttcatgtgaacttcagcagtttcctctgcctctgtagtcagcttttgccttttcaaactttagttagatggataatgacttttactcattaggacttttttccattagttggaaacccagagttgcaatacgtttcttttttccttagaatcaccgggtttatgggaataacaattgggattctctttatataaaaatagtggtggaatcttggcacagggttcatatgtggctttgttgaaggcttgttgtcacttccttatttgtataatttccctcctttgtggcctaaacatgactttcaaagagtcaagaggagttaagtcctaatttttattttagaacatctgaaaaatgaattcagagaaaagtgatattgatgccttggatttccccacacatacaaatcccaatctcctgctgactttttctcatgtttttgggcttcagggactgttgtgggatttgtattttgatactgaaggaccaacacagactgacttagcttcttgcctgtgtgcaggtcatgtgccactgtcactggagagaatttcatgttgtgacttctgttcagatttgttttttttttatggctttcccatcagggttcttgggagccatggctgcttcttgatatcttctgtttccctgtagaacagacgattgcaggcccggggccctggcaagctgggccctctgtggctttctgagtccattgtgaggcagaggatcaggtgcgttttgggcagcagccttcagagcaaggcactgacctgatgattcacactgacccctcccctccgctgaattttctgacaaccttgtgactctcacatgggaaatgtgagtggtttttgagaaatctttacataagaggttttaaaattttcttttgagattgcctcggtgtttttccttaaagttagcacattctttgctttctacttcagcctcaaggacaggaagttcattcttgctctttacattggggtgttgatgtttgtggttttgttgttttgttcttcatgttactcatgatgtattgatattaattaacctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtggcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttgttcgtttcttttctgtttttgagacagaaggagccttgctcttttatcctggctgaaggctagagtgcagtggcacaatcacggctcactgtgtcctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcatgagccacagtacctgtcctcacttgctgctttcatcataattattaaaggtttcaactttccctggaattactaatagaaatagtaagtagcactctggttgaattgaatcaaacaaacaaaaaaccctaagaagacataaaatgattgtcaggagaggagagaaagcttccaaataaaaagaaaattagaaacatctctacttgtgaataaatagtaaatgtgtagccttttaaaataattctataataactttgcaaatacaggatgtgtcttacccttttgtacttcaaaaggattacatgaatgaatgtgtcttagttcactgaggaatgttgaccttactctaactgttgcctactcccgtgtctgtgctctttcacctgaaaggaactctgtccaggattcttctttggcaatgtcagtctctgttgtgatgttcggcagcttcagacactaaaagacaacctgcagctgcctctacagtttctgtccaggtaggttctgctggggaaacagaacaactgggctgtagatacttgtgaactggtaatgctcagctttccatttattctttgtttacatatttttatttattatatgtctatattatatgtatattatatatttatacatatatgtatacatgtaaagtaggtgaatatatatttatgtattaaaaatacatgtatgtataatgtgtatgcatgcgtgtgtgtataatagagacagagtctcactctgctgcccaggctagagtgcagtggtttgtggtgtgatcacagctcactgcagcttaaacttcctaggctccagtgattgttctaccttagcctcctgagtagctaggactacaggcatgcactaccatgtctagctaattttatttatgtttttctttatttttttttttttttgagacagactcttgctctgtcaccgaggctggagtacagtggcatgatctcagcttactgcaacctcctcccgggttcaagcgattctcctgcctcagcctgcccagtagctgggactgcaggcacatgccaccacacctagctaagttttatatttttagtagaggtggggtttcaccatgttggccaggctggtctcaaactcctgacctcaagtcatctacccgcctcagcctggttattacaggctgggattacaggcatgagccactgcacctagcctaatttttatttttttctagagatgagggtctcactatgttggccaggcctggtctcaaatgatcctcccaccttagcctcccagagtgctggattataggtgtgaaccacagttcccagccagttttttttttttttaaagtcagtttttgttttgttttaagaaagcactcttacaatttgtcagaaataaagagaaaaacaataattaccagacttggttcacttcccagttgcattcagagttgatgcttggtttcctctgcgatgttctcaccctgcagggtgtctgcactgcggccaggctcctttcaaacttgagctgtgcactgtggggaagagaggttcctaggggtcctgctcaggtgcctggcctgagactctcatcatgcagtccttcctctccccccatgctttgctttgcacatcattcttgtccctccctctggtgaagggttgtgatagagtcaggtcctcagtagagccggcctcggggagctgttaaaaattttgttctgctgtagctggctggttttgtcaaacttagttttttatctgttctgttggctatgaccctgagcagtgaaaaagggcttggtaatagatgttcttctctaggcctagccagcaattctcaaatatgcaaaagagcaagctggtagtggtctttagaacagcagattgtggtatctttctaaatttttcagacttcagcacactgataaagatgtttgggaagcaaatattaaaaagggaaaatgcttctctgcacaaatatcactgcaggtggtgatagggcacaagttggcttccagtgaagaaattctgcttcttaccaaaagttaacaatagagaatggaaaaccaccactaaattgttttttcagaacaacaaaagttgaggctgtaattgggccagcatatcctatgaaaggcttgtgaacattgatggaaccaaattggagccttgtacactcagtcaaaacacatttatttaggatccaccgtaggtgaggcattatggacatacggacataaacataaaaagatagccaacctttctccatattatcagaggtaccaaagcttgatttataatagcaaacaggagaaacaacctgatatttggaaaaatatacagctgtcaaaattagtgattgtgggcattaaatgtagtaacatggaaaaggtttgaaaactgtgtaccccaagagtgattcctattagaataatacaattgtggtttctggctttgttgcagtaaagcagtggggctcctgaaagaaagagagtctgtgcttctctgtctccttcactagaacagagactcttgaaggccaggacacacttttttcattctttgtcttacatggtcactgggactgaatcggagtctaaagtaatcttgattgcaagaatgcaagtctaatgaaacagcttttgcaagtaacagtggaccaaagggaaaagagagctcttttatcatgtaacaagtcaacattaggagcttaaactttgaacctgaaggatagcaggcagcttatggttcttgtgcagttgtgtgctcctgaagtgcatgcagccagagaacaacattgctgttctctatctttacaaaccatggggatttctccttgtgtttcaggagggcctagtgattttccggggcttgaaagaaaacctttcaataggttataagatgaagattctcataattctcattattttattttcttcttaatcaaaactgtcagctggtgcagcgctcatgtcgataatcccagcactttggaaggccaaggcaggagggttgcttgagtttaggagtttgagaccatcctgggcaacacagacccacatctctacaaaaacattttaaaaattagccaggtgtggtggtgtgcacctgtagtcctagctacttgggaggctgaggtgggaggattgcttgagcctaggagctcaaggttacagtgagctgtgatcacaccactgcactcagcctgggcgacaaagtgagaccctttctcaaaaaataataataattgtcttcctgatgctccaaagtccctttactctaggtcagagaatgtatgtctctaaattataaagtgcagaattcagagaagcatctctctctttttgaaattataattggacacaataaatgcagaaagtaattagggcattttttaaaggtgtgcctttattttaacatgaagttttaagtttagaattgctggtttttaatatgttctcttggtaatttgtcactttacagtaagtttaaaatattctttgtctatttaaaatcgttcttgctggccctattatgtgtgagatcatgcagaatataatttacttttcctttagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatggtaagtaaacttttaattattcctcttttacagctggcatcaggacagcagagcaaattgttccttttagttgtcctgtcaactctggaaaatcacaattttcagttccattggccaggaaataagagttgttgctttgcttgtatcctaggacttgaactgcaacgaatataaaaatctccttaaagcgcttgctttaactccccctaactttaacttcccacatggaaaattttagtatgtgcaagtttgcatccatacacttcagtaaccattggatctttgactctaacagacatgagttgtgtaatgtcataaattactgcaagactgagaagatagaactgttaatagttggcagagaagaggtcatgacttgcaagaatcagatcaccataaaggaaagtcagcaggtctaacagatagcagaaatgatcccccagcattgaccaacatacaacatttaattataatgacaaagtaaaaaggtaacaaaaaaattccatagaaaaaaggtctcattcacaaaagcaacaaaaaataaggcacttaggaatccaaaagatgtgacatacaaggcaacctgactgaatggagagaggtcattttgtccagaaacagaagcctgcatgtatggaaagtggatgtgtaacacgtgtgtcattacaaatcattgagagaaaaggtgggctagttgataaatgagatgagaaaatagattatatttatctaattttaatttttacagaaaataaaaaaatcaattgtgtagattaaaaatcccaattggaaagttttagaagtaaatatggaaagatttctagacaggagaggaaaagcagaaaccataagaaaaatatttatgaatataaacaactgttatctagagcagacagcgaaatgcaaatttgaacagtaaactaccatttcacacctcatcagcttggcacaaattaaaaagttggtcaatttcaactgtgggtgaaaatgtgaagcaataggaatactaatgtactccaccacttacaaccataatttggtacaatcgtttcaaaactacttgaaaaacaactttgcagtacgtagtaagttgaagctaaccctcctcccagaaatttcacttatagatgcctgccttagagaaactctaaatgcatataaacctggagacccatataagaacacccactgtaacactattgtgattgtgaaaaattgaagacctcaagaacgagaagacaagacacagactgggagaaagtatttgcaaaagacatattagtaaggactgttattcaaaatatacaaataactcctaaaactcaataagaaagcaaacagcccaattgaaaaatggacaaaacaacctgaacagatacctcaccaaagaaggcatacagtggtaaataagtacatgagaagagatgctcaacattatgtcattagagaattacaaattaaaacaacgagataccactacacatctattagaatggcaaaaattcaagacgctttcaacaccaaatgctggcaatgagctctcattcattgatggtgggagtacaaaacggtacagccaccttggaagataatttagcggtttcttacaaaactaatcatactccttggtatttacccaaatgagttaaaaatgtgtctaccccaaaacctgcacgtggatatttgtagcagctttgtccataagtgccaaaacttgtaagccaccaagatttctctcagtaggtgaatgggtaaataaactgctacatccacacagtggaatattatttggtgctaaaaagccatgaaaattcagtgctatcaagccatgaaagtacatggatgaaccttaaatcctattactaagcaaagccaatctgaaaagactactcactatgattccactatatgacgttctacaaaaggcaaaaccgtggagacagtaaaaagtcagtgattgccatgggttaggagagaggaaggcataagtagagcacagaagatttttaggtggtgaaaatactctatatgatactataatggtggttacatgtttatatgacattttgaaacaaaagtactacatacttaaaacaagtacacaaacatgcatgggaaggataaacatcaaattcaggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggactgtaggtgtgagccaccacacctggcctatagtgcattattatttttatttagtttttaaattatgccatagccagttgttctgaatagtgcagtactacaaaacagagtcaaggtctcatgctgtcacccaggctggaatacagtgatgcaatcatggctcactgcagcctcaacctcctaggttcaagtagtccccctgggtagttggaaccacaggcatatgctaccacacctagctaattaaaaacaaatttttttttgtagagatagggtcttgcttttttgcccaggctggcctcaaactcctggcctcaggagatcttcccacagtgctgggattacaggtgtgagtcactgcacctggccaagtccattatttttttaatgttgaggcaaatgttgtgaaatggtatgactgatagttaactgggtaatgaggaaatgagaattgtattattctccatgtgttttgtatgcttgaaacataaaataaaacctgaaaaccaaatggtgagctggaagatacgagggaattactcagaaaacagcatacagatacaaagacctataaatcattaaagaaatgacatataacatgagaagctccagagagttggggagagacaataataatcaaagggataatgaggattttccagagtggataagggatgaaccctgagaacttagagaaaattcagcatacaaaaatcagttgtatttctgtacacttgcaatggacaatctcaaagtgaaaataaaacaattccatttactttagtatgggaaatacttaggagtaactataacagaaggcaaaacactttaaagaacagccgggtgcagtggctcacacctgtaatccaagcactttggaaggccgaggcaggcagatcacaaggtcaagagattgagatcatcctggccaacatggtgaaaccccatctctactaaaaatataaaaattagctgggcgtggtggcgctcgcttgtaatgccagctacttgggaggctgaggcatgagaatcacttgaacctgggacgcggtggttgcaggagctgaaattgtgccactgcactccagcctggctgacagagcgagactccatctcaaaaaaagaaaaacagaaaaaacacactaaagaacattattcagcgaaattaacgaggatctaaataaatggaaagacattccatgtttatcaatcaaaagacttaatattgtttagatatcagtattctccaaattgttttatagattcagggcaatctctgttataatcccaactgacttctttgtggaaattgacaagctgattctgaaattcacatagaagtttgagggacttagaatagtaaaacaaccctgaaaaaagaacaaaataggaagactcacacttctcagtttcaaaactaagcaatggaaatcaagacagtggtactggaataaagatagacatatagatcaatggaatataactgagaataaataatatatctatggtcaactgatttttgacaagggtgccagggccattcaatgagaaaagaatactcttcatcaaatggtgctgcaataactggatacacacatgcaaaaataaataaataataatgaaattgggccctacttcacaccatatgttaaagaaattaactcaaagtggatcgaagacctaaatgtaagagctaaaaactataaaacaataaaacatagggattaatttgcatggcctcatatttggcacttgattcttaaatatgacaccaaaaacaagagcaataacagaagaaaagattaattggacttcattaaaataaaaaagtttgtatttcagaggacgccatcaagaaaagacaagaaggccgggcacagtgactcacacctgttatcccagcagttcgggtggctgaggcaggaggattgcttgagcccgggagttcaagaccagcctgggtgacaaagtgagaccctgtgtctacaaaaaataattagccaggcatggtggcatgtacctgtggtcccagccacatggttatctgaggcaggaagattgcttgagcctaaggaggctgcactaagtacctcgcactccagcctgggtgacagagtgagactctgtctcaaaaaaaaggacaagaatatatttgcaaattgtatatttgataagggacttgtatctagaatacataaagaactcttggccgggcgctgtggctcatgcctgtaatcccagcactttggggggccaaggcgggtggatcacctgaggtcaggagttcgagaccagcctggccaacatggtgaaaccctgtctctactaaaatagaaaaattagccaggtgtggtgatgtgcgcctgtaatcccagctactcaggaggctgaggcaggagaattgcttcagcctgggaagtggaggttgcagtgagctgagatcacaccattggactccagcctgagggacagagactccatctccaaaaaaaaaaaaaaaaaaaaaaactcttactactcaatgataaataaataacccaatttaaaatggcaaaagatctgaatagagtagacatttctctaaggaagatatacaaatgaccaacaagcacatgagagatgctcaatactatgagtcatcagggaaatacaaatcaaaaccacaatgagataccacttcacacccaccaggatggctagaatcaaagtcacataacaagcagtgttgacaaggctgtggaaaataggaacctttattaaaaagaaatccaaaaaccaaaaacagctgggcacagtggctcatgcctataatccagcacttcggacggccaaggcaggtggatcaccttagctcaggagtttgagaccagcctgggcagcatggtgaaactccatctctacaaaaacttagctgggtatggtggtgcacatctgtagtcccagctacttgagaggctgaagtgggaggatcacttgagcctgaggggcagaggttgccagtgagctgagatcacaccactgcactccaatctgtgtgacagagtgagaccccactttggaaaacagtttggcagttcctgaaacaaacatagaactaccatatgacccatcagttccactcacaagacgaaagtataggtcaacacaaaaacttatacacaaatgcttctagcagcattactgataatagccaaactgtggaaacaactcagatatttatcacctgatatatggataaacaaaacatatgtccttgcaatgaaatgttgttcggccataaaaagaaatgaagtattgatacatgccacaatatgcatgaaccttgagaacattatgctaaatgaaagaagccggtcatgaaagaccacatattatatgattggatttatgtgaactgtctgaaatagtcagataaatagagacagttcagtggttgcttagggcttagggaagtagggaggtagttgagcatagctagaatacaggatttcttttgaggtgatgaaaatgttataaaattgactatggtgatagttgcatatatctatgaatatgctaaactccattaaattatatagtttaagggggtaaattgtaaattacatgtaattatattgtaaattatatagcgccaccacacctggctaatttttttttatttttttattttttgtagagacggggttttgccatattgcccaggctggtctggacctcctgagctcaggcagtccacccaccagggcctcccaaattactgggattaaaggtgtgcataaccacccctggcccaaagacaaatatcttaaaagcaaatagagacaagacacaaatcaccttaagacaatgataattggagattttcttaccagccatgatagagcctggaaggcaatggaataatctgttgagaattctgagggagatgactgtcaccctagttaacctgtctttccagaacaagggtaaaacaaaatgaatgtgtaagcatctccttgaagattagggaaagaagatcctgggaagtttctagcaagcagagactggtaaatgagaatcgacagtacaggacccattccagctattttcttaggtgtaatacactgatactatccttatgtaatgtgttgtgtgtatgtgtaagaaaataaaatccaaaaagataacagtattaggggttttttttgttttttttttttgtttttttgtgatggagtcttgctctgtcacccacgctggagtgcagtggcgcaatcttggctcacttcaagctctgcctcccgggttcatgccattctcccgcctcagcctcccgagtagctgggactacaggcgtccgccaccacgcccggctaattttttgtattttcagtagagatggggtttcactgtgttagccaggttggtctccatctcctgacctggtggtccgcccacctcggcctcccagagtgctggaattacaggtgtgagccaccgtgcccggccaacagtattaggtttattgacacgtgacctctgctctaaaaccagttttccaagtaagttccataattctctggctgtgtagcttcctgcggcagaggttttctggaaccagctttgttaactgaagaagtactgaggctcttagctgcgtcttcctgggccttggtatactcttctatatagtggggatttgacttctccaagctgttgtgagagctatgagataacgtgtgcctttccctttcctgtctgttttttacttttaagttacttggaatcgggcctccatattatttgcagggtgataagccaatttaaagggaatctctgttcgtgcccttagttagtgtttgctgtccagcattccagcatggtgcatatggagttcgtgtttcccttcaagaggccttttgtaagatcttgcctcgtgaattacagcaagcatcttgtctcctttttcctttgggtttcctcttctagcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcaggtaggtataaagattccaagtttggtgtgtttatgatattgttttaaagccaaggaactggctgggcacagtggctcaccagtgcttggggagactgaggcaagagaattgcttaagaccaggagttccagaccagcctgggcaatgtagtgaggccccatctctatgaaagaattaaacattagccaggtgtggtggcatgcatctgtagtcccagctacttgggaggctgaggcaggaggattgcgtgggtccaggagttcaaggctgcagtgagttacgatcatcccattgtactccaaccttggtgagggcaaagccctgtctctccatgaatgaatgaatgaatcttagttgaggaagcataatctacaataggaagataaacacattcaggtaactagttcatagtttctcccagtaagagaggtaactggtacatttatcctgctgtggctaatttagggggtgctgggagtgggaatggaggaggaaatgaattgccttcaggcattgctgtcataattgaaagaataagcagttaaaaagggggtgggaggcagcttttctagagctctgctatagtattagctcctgagaatggagatgggacatgattgaagggttgccttggtatgtggtgtacttggaggattcctctatcagtgacaaacccctacgcgcaagtttattgaggtaacttaaaattccataggacgaagcagcaaaacataatttaattaaactaaaacctccaattctttttcttctttcagttgttttatgtatttcagtgggcttttctttgagtttaagtataatacaaaattttggatgtttttaattgagatttgtactcaacacaattcctttctgtagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacaggtaagcagttttgtttgtcatccagggcaaaaagagcaaaattgcccactggcactttgagctttcatttgtcagagcttggttacttaggacaagaaacaaatacctccatgaataccattgcatggattattgtgtcctacagctattctatagtaaaccatcaaagttctgtttaacactgcaacatctgaaatgaattttactgatttattcaaaatgatgtgtgatttaaagcactgtgcattagccactgattctttttttttttggagactgagtctcactcttgtcgcccaggctgaagtgcagtggtgtgatctcagctcactgcaacctccacctcccaggtttaagcaattcccctgcatcagcctcctgagtagctgggattacaggcatccgccaccatgcctgcatgcctgactaatttttgtatttttagtagagacggggtttcaccgtgttggccaggctgatctccaactcctgacctcaggtgatctgcccgccttggcctcccagagtgctgggattacaggagtaagccaccgtgcccagccggccactcattctttagaaagtcagagtcaaggccaggctcagtggctcacacctgtaatcccagcactttaggaggccaaggcaggagaatcatgaggtcaggagtccattgcaaacagccctggcgacagtgcgagactgtgtctcaccaaaaaaaaaaaaaaaaaaaaaaaagtcagagtcaaatgagcgaaatcagattcaaatctaattaaatggagtactatagtccttttagatatttgcatcttaatttaggacagtactttttttactttttattttgaaataattgtagacttaaccaaaaagttgcaaaatggtagaatttatgtgtatccttaacccagtttccccgatgatacaacttacataactcatagtacatctagaactagaaataccatttgacccagccatcccattactgggtatatacccaaaggattataaatcatgctgctataaagacacatgcacacgtatgtttatagcggcactattcacaatagcaaagacttggaaccaacctaaatgtccaacaacgatagactggattaagaaaatgtggcacatacacaccatggaatactctgcagccataaaaaatgatgagttcatgtcctttgtagggacttggatgaaactggaaaccatcattctcagcaaaatatcgcaaggacaaaaaaccaaacaccgcatgttctcactcataggtgggaattgaacaatgagaacacatggacacaggaaggggaacgtcacacaccggggactgttgtggggtgggggcctgggggagggatagcattaggagatatacctaatgctaaatgacgagttaatgggtacaacacatcaacatggcacacgtacacatacgtaacaaacctgcacgttgtgcacatgcaccctaaaacttaaagtataataataattaaaaaaaaaactcatagtacaatgatcaaaaccacgaccatgccattattattacattattattagctaaaccagagatcttaatcagatttcaccagctttttctctaatgcccttccctgtttcaaggtcccatattacatttttgtgttttatgagtcccctctaatctgtgacagaaagttcctcagtctttccttttctggccttaacactcttgatgatactggtcaggtattttgtagcatgtccttccatttggctttatctggtattttctcatgatgagattgaaataaggtgttttgacaagtacatcacagaagtcatgttatgtctttctcggtgcatcatgtcagggatccctgatgttgatgcgtctctttcctggtgatgttaaccttgatcacttgctcaaggtgatgtctgctggctatctccactgtgaagttactgcttttcccttcgtaattgataaatatcttgggggaagatgctttgagactatactaatattttgttcctcctgaaactcaaccactgattttagcattcattgttgggtcttgtctgcaacagttataactaaggtgtttgcctgatagtgatttttttctctttccctctcttcctctgcatttactaactggacttctgtacagaaagctatcccttctccctcatttatttactcagttatttacatcatggacttttaattctgtgggttgtatccaacactgtcatttatcttgttactcaaagttttccactttgggccattgggagtgccttctggctggcttctgtgttcttacatacacctcccatccccagctttatcttacatattccctgtccctgccctgcaaggagctctggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcctcagcctcccaaggcacgtgccaccacacccagctaacctttttgtatttttagtagagacagggtttcaccatgttggccaggttggtctcgatctcttgacctcgtgatcccgcccaccttggcctcccaaagtgctgggtttacaggcgtgagccaccgcgcccagcccagtagtgtgtttttaaaggacctaaaagttttaaataaaatgagggccacaaggtgaaattatcctttattaattgttctcttaacatcttcttaaattttctcctgagactggtgagcagagggacccagagcaaggggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggtaggcatatttgtccatgaataaaagggttcagatgatgctgtctgtcatgagagcattcgtttcctcagtggggttgcagcagtgggtgaggtggtgtgccagtgccgaggacacggctgcgaccaaggcagacatggtccttgcctttgtggccctaccatctagtcagggtggcacagcagaaccaagtaattaatcatagctggggaggcgcgaaagcagcaggacaagagtgggaatagcagggcagggttgaacctcacccttcagaggctcctgtgtcggcatctcctctgtggggtgggaatagcgctcattgagggcagccaacaaaggtggctttgctgagcagataggtagctgagggcaggggtctcatatgtgtccccaggtgggcttgattcctgccatgagatagcaactaatgctttccctgttccgactttcaggaacggcttggctcttaacctccaccttcccttcctctcccgttcttccaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggtaacctgctgtttgaagaaataagtcactctagatgaccttgtggtttgctggcttttacatgttgactactgctagatggggatttggggctgaatgtcatggtatatcttgaaaatcttagcgtataatggcaaagctgcctttaagttaggtttcaagaaagtgaatgatgttgaacttaatggaatatttattgttgctcacttttgtatttacttcagatagtagaccttgcctttttcttgaaattgagatgagcagagaaagaagacttcagtggcgtttctctattgaggcaggatatatttattaggaagtcaccttaggaatttgtgaaatgttttctgttggtaactgaaagtaatatgcaaggacccagaggcatgaagcccttactgctgtcctgggggctgaggaaggagctgccagattaccatccctgatccaacctgtaggaatgaacttatcactcactgcctgaacatgggcacccagcctgtttttggtgagaggcgcatttggggcaagatccatcccattgctcctagaaaggcatgtaaaccttcccattgtccctgtcacacttgccttggagaactgtacctgtgcataaactgtaccggcttcttttttaatgaatgtataatcacatggtttttcctttaaacattgctcatgtctacaagaaagtctgcaatcttgaaaagcattaaaatggtcccaagacttgaatcttttctctacccagtgactgtctgttgctttttccagcttgttgctgaaggtgaacagcatagtcatttacctccaagatcatcttctctgttaggaaataaggggacatatataaatggctgtagtgcagagcaaggcaggaggttatgtgttactattgagaggagggtcagggagaccaggagtccccctccactctcccctctggcctgctggccaccactggagaacggtggaggggagatggttgtgtgtcctatgttgatagctgttctggtcatggtgttccccctacccctcgccgcctctgtggacgcctctaactagtttgctgttagagtgggcctgtggcctgaccagttttcttactgtattgcatcttaattctctccctcatcttaggaagtattttccccaaatactctttgtcttctgaccctcagggcaatgctgattaatcaagatctgagagaaatgtgacgtgtttctgggtttgcttatttttaaaatcttctttcaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacggtaagtggcaagagacaatcattggtagacaccattcttgggtctgacttagggtacatgggcaaaagcttgttttatgagcataacccagaggtgagcaaacaacaagaccttgccctgtgaagtttacatcatcttttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgtgccaccacgcccagctaatttttgtattttcagtagagatggggtttcgccatgttggccaggctggtctcaatctcctgacctcaggcgatccgcccacctcggcctcccaaagtgctgggattacaggcgtgagcttccatgcccagctggaagcttacatcttaatggagggagacggttgatgaacacataacatatgctatcgtgccagctagagattagtgctatgaggagaaaaataaggctggacagagtggggggtgcattgcttaagcgtggagatgtgcacaaagggagaggaaaggacagctgggcacatcacagggatgagagttcccggcagaaccagcagcaagtgcagagccctggcaggaagctctcgtggtgtgtgattgaggagtgcagctgcctctcaccctttacctcgtgcctgggtcgctaacacagtgtcatgtatcacaccccccacaagatttaaagatagaagagcctttggtgccttttgttctgtctcagatatatagcccagtcccctgtagtgccccagctatttgggaggcagcctccctctgaggagttgaggcagtataggtctgcagctccgcagctttagattggagggccctgcagctgcttcccttaggaggcatgtctagctgggcagggtgcgtttataattgggaatagtcaccccaggaagcggtgctttggtgacctgtaggggaatcttaaggcttctcccagtaggggaagagtagcatgatgccggatgggcctactctccctgaatgctagggacctggcctagggacatttgttcagccagttgagcaaccacagtggctatttcttcagcatgggaacagagaaattattcctttttgcctttaaggacactgctcagccgactacttctcaagagctaaggactctcacttctggttctaaagaactttgaccttgagttctgtttgtttgttactggagtaagactttttatgcagttgggctatatttactctgtttcaagaatatcacccctaaaaacatgagttatactcatgaaaacacaatagcttatgctccataccctaaaccggcattctccacagggtagacggtgcagacgagccatgggtaatttgaagaaacaaaaaacatttaatgttacataatttttataattggacaaccatttaatgttacataaattttatagtttactctctgtggcacaagataaaagtcaacaaaaatgatgggggacagaggtgcgtgagccttgtgtttcctcaaagcggacgtggttcccaccagtgtggaagcggtacagggagtggcaggctcctggtggcagggacctgaattggtttgtagttatgcttgtgcgcgtcctcataaccccagtctcgccctagcgctgtcccctttcctctccctccagcttttcctggactttttcacctgagggtcctgcagtaatggcaggtggcctgcccagaaccatgcccttacctgcttcttctccccattttgtttaaaggcagtgacagctaccagttactcaggcttgaggctttatccctgaattctgcctcgccctcgccttcctcatggggttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagctgatggtctgtccgaaaatgctggttcactctccactggccaactgtctgtctgcactgcactgccagttgcctcttgcctgggccattgcgctaacatctccacttactgttccacctgcttcctgtttctttgccgtttccagaccttccactttgccacgcaagctatctttgtaaaacagctcatgacatttctttcccggaaatctctaattgttccccagtgcctccagaataaaaatccaaactacttaactggcactgagtccttttattttgcatttgtctgtccattactcttcccagactggccccctccttcaggagcccccttggtgggcaccccatgctctaggacaggacatcttttctttgaattattattattttttttttagagatgggatcttgctatgttgtccaggctggactcaaactcctgggttatagccatccttctgcctcagcttcctgagtacttgagattaggcgtgccaccatacccggcatacaggacttgccaaaccaccatcttgctctcattccctctcactgttctctctccctccctttttcctcccacagttgtaattgtgtgagacacccttttgtcctccctctttggtgaaatccccctcatcctcggagctctgggtctgtacagtctcttcctcttggctataattttgccttttagtgtttgctccctcctctgtgcctgcgtagcgccatgcaccatgtgccattgatggcactgggctgtatttgcctgcctcttgcccagtgattctgagctcccaaaggtgagtgctgagctgtattactcaactgagaaacctcagggcccatgttgtccttagaatacagccagcctcatcaaatgttcactgtgtaaatgtttaggtccctgatgtcttgaggcccttctaactgggaggtgttttctaaactttttggcagggctcctgcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcattagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttccccagaataatgcaattgcaaacctctgcattgttgttcagcttgaaggtcatgggcctccgaagttcatttatagaccctctagggagctcatggacctcaggtaagagcctctgtgatagagaaaagatagtatgtgaggtatgtggaaaaagaaacaaagttgatggattttttttcttctaagccagtcagttgagtatttggacactcttacagtgtgaagagcagctggtttgctctttcctggttcctgtagcactttagaaccaattgtacttgacaaaatgaggtgattattcatgtgacacctttggcatcttaagccaaattacaggctcaacaggttttgcccaaccagttaagaatccagataggttttcttctcctcacttggtggcaggggagaagttgcaatctgtatttaaaatttactgtgcatcagagaggaaaatgccatttctaattgttggagaagggatggtgtcagcaactgactagccataggggaaacaattgactttgatctctgacttgttcatttcaccaaaataaattccagatggataaaagattgaaatgtaagaactgggccaggcgtggtggctcacgcctgtaatcccagcactttcggaggccgaggcgggtggatcacaaggtcaggagatcgagaccatcctggctaacacagtgaaaccctatctctactaaaaatattctttaaaaaattagctgggtgtggtggcaggtgcctgtggtcccagctactcgggaggctgaggcaggagagtggtgtgaacccgggaggcagagcttgcagtgagccaagatcaagtcactgcactccagcctgggcgacagagtgagactccatctcaaaaaaaaaaaaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggaggcagaggcgagcacatcacttgagctaggagtttgagaccagcctgagcaacatggagaaaccccgtctctgcaaaaaatacaaaaattagctgggcatggtggtgcatgcttgtagtcccagctactcgggaggctgaggtgggaggatcacttgagcccaggaggttgaggctgcagtaagcgagattgcaccacattccagcctgggtgacagagcgagaccttgccagaaaaaaaaaaaaactggacaaaaatattagtatgcatggcagtcagcattttcttaataaataaagatctcatctcagcctggccaaaatgtgaaaccctgtctctactgaaaatacaaaaaaaattagccacacgtggtggtgtgtgcctgtagtcccagctactcgggagactgaggcaggagaatcacttgaatcctggaggtggagtttgcagtgagccaagatcattccattgcactccagcctgggcgacaagagcaagactccgtcttaaaaaaaaaaaaaaaaagttgtgaaaaaaagatcaacaacctgaaagaaaagtgggtgaggtcatgtgaaagataacaaaagaagaaatacaaaaaaaaaaggtttttattttatttttcagagacagagtcttgctctgttgtccaggctggagtgcggtggtgtgatctcggctcactgcaacccctgcctcccaggttcgagcaattcttctgcctccacctcctgagtagctgggattacaggcatgtatcaccaggcccagctaatttcttgtatttttagtagagacacggttttgccttgttgcccagactggtcttgaactcctgacctaaggtgatccacccaccttggcctcccaaagtgctgggatcataggcatgagccaccacgcccagcctcagtaaatattttcttgactaaagtaatgaaaagggaggccaaggcaggaggattgcttgagcctgagaagtcaaggcttcagtaaaccatgattgtgccactgcactccagccagggcaacagagtgagatcctgtctctaaaaaagaagaaaaaaaggaatgaaaaatagttaagcttctttggaaggcagtttgggagaatttatcaaaattggaaatatacatagtttttgattcattgattatgctttaagaattgattctagccaggtgcagtggctcatgcctataatcccagcactttgggagggcaaagcaggaggattgcttgagcccagtagttcaagtccagcctgggcaacatgacaaaatcccatctctacataaatacaaaaattagccagcaatggtggtgcacacctttagtcccagctactgggaggctgaggcaggaggattaattgagttcgggtggtcaaggccacaaaaagccgcgattgcaccactgtacttcagcctgggcaacagaacaagacactgtccccctgtcaggcccccaccccaaaaaaagaaaaaagatttatttctacaagtatgtgttttacacattaaaatatttataggctatttatagtaactttgtaatagaaaaaattgcaaaactactcatcagttgggggggattggctaaagtataccagaaaatactgtaggaaaagaataaggaaactctttatggagcagtctccaagatacaaaattttaaaatgtaatgtgcagaatagtattttactgtttgtgtggttaagagggaaaggggaagaatctgtgtgtttgcttgtgtgtgtgtggagtggctctggaaagattcgcagatggtcacagtatggggaggagaactaagacaatgaaacagatgttggagaaggagagaattttcgataaacacttttctgttctgtttgaaattgttaacatgcatgtactgtatcctttaaaaaaaaaaaaaaaaagagttactcttcctgaatgataaccatgcctacctcagataaaaaatcctttttattcattaactgaagtacataaagactatttcagcaaactcttgtttaattcttagagcccagagatacagtccatagctccagtgagaaatctgtgttgtgatttttcccctggtatgtgtctaattttctgcatgcttgtaatctgctttttgatgtcacatttttcctttctagatcaaaactacaataacgccactgcccttgtgattaccttccctgtcaataattactataatgatacagagaagctccagagggcccaggcctgggaaaaagagtgagtcactcatgggtgtgagcagactgtccttgcattgtgggaagctagacacttgcggcaagcacttaaacttcattttctaaattaaccaatggcagatctgagttacgtagttttgttcacttggtactaatgatgctaagaagaaactgtaaacacatttacctttgagcaggtgctttaaacagctctccctccacaggaatgcaaaagtgtgcaaaaaaaggttccttgcattgtttttacttatttcatttattttttgagactgggttcacttttgcccaggctggggtgcagtgactgaatctcagctcactgcagcctcaacctcctaggctcaagtgatcctcccacctcagcctcctgagtagctgagactacacgtgcatgccatcacacccagctaatttttgtatttgtttgtagaaacagggttttgccatggtgcccaggctggtcttgacctactaacctcaggtgattcaccctcctcggcctcccaaagtgccgggattacaggtgtgagccactgcacccagccacctgcattgttttctaacagcaaaacttgggagcatgctgaatgtatttaataaggaatgaatacaatagaatattgtgctgtcataaaagacagtgaagtaaatggtccatgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctctaaaaaaaagaaaaaagagaatttaaaaagaaaaaaaagcgtacaattcagtagctttactatattcacgtgtatgtgcagccatcaccacagtcaattttaggaacattttcattactccacaataaaactctgtaccctttaactaacaccctccatcttttcatcctcctatccacagccctaggcaaccactaaaatactgtctctggagattttcctattctggacttttatgtgcatagaataatatgtggacttttttgtctggctatcattgaacataatattctcaaggttcattcatgttgtggcatgtatcagtactccattccttttcattccattgtatggatataccacattgtgtgcatttatcaactgacaaacacttgggctgtttccattttggctattatgaataatgctgctatgaacacttgagtacaagttcttgtggatgtgagttttcatttcttttgggtacatacctagtagtagaattgctgagtcatagggtaagtccaccttgaatagtttgaagaactgccagactgttttccaaagtggctatagcgctttacgtcaccaccagcagtccatgaaacttccaattcgttcgcatcctcgtcagcactttttattatctgactttgtgattctagctatcttcatgggtgtgaagtggtatctcattgtggttttgatttagtagactgaatgcatttcctttttttttttttttttttttttttttgagacagagtcttgctgtgtcatccaggctggagtgcagtggcatgatctcagctcgctgcagcctctgccttccaggttcaagtgattctcgtgcctcagcctcccaagtagctgggattacaggcacctgccaccacgcctggctaatttttgtatttttagtagagacgggctttcaccatgttggccaggctagtctcgaactcttgacctcaggtgatctgccagcctcagcctcccaaagtgctggaattacaggcataagccactgagcccagccctaaacttactttaattcagcatgtatggaaccttagctgtaatctgatagtctccagtgtggaagaccctaatgcagtggctgggcatggtgcctgtcatcccagcacttagggatgtggaggcaggaggaatgccttgaggccaggagtttgagaccagcttgcacaacatggcaaagaccccatctctacaaaaaatttttaaaattagccaggcatggggatacgtctctgtagtaccagctactcaagaggctaaggcaggaggatcccttaagctgaggagttcgaggctgcagtgagctgtaatagtgccactgtactccagccgaggcaacagagagagactctatttcaaaacaggaacaaaagcaaacaaaggatcctaatgcaggataaaggttaagaaaacatggcctttgagccgggcacagtggctcacgcctgtaatcccagcgctttggggaggctgaggcaggtggatcacttgaggtcaggagtttgagactagcctggccaacatggtgaaaccctgtctctactaaaaataccaaaattagccgggcctggtggcgcacgcctggagtcccagctactcaggaggctggggcaggagaagcactcaaacccgggaggtggagcttggagtgagctgagattgcgccattgcacttcagcctgggcgacagagcgagaatcagtctcaaaaccaaaaaaaagaaaacgtggcctttgtatcgtgaaagttagggagaagtttcttacttagctgtcagttagtttaactaaaaatataacattttgcttaccttttaggtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtaagccggggggggggtggtgtatgttctagaggttaacagcagtgcacagtgtaacgtcatatttttgcctctttattcttattccattatgtttaaaactgccataaattcccccatgttttaattgtatgtaacgtttctgttgcctacatctattttcttcattccaactttttggtttatcttaaagtttatttcacataatccagttttttcttatttgtccagtccatcacctaagaatgcaaactcataacatgtgttgcccgagcagacctagaaatgtttacaagtcctctctgaaacacagaattgtacattcaactctaggtttaatacagccctgtaaagtaaaaaggaggaccttttagtaacaagtgggacagacaaccctgtaactaattggtgattgtgtctgtcgcctctctcaggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccaggtatacttccatattctcacagggctcagcatctgttcaagtttcagggactgtgaatggctcctgggctccgcattcgtgagtgtgacctgtgagggtgttttgtttcctttccctgtgtggctcatcggtcgtcttgacttgctgtggacatcttaggaccaagaatttcacccctctttttggttgttgaaatagtagatataaagtaagaattgtgttttaaattgtatctttaaatagtgtcttttaatagtatcttttcattttaaatagtatcatgtgtacaagaagggctaacacacttttggaaaagattttgggtacgactgctgttaaaatgatgttcagcatagtatagaatgttagattcattttgcccaaaggtgccactaaaaaggcaaaaggtcaacacgtgtcccgctgctgtagaaggtggtctcagtcgtcctgtagacccgacgtgggcggagactcagtgcacgtgagagtgatgttcactggtccagtcccctgccgcctgtgttccgagtgttttcctgataatgtggctggctcagctttccctttagtttctcacttggtacctagctctgtagtgcagaaatactctgagaacattggagtcccccaccgaagtttatatgcttagaagacactgctaatcgtctactaatcatttatttttacccttgagttaacacaaggcagcaagaaatggcgttgttattgagaaattttaatgtcgcataatttttttttttttttttaagagagatgaacgtcttcaaggggaaaccctggatcagcagctgggcagggtcctaggagaagtggctcccagtatgttcctgtcatccttttctgagactgtagcatttttcttaggtaattatgctttcaatcctaccagtcctgtagtctgctgagcctggagaaagaaggagctggctacctgaacatgtccctttgtgttgcttcctttttttttttttcttttttttttttttctctgagacggagtctcactctgccacccaggctggagtgcagtggtgcaatctcggctcactgcagcctccgcctcccgggttcaagcgattttcctgcctcagcctcccaaatagctgggattaaaggcacgtaccaccatgcccagttaattttttgcatttttaatagagatggggtttcaccatgttggccaggctggtctcgaactcctgacctcaggtgatgtacctgcctcggcctcccaaagtgctgagattacaggcgtgagcccccgtgcccagcccgtgttgtctcctttttttaagctttgttctgcactgggaaagtatcactggaccacagaaaaattggcagcagtaacttaggtgtgattttgcaagtggcttccttctcatttaactgtcaggacagcattgatgttggggttcagggtgaaagagacctagagttcgtcttgccactttccccttttagtagccactgggaatgttgatagttgaaaatggcatccttgagtagccactgaatccttctccacatgacactctaagcagcagctcccaaatccacaggcactcgcttacaagatgtttgccgttgttttcaaaggcagtctttctcttctgtgcacacaactcattggggaagcagccttgttaatgaccagaagctcttgactcaccacattacaaggagccagaataagctggaacaaagtcagcacttctgtgtttctttcacatagagaatcatcaaatagacccactagtggggctgtctgccccatgtctgaagtgtagtaagagcaaagtgactctgtccactataggggaggctggactggaatcactcagtccaaagaagaccatccacgggccacaaactgcaatgcctacatggctgggaggtcagcttaatcagggccattgtaaggtcattgtaggtggtagtctttcaccacagatacactgctagcttgttattcttcatctccacaaagccatgtgcttttgaaacctgtagccctgtagttccttttgacaaacacaggtgcagaaaaaaaaaaaaaaaagaaaaaactttctttttttcactactattataagaaaaccagtgcaagtgtgatgataatagcagcagagactgtgcctcaaggttggagtgaccttgggacagtaggagtgagtagggattgtggcaccccaactgcacgtgtcctatctaaaaagacagttatgtgtgtggccaacccagtgctacaaggtctgtgttgttgttgttgtttttcttccaagcaaagctgtgaatctagatttttgtgtaaaatgccattgttaaatattggcaacttataaaaaaaagttttttaatcttaagatgggttgatacagtgtgggctaaacaggaaccatctgattcatgggctgccagtttgcagtttccaagtcttaccctcatgcctttgatcctcactcgattgtagattacctcttaactaaactgggaggctagtagtgttgatgtaataaatggaaaatactgtccatttcttacagtgaagcacagaaagtactataagaaatggcctgtattagtggttctcaaattttaatgtgtgtgaatttgctgtgaacctgagtatagtagaattggggttgaattcctgtcataactaggatggggcttcccaaatggtctggtgctgagtgtgctttgaaaagcactggcttatcacctcctgtcccacttctggtgtaatgtccagccgcagcatgccttctcatgcgtttggcctgtgctggctccttgtatctgtacatgcacatgaacataagacctgcagagagcccccggctgtaaacagaagtgacgcagagcccttctctccccgacaggagcattgtccgtgatgccagccgtgcacaccttctctctctttgcgggattggcagtcttcattgactttcttctgcagattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtggtatgcgcttatctgtggtttttctctttcctctcactgaaacagattatcacatgccttctaagaagccagacagcctgggaaggagattcttaaagctgttaaaatgtatctaaaaaaaaagcaaaagcaaatgtggaacagtagataaaatgtttttcccgtgagcttttatcagtccatataaacaagagttttaagttttttattttgaaatagtttcagattcacagaaagttgcaaagaaacttttatttttcctcttaataatgaggaaatagaagccaagagaggtgaagtggtttgccccaagtcactcagcccgtaagtggcagagtcaggatttgcacccaggaatttggactcctggtgctgtggtctcacccactgccctgtactccctattagcctgtcatttaagcttttccattttaaaaaatcctgctttttgtgtgtgcttaagattttatttctggtcgtaagcttatttactaagcagtctctgtcttatgattcatttgttgttccagatagcaatatttgtgggtgttctgtcattcagcatcgcagtcctgaacaaagtagatattggattggatcagtctctttcgatgccagatgtaagatgacttccttttttttttttttttaacttctttagctgatgatgaatacatttttcaaaacatgcacgtaggtgtttcaagcaagtgcctgcttctaactgcaaatggtgacagggtttccagggttaggagaactgtcgcagtgcactgctggtgtgggctgtctggcattctgactgagcccctctgggcacagctgcagaacacgaataactagtcttatgaggttactttatgagatgctctcctgattgtggggctagcaggaggagcaccctggggccctggggggaagactggtggtgttaggaatcatgagtccagctggaggcatctcagccaggaacctcctggcaccctcttattctccatgatcctcgccttgcttagttactatcagagtgttcacactctctcctattcttttatctttctttcaggactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactagtcagtaccaccttgtcttgtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccgaataggcttcgccccctcgtcctggatcgacgattatttcgactgggtgaagccacagtcgtcttgctgtcgagtggacaatatcactgaccagttctgcaatgcttcaggtaccttctcctttaccaaatctttcctgttttgctgaaaaattttcaaattatcatttaaaaatcatttgcatcgtgcctcagtttatacctatttgtatatcaaagctgggtctccctgtgtcatcattcctttcctcagtcattcattctgaaattgtcatgttgttcctggctcagacagccaccctcggggctgcaagctgaacaaggtccacatgttcggagtgtggtttccacataaggtttctcatcctgttctaactccagcgattgcctctcaggattggtatctggccttagcttctcagaggagggcttttctttatcactttaccctgtggttttgtaggagcgtcgaggttgccctggaattttcttaataaaaacatagaagccccgggctctgaccagtcaaggccatacttgaaggaggagatctacttcagggcagaaaatgatgcatagtatgcctaagatgaaaatggtatttcagattcattaaactgtgaaagtgacatgtggctgaagcttttagataaggggaaagattatccctcactagtaaggaaagtaatcgatagagaagaaagtaatgcccctcactgtcagtattttaaaatgttttacaaaaaatctggagacctattcttctaacagtcctccctgcatgtctccgccagtggttgaccctgcctgcgttcgctgcaggcctctgactccggaaggcaaacagaggcctcaggggggagacttcatgagattcctgcccatgttcctttcggataaccctaaccccaagtgtggcaaagggtaagtgctgctgccattgcagataagcatccactgcaactttaatttgcagtagaaaactaggagaggactgggctaagacagttgcatgggaacgtctcttctccgccccaccctgtcctggtcctttggtggaagcaggaaaaccgaaaacacctttttaagaaaatgcctcatagtgttcaactgattctgtcttagcgtgggcattcacatctcatgctctctctgtgtcctggccccctgggcatgagaatgaacgcagattcctgtgcacattccaagcggggctgagggagaggacggcctgctggtaatccaggcctgaaggaacttggcctgttcacttgtactgatggcagctggggcgtgatcttagctttagtaacattatcccacattaaggttgcgattcttttagcctcgtcatgctccttgccagcccatccatgtatagggttatgggctatctcactcccccatccagccaggcagccagttacccacggaagccagatatatggcccaaaaatagtgatgatgaccggaagtctctggccttgatttggaagctttgggaggtggaagatgagtatccccatgtatgttaggtaaaccctgaacttaggtttttcataagaacatacatctgaccagagtcatatcagtgaatcatttatatcatgcatgtgctttgagacctattcgaggtatcatgggatgactcctcctaaaagttaagtagaaatgaatcttgcagcttgatttactcactgactggatgctttggcctacgtaaaataagttgaagtagattcagtttttctgaaggcagtagccaccgttcctggggagcctccagggtgccagcgtcatgccaggcactccctgacattattccatttctcatcacgcagcctatgagtaggtggtggtatacccatttacagaagaggagactggggctcagaggtggtcattttgctcggggttacatgaccagtaagtggcagggctgaggttgttcccagggcccttgccctttcctgcttcctattacacaacaggactgagtaaaccctgtacctttgattatacatgaaaccaggtggagaaacagcagctatgtaccaaagaacccagagcaatcgagaaaagcccatctggccaggcgaagtggctcacacctgtaatcccagtacttttggaggccgaggtgggcggatcacctgagatcacctcaggagttcaagactagccaggccaacatggcaaaaccctgtctctactaaaaaaatacaaaagttagttgagcgtggtggcaggtgcctgtaatcccagctattcgggaggctgaggcagggagaattgcttgaacccgggaggtggaggttgcagtgagccgagatcacgccactgcactccagcctgggctacagagcaagactctgtctcaaaataaaaaaaaaaagaagccagtctgggagagaacaagctaaacctttggcgttcccttatctgggggccttcttcatccctgaaatgtacagctgggtctgacctctgagtccagggtcaggtgattttgcttagcctcaagtgctcagattctgctgatattttgcaagacctggactctcttgacacccaggattctttcctcaggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacaggtaaagcctgccctttttcaatggggtttacccagcaaagggcctacactgggtgggagtggggagggttcccttggcaagatgctgattttcaggttgggttctggcccctgctccattctgagcacagggcagtatatcaaaggaaatgggtgctgggcaaaggagttcagaatctaaagtctctgtgaaggcctgagggctagagacgcaaaacttgatctctgcgccactgcacagctgcaagagacacacactggaaaatggcttaaggcagggggcgcttggagagcaggcggctcagagcagggcccggcccacattcttggccaacaatgaaccagaatccctaactgctggttatttgggatgctgcctgtatgtagactttttatattgttaggggttttttttcccaggaagaaaagtattatgtatgaactactgaatttagaaactgtagaaaggtaggagaaacaagtgatttatttttcctgcctccccatgatctcgcttaaagcaggaaggcctggatttgtttggaagaagttaagagccggttagctctggcagaaaataaatgaaagcatgttttcctcaggccttgcacggaccccgctgagcctgaggtagtgtctcaggatagatcaggattctttgtttttttgtgttttttcagaatgctgtggaatgctctctgtaaatgtctataaaatagcatagattgggcttataaacagaaactttatcaaaaatatacattttgcatcactgctgggcccttctctgggtggtcagtggccatgagaggtcaagtgagttgctttcggtgagtcttgtagacagccagcaaggttttctgcaagggatgtttcccaaaggagtctgaccacttggcagtggtgacaggatgaacacgcagtgttcgggagtgagagcgagctttaatgaggcctcccctctcccctccagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatggtgagtcctcatacagtctcagtttgtccctagctcctgtttcacttgggggaattggctgtcttagattccatgtaaaccctaaagatggagtaagataccaagtctggcgcttgctcttggcacacatggagaggcaggatgagtgctggaggagtgctggatggtggtgggacagggcatagagggagcgagcattgagttggacatctgggagcataggcacattacaggcaatttctgttcaattttttctcttgtcccattccttgcggctatactagtatacctgatggtgcctctgaccatggaaatgtgatttcctggcctagttctgggctagtctgcctgtaatttgttattctttagagattgcacaagcctgtagcctgatgacagcaggatgttcactttttacttagaaaattgcaccccgccccaggagctctccgaccagtgccttttgcctcctatgtggttatcaggtacttttaatcattaaagatgagagcactcgagaaggtattcatggaaaatagaacagtgtatccgtactctcagatatgagccctgcttcagataggggagcactgaggtccaagaaaagaagttgtgacaatgcgccagctcggtgcgggtggggtgaccttaacgggttccagcaatttctcctggtcaacacaaacgtgccacagaaaaccaggcttttggctgtgtgtagagagggccccaaaaagttcctggtacagtaagattggtgtgatggaggccttgtaagtccaatgggatgcttggcctcctctagcacccagggtgccctgggtaattagcacccatcctcagaacggggtggctgcctagggtcttcaacaggaagagagccatcctaaaggaagtgctttatttcagagctgtggcatctccgtggagttctgcagccacataaccagagcgttcacggtgagcatgaaaggcagccgcgtggagcgcgcggaagaggcacttgcccacatgggcagctccgtgagtaccctgagcagggccacgccggcagagtcgcaccacaaagtaatcctcctcagtgactgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcccatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatccttgtaaggaagtgtttttgttcaattacaggttggtaaaagtggtttctaacacagtatctcttcttttaggtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacataggtaagagttctcatcttaaaagggtggcacaatagaaggacattactgaaagggaattctatcctgaggcattcttttcaagtatttgaactcatactaatggtcatttgataatgataaatgatactgagtaaaaaaatttcttctaaaagaaaaaacccatccaggggattcatgatggtgcagactactttattaggaagttgtcgatgttttttctggaggcctgatctgtctgcttcacaaaggcctggagccagtccttgaatggatctgagtgtcagcaggcagggcagctcctccctgccactgagatgaaggagtccatctggcagccagctctcacaccagcagtgctgcagaacagctttttatgtccctcatggatttcccgtttcttagcaaagtgcttgctgcctttcttcatctcgagactgtccttgatccttttacttctatggccacttcaccttgcacaaaaatgacccacggttgaaagaacaatactgatttgcttcatttatagctttgtcactaaattgaagcactgaagtagaagattaagaaaatgaggggctttttatcatctccgggggatagaaagtagttctattacaatctaatatactagttccttttaagaaaaaaaaaaaaaaaaaagagatgagcactttggaaggctgagacaggagaatcgtttgagaccagcctaggcaacatagtgaggcctccatctctacaaaaataaaattagccaggtgaagtggtgtgcgtctgcagtcccacctacttgttaggctgaggcaggaagcttgcttgagcccagaagggtgggcttaggatgcagtgagtcgtgttcataccactgcactgcagcctgaggaagaaagcaaagagcccatctccaaaagagagggagagagatgtggtctcactctgttgtccaggctggtctcaagcaattctcctgcctcagtcttccaaagtgggattacaggcgtgagccactatgcccagccaactagctccctttctcctgcagaaataagaaaaagtctctctctctcatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattctatctaacctgtccttatggtaactaaatgccgtcttacattgagctagaaatagacctagaagtttcattagacagccctgatccttccctatcctaaagatgatgtcttaggttgtataactatttggagatgagaatgatcaaccagggccaggtgcggtggctcaaacctgtaatcccagcactttgggaggctgaggcaggcggatcatgaggtcaggagtttgagaccagcctggacaatatagtaaaaccccatctctactaaaaatacaaaaatcagccgggtgtggtggcacgcacctgtagtcccaactactcaggaggctgaggcagaagaatcgcttgaacccagcggaggttgcagtgaaccgagatcacaccactgcactccagcctgggcaacggagcgagactctgtctcaaaaaaaaaatgagaatgatcaaccaatgtatacttcataaaactgaaaccttaataagccccagaccctttaaaacccttagccaccatttgccgtcttattcctggctttaagagatattccaagatctgctataagagatgggctgtgcctgatctgggtcctaaatgtgtcttgactcaaaacacacctcctcggtgagttccagagcataattcagattctgtcagtatactgaattcactctactacaaataatgggccaagggctaggtgggctgttatcaaattgtgttgtttacaaaaatgctaacccagggtcctcgcccaccagctgccagtgccctctgctactctttgaggctatggttaccccaagtcttttcattgcattctcacctggtgtgaaattggggctccctcgcaaacgctggtttcgctgttcaaaaaagcggaatattgtatagaaaagcatgttgtcttcagtctgctttgcagcatctaaaaattttcgtgcagaaatgttgtcatggccaccaatgccccggataaaccttaaggcagctaacacttggtgtttggaaaggagaacttctactatttcatcatttgctgttgaaagtcgctagcagtaagggagagaagtccaggtcagtgcaaacaacaggaacagagttagtttccatagtctaaaacctcacacatcagagttaccttcagcatgtccagagatagctgatgagcaggaggatagaaactctctagggataacagcagacaagcctgaaagacatttttagacccacttcagttggaaagataacggttaaaattttccatttttaaccacaatggaagtaaaaatctggcaatgcataccaaaggtttggagtcgctgaggacgtggtactgcaggaactgatgcagcatataaaagaggttgtgctggacaagggttttgataacaagttcatgtaggtaatgctgaggacaaaagtaaaaagtgaaagaacacttccaaatcattcagctacaacagactagaggctccccaaggactggctattctaaccaacacagtaaaagtctgtcattacaagaagtggtttcgtcatgcaggtaaagaccccaacttgaccttacacttcccattccaactaataatgtcaggagtcactcagcattctgagtcagggaggcagacctgtcttagcatatgagtcatcttctaagacagtgactgtgttttttttttaaattccttctgttttaacttgggcccagatgatttgaaggtacctgtactgcaatctgaaactggttaagagaacgaatgtattccatcagcacggctatcacaaatttatgaggcatctcctagggagaaaaaaatgtggtcttacaaataccaacgaggtgcaaaagaggctgcatataactctctatccaacccccaccttgtttccatcttaaaatggcccagtgttcatctttcactggttttgcacacatc

SEQ ID NO: 16024 - DNA, 34745 bp, Human
cccgggtggactcgcccccactccggggacagggcttgcggctcagcccacgcccgcaggcagcgcggctctcattgtctgcctgggcggcgcgctcccctcccccctcgccgtcccctccccaccctcttttctctcctcccctcgatccctcctcctcctcttcacctccagcgcccagctgctcgctgagcgcagttccgacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggttcggctgcttcctcctcgcgcgatctccccgctttcctcccctccacccctactcgtcgcgggcccctggcctccggctctccggccctctccaggccgcggtcggctccgacggtgtttccctccttccctccgggcgggctgaggcggctcccaggctcccgggacaccgcggaccaacttctagtctctttttctctcctcgaagcgcttatctgcgcgcagccttatctccgagttatctcggcgcaaaggggcgggagccggtagttaggcaggcagagaaacttctttcttgctatctagccaggtctgtgtgtgggcattaattttagtgtggtaatctccgatgagccgaggcgatttggaagagcagcctggaggaggccagcccggctgcatttcacctccctcccccactcgctccgagtctccctgtcattcttcctgctctcccatttggggtcgcctcggctctggggcggtctcacgctcccccctccccagcccgttgcgttccccctccttttctctgctctccgctccaccccgctacgtccgattccggaacggtccggcgtttctgctgctggagatgaccgcggggtgggccgggtggcccggccggcgtgagcgcgcacgctggtggctgcaggcgcgggccgtgtctaaggtgtgcggcgccgcggggacgccggtggggctggcgattcccgccccacaagctctccgcattgcctctgctgggaaggacccagactgctgcccccgccctggcgtcccactttccctgggccgagttgcatttctctctggggctcgcgttcgggctggtcagcgcagtccgggaagctctgggagagccaatataggagaacgcggcggtttcgttttcggggacaggttgccttccttacgcgaagggttttcccgtggggaaccctcaccccgaggcatttcgggagaggggcatccgcagagaggcgggatgcggcggtgccgacacgcacagctacttaaattcttttgtgtgtcatcagcccgggggagacactttagggcggaaggaaagcctcagccagcttctgcagatcacccctgggatctggcgcgcgcacggagaaaggatgcggccgagggggtgggcggggaggacgcggggaccggagcggtgcctttgagggagggctggtatcccagcccttccagggccctgtggcggctgcgcaggctcccttcccctcccttattgatctccacgcccggggcagaaataggatctttgagaagtctcaaatgggatctttgagaagtcagatcccatttgaactagaaaaaggagtggaggcgaggtagcgtgcagcctacgctcttgttaacccgtcgatctcctaccatacccgtctcccccaccccacctcaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcaggtaagggtcgcgcctcaggttcggggtgcgggtccaaagcgctggggcgcacgggggacgtggagcagctgctccactcgggccctgttttcaggactttctcgtccgggtgcgcggaggtcggcctggtcccaggaaggatttgcaggcctgtggctgggtaacccagagtccggtagcgctgaggcgagttgtgccaagacttgagtctgttgtgccaagttcctttccacggatgagactaaatgcacatctgtaccttcgtgccttggggaagctcagggccttgatgagtagtgaatggcatctgctattggggaaaaacgaggctgggagggaactaacagcgcttgagccccatcgcagaccctactttgggtgagtggaagaaattccacgatgggagtaagtttgggagagtggcgggcacttgatccacccccaaacagacacacaagcacatgcaggctcacccagtttaactctccaaagggtgcgtgtttgtgttttcctagagaagggtatttagaagagcacaacagaagaacctagatgttcctagggaagctagttggcgtctcctctcccacaagggagagagggaaagaagagagggcacctggagtggtcagacttgtgacttcatggtgaaggagagctggtggataggcccttgggcttggcatcagctgggccttggtctggggctgctgctcacatggccaggctgcaactcagggatcctggagctggggcacctattctcccttcgaagtttagcccgccaatttttcagtttccaatttgactcattttttcctgtatctgggagccattagggggtaaaccgtgaaaacgctattgtcaaaaatacctggaaatacctcgttttgaaaagtgttttgtttactccagcacaggagtgtgggagccctgttaggctgtttttctcagatgcaacattctgcgtccttggtgctttcaactggcttatcttaccttatatttcacctgtttgataatctttctaaggaaacaacatctttttttattgtagtttgtttgaggggaggtgtgggggaggccccttgagtcacagaggtggcagagtggaggaaggcacattactccaaacagtcctaccccggtgtcttgtgtatcccaggtctgtgcttctcgtgggagcctcgacgctacctttaggacagcaagtcagtcctaggggccaggattccttaggataaaatgggacattcccaaccttgtccgcaaaagacacgctggaaatgcaagtggtctgaaagagagggaaccaatttgaacagctctctgatagcctgagttctttctgtcttcttccaagcgctgcaagacttggtctcaaaattccctctttttagttttgctctgtcgcccagtctggagtgcagtggctcactgtaatctctgtctcccgggttcaagcgattctcctgcctcagcctcccgtgtagctgggattacaggcgcgcgccgccacacctagctaatttttgtatttttagtagtttttgccacgttggtcaggctgtttttgaactcttgacttcaggcgatccattcgcctcagcctcccaaagtactgggattataggcgtgagccaccgcgcccagcgaaattccctctttttgcttctgctgcaaagctggccctggagaccatttttcccctgtgtgtggaatgggatcgggggaccctgttgagatttgcactgttggcttgggacttgagagtcagggctctcatccttacctctgcatagggacccgtgtttggctcccaggagcagagagatggagaggctgggaatctctaaggaggtaatggttgggtgtgaagcttattttgtcagtcggggagttccgtagggaatgtgcaagggtgttgtgagttgggtgaggggtagtatctgcagattgagccagcgcctgcagctctgcctatttcttgacacaccttagcctgatctccaggttcctttcctccaatcttccagcatttcatatggctgagagagtcttttgatgtttacagtaactggtcctgtatgagaaatccttttagaggcagtatggggcagttgtgggcaagttaatatgtttctttttgttttaaatttagcctacacttttcctaattttttcatcttctgggcacaccacagttagaggaattttctgtagacccagaagatttgttatttttttaagtatttttttaagtatgtttaaaaaaatgggaagggatttgggaacacccagcttttgcatagagtctgttaggaaatcaggaagtgactgggaccaagccagtattggggtgaagggtggggagcgagtgaccctaactttgcttgtcctcacaggtattctgaggccagcttcctagctagatttcctgtttcttagatttttttttttttttaaacaaaccgtttttggaggcagacactttaaacaccagagctaaaacctgagtgctgaacttgatcaacccgcacaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggcaccgcaaacagccatgttaggagagaaatggtgagttgaaaagggggaacttggtgagcaagcccccagcttttatatcttacagcttttataaagacagcatttttttttcctttttagtcacttacaggattatagctgcctggtgggtttgggaaagaggtagggagggaatgagagagattttattcaactaaaaataagcaagcttcctaggttgtatttatccaaagtggacttttaattaaattttgtctttgggttttcagatgactaaatagttctacctggggagttcacactgtcttctaataggattcttattgttcccagtcataggactgggttttccagggaatgccccactcctctatccagaggggctctgataggtaacattttaaagtcaacaacaaagacaaataccttgtttaacttcagtgtccttgaagacctgagcattttactgattaccgtagtcaatagtggcttttagggcggagaagaataaacctttgtgatgtgttgtaagttgcagtatccccatgacaactttgaactcgggttgtgtaggatgccagtttctttaaaacttaataagaaatgagaaaagagacttgttttgtaaatagtattaatggaattaaagtttttatgctaaagtcatatttaaatatcgttaccacacagttgatagtagacacaagcaataaactgcaaggggatgagaaagaaccaaaaggttcaccagcacataatcttaagctaaaactctgaagtgtaatgtttatttactttaaaaagtgattcaggaatgcttcttcaataatgcagaactaggacatttaaaccttctataatctaaagaaccttaaatggcggtctatacttttttttggtctatacttacaataagtacctttctcatttttagagacatttattcttccatatttaaccttcttgagaagtaataaatgttacatttactcttaattaggatttgtttttattagcaggtttaggttattgtgaattctgaaaactaaccaaagaataataataataaaattatgtaaaataaacacattttaaatcgattgctaactcaaaatgatcactgggaaggtcttggtaattttctcaatcagtaaggtatcaaccttttataaaaattttgcagatagaagcagttggacccacttctaaatcgggattttagcatttgatctttgtggcatgaaaataaaactctgtgcttaacgttagtgcatttttcccctgaaaagatgagagtaatcttctcatttctagtttctaactaacgtaggtgcctaagaatagtacttttaatttcacttgtgtatctttaattggagaagaggcacatatggacgggtggcagatgtagaaaatactttttaaaattacttgagataaaagttaatgaggcagcctcgctgtgtccccggatatttgtgggttgcagcggggctcagtggtcagtatttctgtgtggcttgctcgggtttggcaacgacgtactgtaatgatgatggatttcagtctttaaaagctccgggacagcctgagagtaggggtcaggggactcaagccgacctccccaccgctcatctcggactctgacgtcctctgcttccagcactgtctctttcccggagtctctactggggcgctccgggtgtgcagaagtattggacaaatggtcagtggagcaatagtgacgaaataaccctgctcctggctttgcggccaaggagaaaagctcagccgggaagggcacgggcagggaagccgggcaccggggctgggggccggggtccccggggtgatgcggggagggacgggtccggcgcgcccactcccgccctcacgcaccgctgtcgccgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtggtgagtgtgacccgccctgcccctggctcgcggccggccccgggctctcctggcccggccggccccgccctggctcggcctgccttgggcgtccccctcccaggggacaggtgcggccgctgcggtcccaccctagcggggacccagcggtaccatcctgtcccggctgttccaacgcccacccgctggcgcccaagtagaagttaccccgaaactggcctctgggaagccaagatagcctttccccatgtttacgcgcaggggatgacgtccgtaaatgacaaaaacaaaaacaaacaaaaaaggaaggtgcaaaatgttaccatgttttaagcaaaaaaagaaaaaataatctatatatctctaggtgtacttgccaaagcaccgtaataattctggtaagataggcaagaaattggtgatggtaacccgaggagaaaaacagtagacctaccgaggccgggcgaaggaagacttttttcactgtgtatggtttagattttatgcttgaaaaaccatgctcacttataccattcgtcccccaaatagaatatgccagaaatccacccactcacgcctcctcacagccacattcttttgggtgccgtttactttgtcctttccaccttcttggtcacttctacctcttatcctcaggtgtatccccaaataccatatcttggattgcccttgagcctggtgaaaatttatttgctctaacttttgttatttcaaaatcagagaactttgtagaacttgagtaaaagtgtggtttgtatgttcttaagttgagcattttccccaattcgcacacgttttactgtttttttgttttttttttttttttttttttttttgagacggagtttcactcttgttgcccaggctggagtgcaatggcgcgatctcggctcaccgcagcctccgcctccagggttcaagcgattctcctgcctcagcctcccgagtagctgggattacaggcatgtgccaccacgcccggctcatttttttgtatttttagtagagacagggtttctccatgtaggtcaggctggtctcgaactcccgatctcatgtgatcccgcccgcctcggcctcccgaagtgctaggattacaggcgtgagccaccgcgcccggccaccatgttttaaagtaagggaatcctgatttcagggattaatctcgtattgtcattgttatgtgtgcttcctagccggagagagtatttaccgctgtaatagagaaaataaaggaaagctttcaccagtcccactctaaggttaacatttgtttagcgaagtactcataatctaataaccctttaaagctaaatatgttacagttagatgccagacgtcttaagtatcccagtaatttatttgttatactctaattagcaggaacaaatgctacacatgttgtttgtgttaaatagattagagtgaaattgcatcacaatgtaagtctgacaccttaaagagaagcaattagttttatggttggttttgttttaatgcatttaaaataaagtggccgaggttaatttaatgagtgtatgtgccttaaactcgttacaacctcccacagcttaaaattttctttaaagggtacccttaactgcagtgtgtgactgtgggtttcatgttttcttaaatgcatcatattaaagaagaaaaagtagtaactggaaaatatcccacagaagttccttgttttcatataatagacaacacatgaacaatgaaaccgatttatttttctggaaaggcacattgagctgagtactaactgaactttcaaaggtaacattttctagagattgagcaaaaatttggtggaatagtagtcatttaggttccagttgcattataaatttgatctagtaacatttagatagtgccatttgttttgtgcatgtaccagtaaaaataacttagaaggaaaaaaaagaacagtttttagcatttctgaatcgttagctttctttgtgcttagcaggtgtcttggccataaccaaggtcagcaaatatgctttgtaaatgggttataaatgataccaattgaagggtgtgtcactatcaattaggtctccttgtgggcttcttatttatggttttgatggatctggcttagttctcagaagcagaatgttgaactcaagtttgtttagccagcactatagaaccaatcactgtgaatttgaacttgcaatacattgcaaaataagagatttatggtgtaacttgaattccttgtcagtgaggaatatgactgagatcacttgttacaaggaacttttataacccattcacctgcatttcacatgtttatgaggactggcttcacttatgatctgcagttgacagtcataaagtcctttgttataatggcaaattctgataacaagtttgcttcacattggctccaaattccactggaaactgtcataaatggctggtttataaagtgaaccttcctgtcccttgtttactgatttcacatttatgaagagaaaggaatcctttcctaaaaaattattttcttttaaccacaaagaaagaaaaaagaaaagcctggatgtgtaaagttttgttaatatgttgtcatcattttagcaaagcagtttcccaggtagctctcctgtgagccaagcatactcatttcaactaaaggcaaattgattcttagcactgacttcctagaaatgttgtagtgctaaaaggtttgccagtgtctctgtttataacttctctgtagagtgatgctaagtaatgcaacaggatgtaaaccataaatgcagattttaatttcatcttttaaatttcccagcaaaggttttggaagtctctgtcctgtaatctgtgaatattcgatacatactcaatttacatttctctcttcttcattctttacaattgatcttaacttcccaaattttgtaattttcaacttggtttggtcctgaatctttctctgatttttttttttaactatggaaggcttcacgaatttgggtgtcattcttgcgctggggccatgctaatcttctctgtatccttccaattttagtatatgtgttgctgaagcaagcatccattttttttttaactgaagctatgtcacaatttttaaagtaatttacagcatttgaaaggaaatttaagcttggcaacttaaaaacgagttttatattttgccattctgggtaagaagttatgttagcttattataattaacatgtagtaatctagaggtaataaattccctttaaggctgttatgggcataaagaaaacatggaaatgggagtgacagtggcagacaggtggccttttacctttcctggtaataccaattaaccctttgcatgaacgaaagttgagaataatactgatagggcaaatactgatattagtatcactgcatctaagacagtggcagcattaagattatgccataaaatttgctcgtatcctttgtaaaatagataaaacaaaaatgcaggcagcaggcaatcatgatggtaattatggaatgtattcaaatatatttcttttttttttttaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggtgggcggcagggaggtggggcactttcatgttaatgtctacttgtgttgttacttctggtgtgttttgagtataactctatttggccaacttttagaaaatcttttaattcccctaaaaaagataccagtagtatctgggaaactctaaattggagaagaaaccagggatgaaactctccttgatatgatgctggtaaaagctttgcatgaagttattggccaactatatgactgctcccgggtattcttgaattcacggagacaggctagctggagaagtaaatcaaatctatagggtccagcatactatgcaaacctcaaatttcttggcccagaaaagtcagtataagtacactgcaattttttttctcaaggaccatttcatttataataaaacagatacatacttgttgatgacagggacaaaataccttaatgtatgtatgtaatatatatatatgtcacttatatttttccacttatgttcttgtactgtttctagccttcatcacggcggcttggattgtcctgtgccaactgtcacaccacaactaccaccttatggcgcagaaacgccgagggtgaacccgtgtgcaatgcttgtggactctacatgaaactccatggggtatgccatgtattctgctcacttgtatatacatttagtatctggtttgtatgtgatatcagttacaaagaatcagcaaatgaaagatactcaagtgaaaaatttgaatgcatataatttattactgaatatgtttaatatattcagtgtacatactgaatatatttattgaattgaaggtgcttttaattataatatgaaatattaccttatgcaccagtaggaaacaaaaaatgctaccagttgaactattgcaaacgttcatttaagacacattccagttttagaaatgtgaaaatgtgaaaagtgtgtattttagaattggtaatatggtagtaactgtttttaaaaatgcacaattaaggaaatcaataaaaaatgcacaatcactagtctatatctcttaaaaattttgaatgtaatcagacatttgtgcaaaagagtaatgcatttaatagttatagtttgaaatatttcatagttcattttaaaggattgcacaaaatataataaacaactcaatcttaaaaagaaaaataaccttgcatctgtaggaggaaggaaatacatgatctctttgaaataatacttcttcaatgaatagctactcatttcaaacaataaacgttaagttgaaggaattaaattctccttggcaaatcatctcattctttctgaaggaatctctgcatttgatgaggaaagtgtagtctttgtgcacttgggatcttgagtgtgtataaaaattggattgaaatttatgccaagttctttttttttttttttttcttgttttgagatggagtctaactcttgttgcccaggctggagtgcagtggtgctatctcggctcactgcaacctccacctcctgggttcaagcgattctcctgccttagcctcccaagtagctgggattacaggcatgcgccaacaagtctggctaatttttgtatatttagtagagacggggtttcgtcatgttggccaggctggtttcgaactcctgacctcaggtgatctgcctgcctcggcctctgaaagtgctgggattagaggcgtgagccactgcactcggccgccaaattcttttaaatgagagcttttagtgccaatgttgggtctttggtttttcttcaatataatattaaatttatggcctatgtgaaaattttttaggtgcccagaccacttgctatgaaaaaagagggaattcaaaccaggaaacgaaaacctaagaacataaataaatcaaagacttgctctggtaaatatactaaaatgacgtttgactgtaaagtatttgccaaccttaacagtagagcatatgtatatttataaggtttattttgactgttgcaggtaatagcaataattccattcccatgactccaacttccacctcttctaactcagatgattgcagcaaaaatacttcccccacaacacaacctacagcctcaggggtaagtattaaaacagcatagactcctaaattactgggctgctctctagtaaattatctcaaattttatcttatctggtagtacaataatctaaaccaacagttcagtttagttagttgatacctaagaatagtttttagaggaaattacatttaaatgtcaacaaaatgacaaacttaagtactttacaaacctcttaattaagatcggtatcatttttttatggttaaattaacccaagtaaaagcaagaagttttggtttaaagtgttttaaattgttttatttccaggtttttatcagagttgctatatatattatatgtgtatatttatgtatttccgatgtagatcataagaactatgaggccagtggtttcatagattacagtgcccataacagttaagtagcttttgtttatcctatcaattccagcctttttttctttttttatcatccacccaaagcaaagctcatcataaagtgttatatgctgctgtattcactatttcctttgcccaattgtgttcttgctgggagagcttgccttcttctaatgtaccttaattgtactggcgtttatttcagctatgacaaaacctaggagtgatttgtgccactgtggacaggagatgcctgggtcttcgtgaggatcacagacttagtttcttataaagctgtgaccaaaactcagtttgcctctagtagagagcattttcccaccctaatgtttcccaaatttacctggaatgcccttctaaaaaatactgggccttccctcagacgtcagtgagctccaaggcagggcctgcggcaagcaggactttaaaatgtgtccttgtgacccttgggactacactgagacaagattaggactaaacaccagcatttaaatgcctatttacttagtaattgttttctacatttagttttctcctgaaattatttggggtactttaaaatactacagattcctgggccccaccctggattttccaagtcagagtctctgggtgtgggacttggatatctatctgttgttgaacaagtgccccaggtgaaattggaactactgccccggaggtgtttgggaaccacagacctggtttctttccactgtatttttactggctttaacaaacaaaaattaaatatttaaaacaaaatgtttaaactgtgcttaaaattatatttgatatttttctttgtcctcctacccaaattcttttgagccttttctgtaaggaaacaaaacgtctttttagagtttcacaagggaagaagccttttagttgtttttttttttgcagactcatggtaaagaatgtttctaggctttataaaggtggactccatgctatggtgttgtgttttacaggcaggttagatgtaactgaggattgaaagtggtaaatagaacatgtttcttgggaaatgaaaagattatttaataataattattttttttttgaggctgagtcttgctgtcaccgaggctggagtgtgcagtggcgcaatctcggctcactgcaacctccacttcccggattcaagcaatcctcccacttcagcctcccgagaagctagaattacaggcatacaccaactcacctggctaatttttttttgtatagttagtagagacggggtttcaccatgttggccagggtggtctcgaactcctgtcctcaagtgatccacctacctcagcctcccaaagtgctaggattacaggcatgagtcaccgcgcctggcctaaaaatatcctttattatgccgtagtcctcaggagcaattatgtagctagaggcaaaacaatttggttttctaaagcagggagggagccgcctctctcctagctgaaatgaggactgctgccagctccaagtcacttttgttggtggtacagtccagcttaaatgtggcaaaaagactaatttgaatgataaattgcactgaggtcgatatatacccaacaatgggcttcggggacttggaaccattgtgggtggagtcttgtgattttgtgacgtaaaatttcaaaatttgctattagcaagtcctatcggttgctgtccagcgaaaggagtgaaaagccagtgaaaagggccatggtctggctagaagaagggccttgggagttccatctctggtcctaggcttattgtcccaggaactctcaccagggacagagcagatggaggtggcttgctggtcaatgcccttcagaggaaagatcagttccccaccagaggccaggaggcaaagcaacaaggatgttaaggatggggttggagagtactagtttcacaccaggtcttcagctgcaagcttccatccctgcggtagtctaggcagcctccacggggactgagaagctgggagtggctggtgtgagctgcagccagggggcatctctccgagctctccagcctctgggctgcgcagcagaaacactgactgccattaccagggcagggggtagggttgctggcctgcctaccaacctccccagttccccagggactgactcttggccttgttccgagggcacacacggctggtgcctgggcttgcagggttttatttcatggatgtctccaaaagcctctacctgctgtggccattgtggggaaacagctactcgtctgctggctgcctttggaagctgtccccctgtaagaatacctgtagtaggcttgagtggtgtccccaggttgttttcatggcgtgcctgcgtataactgtggatcccttcgcactttttgatgtcctctctgggtgggctgagccttcatgtgtatggcatggcccatgtggctgccgagtagctgtgaagagtctgctggaggagccatctgtgagcagctggtagaagcatttctaaaaggtgcctgtgttgacaaaggtgtgtcattttcccattttggtcacagtgcataatgttagagggcagctggctttgtgactgattgcctgtaggattttgtgaaatgctgtgggtgaagaaaatatcagatccacatagcaaggttgtatctggtgtttacaaagtatatgtattacatacacagcaccgaggttggcttggagtttaagcctcctaaggtaatgcgtccaccccacggatctccagtgctccctgtgactgactggtagaaattagtagtgcagggtgaccctcgtttgatggggccacggaactacaaagcaaagggcgatcttaggcaccctcccagcagaaggtggaactgggggccacatatccctccatttagagatgtaagtagcagtatcactgcctttctttaatgactgtgagttatagcaaggaagtaaaaaactgttccagaggcccacatgaaacatgctgtttactttaattccccactgaaaaatcagttgtaggagatcaccggtaggcattcccagcaggcttattgtaagtcctgggacatgacaggaacagggttctgacctgcctttcacgtggccatttaagtgatggcaccaggaccttagcatgacacagagtcctgagctctcttggccaggacgaaaggagccacaggagctgagtattgtggaaggggtctatcgtggttgtctgcttctgggagagggggctccagggctcccctcccctagcaggaatgaaggtgtgggcataattcctagtgcacggcattcttccaggataagttgtcctaatgccacgaaaatttttgtgctgctctgaagcctcatgtcttagctttatatacttgttaatctgtgccttcatgagacctgtgtctgggcaaaaaggagacattccttcagataagagtcagcaagtcgatgaccttgccaccttatgactcagtttctcttggttataggctgtgcatgtgctggaggcacagggagggcagtgtgtttctgtctgaaatcaggaggactcacggtcatacagccctgcttaaaatattgcctatttttttcttttgaaattatttttgtttattaaaaatgtatgttaaacttaaatttttgataaatggttgctttctgtggcaaaaatagtctttctttctggctaagaattttcttatccatgcagatttactaaaaaatgtatatttagttgatctaaatagatatcagtttttctttgggctgggtgcggtggctcacccctttaatcccagcactttgggaggctgaggtgggttgatcacctgaggtcaggagtttgagaccagcctgaccaacatggagaaaccccgtctctactaaaaatacaaacttagccaggcacggtggcgcatgcctgtaatcccagctactctggaggctgaggcaagagaatctcttgaacctgggagttgcaggttgcagtgagctgagattgcaccattgcaccccagcctgggcaacaagagcaaaactctgtctcagaaaaaaaaaaaaattttttttctttggcttttattctctatggattgtaagaatactaaaatcttttttttcttgaattccgtttattgactgaattgtattttatagttttttttggttgttatttaggagagaaacatggtaatgttctgtttctgcaataagatttaataagtagtccacaaatggtcctactcctcctatttctcctcctataactcaaaatttgtaaaactggaggatactttatagctcaatccccaaattttatagataaaaagtttttttcttaatttcttttgtaataggagggattaacttggagatgaaattagcaataatatctgaaaatggcagctacagaaaaaaagaaaaaaaaattagcaataagacaatgtctgagaacaaggagtcactgaacatattttgcctgcctaaaaatagtttctataaataattactttaaaaattaggccaggtgcagtggctcacgcctgtaatcccagttctttgggagactgaggctggaggatcacttgagactaggagtttgagatcagcctgggcaacatagcaagatttctgtctctatttctagtttaaaaaaaaaatgaaaaaaaagtaaaccctatttaagttaatattaaaactaccaatataatattgaaatcatcattaaacataaagtgttgaagttaaatggagagagaaatatatatgaccagcccttgctttactggtctttgttccatttgagtaaaacaaagtgccacatctggaattgtttaaaacatggaggtggtaggggtgggtagagagagacaggtatagatgtagatcttactactggtcagatttggacgtgctttaaaggagtgataactagagttggagatggctccgcagagtagaggaaattaaaattagttaggatttttgcaggggaaaaattgggatagaggtatccaggaaagaagaaggcataggaatctttggagctgaagggaaatagttagttcattgtgactggagtgtagggggtaagaagccaaaggcaggaagtgaggctggtagaacgggtggaaagtagatacttgaaaatatttcaaatcaacgatggactttatttaaatcctgcttcggtgacaaatgtgttttctgtctgtacactggagtccaacaattaggaccttcttactggagcgttctgtattttgataattgatgtaaacaaatgtagcatgctcctgcttgtcaagtttacaagcagagtttcctcctcacaattagggaggaaaaacatctgccagctgattctatgcgctgaccttctttaggcctgtactgtaatttctctgcctccagggatcctgggggcaggatggttggagtggctgcctggctacctcttctaatggaaacatattagacatggtgtattagggataggaaatgtgtttcctcacctttgtggggcattgctggtgatatataacttccacaaagagaggtggacaataggctgagagatagagacttaggttcctcgccagctgcatctgggcctggatgggtgggccttaaccactcttttggtctgtttcttgctagtaaataggcgtcatcgttcccgtcccctgtgtgcttctgggacactgtgtgcttagctagacctatttccctactgtagtcactcctgagctgcgtggtcgtttgaaggagttaagcacccataagtgcttgtggccaacagcagtgatctagagactgactcaagttaagattatttgatgtgctctataaggcctctgaagaaagcttaggcaggtaaatattttaaattgttttcatggattttatttcatatataatatttgcatcctgtggtggaaatagaaaaacaccttagtaggtcctgtagcttactatgcattttccagtgcaggggggttctttattagcagatttacactccactgtctttttcttcaagtaatggaatttttttttgatttactgtgcactatggttggtcacaaaattatagttcctgtgaaagagctgaaaggaacatttgtgaaggacttatgctgtgcttatactgttaagttgctcagaggaaagtatgaaggcgagctctgatgcaagagcctgctggggctggagcagaaaattagtgcttcatttttaacttgaatatgccacagagcttctagaggactcgagagccaaacagtggtggattggtcttcgattttctcatagtgatcttgctttgaggaagtttttccctttcctaatactcactcacttataagatagtgaacatagggaggcaggaaattagtttctatcaggtaccttttatgtgccaggtgttttagatacattttattttttactcctccttctaagtgagatgcagaaggtaaagaacagttccaaggtcacgtgtcaaattgagacgcgtggtttcacgttggccgcaggtctggctgatgcggtcagtgttgttgccactacagcgtgttagattaatatgcgatattagttcatttctttgaaatcttcagagagaagaaagaatgttttcttaaagaaattggactagtttgattaataattttagcatcacatatcctcccactgaaacaggtgggaaaactgtgagaagttatttgctcttgaccaagaatgtatttaagacagttaatgcaaattttcttatcaatgttatacttagaaatcaaatgtgtaatggtactaagaatatggcagttgggtaacattaagttaaaaaaaaagtagtaaaaattacttttgttgacatacctaatgtggttataacaaggttcttttaagagaaacacaagattgccatactgaaatccttctaatgctgcgatttaaatccatacacaaacaaatgctgttttggaacttttcagaatgttaaaattgtcttcaatgaatgtttatgaagaaattactgaaaaagcatttcttaatagtgaagtgcctgttttttttttcagtctatcgtccaaaacactcttttctaaatgagtagcaaaggggttaaaaaatcattaatctcccaaagggtctgtgagagagttatgtggttaggtattattattgcctcatttataaaccaagatccggagtgactccttaaggtcacaaaacaagccagtattgaagccgggactggaaccgacgtctcctgcctcccagtccagggctgttaccactcccagggagttgaccaatcatcacagttattaatatcccacttgccacatgctacaagccatgaacataaatattttgttggcattttatcttcatgctccctatgtgccaggctccctttctttctatgttcacagccccttctaataactcacgttcttgtctgaccacattggcctttgcgtgaaagtcacacgtcaccccggcagggaatgttcaagcatgcggatttgcatactttcattctgatctcaaggctttttctagacttcctttttttttttttttaaatctcgtgtgtgtgtgtgtgtgtgtgtgtgtgtgtgtgtgtgtgtgacagggaggatggtaagaagtagtttaaaaatgcattgtgtgctacatcaatatccaatggctttgtacattaggaaacagtaaagctttaaatagtttgtaacatatgtccacataatttatcacagaattgtggtttatttaataagtgactcattatcactatctgatagccagaatactggataaagaataagtgtgggcagaagttattcaccatttcttatagcctcatcccagaatacagctcttctttgcaaattacagattctttgcagttttctcccacccgcccccccaacgcctctataagaatatacaaaattgtcagaaaacatgaaataatgttacgggaaaacatggccaaatttaagaaatctggcttagattgctctgaaaggttattgctaaatgaatcttcgaagaaaacgaattcctttactggaacaaaagtaatttattatgcatttcatgggtgtctgccagaagagttactagcagtatgaagatccagtggatatgaattaagtacaatctgttagttctgttcatgtttagacctacctgttaattttctctgaaattttaataatttaaaaaagcatctccatagacaggtgttggcaatgtgacaattcaccactcagctacccatcacatcaggcttttttaaaggcccagtactcagaatttgtgagactgagcacaaagacattattttattgacctcatattttaagaatgatttggacaaatacataactaggcattgattctaatgtcctgttggggtcttacgagtaaacggttccaagtcaacatctgacgatgcttaaatcatgatccgacttgatggtgtgctgcctgttttggttgttggcctggcacggtttcaccagagctgggccacatgctgcagaaccatatttttattttattaaacacaagtattttacatttaaagctctcattaaatttagttgcttgattcgtggtgaagcctgaatatggtcaaaagtttattctgggggttcacggattagcagctgggaggaaacagattccagcagccaggcgctagctccagctctgtctgtgtgagtatagcaagctgccaaggttctgtaaagcctctgttttcctccttctactaaaggggaaaagtaattcctaccatctggtccttaggagtattgtgtagagtgagtgggagatgcctggagacctctttgaagtttaagaagaatagcactacttaaatacgggtcttggaagttaatagtaatcagctttatttgcgtggcattttttttcatcccaagatattagaataagatcctcactttcttaatggggaaatttagagacgtagagttattgtgttaagaaagtaaccacattttagagatttgtatttcactgatagcaaattttttattccttctgatacttagtactttcctaatgctttttgtggtttaagtgcattgtaaatgcttcttggtatgttttctgtaattaagatggagagattaagatgctcatccatctcctgaaaagtcagttttgttataaaaattaagatcataattcaccaggttttaaatcttgcctcaggattctgtcccacttaatttgaagattagaatagtgtaattcattctgattcatttagaagataagctttttctttagggtcctcattgacttcaagttgtgggacaaaccctctcccttgcaatttatatttgtacatgagtattttggtgataatcccagagtacttataaagtttggcgcctttcttcaccacaacatgcttgctgttgagtgtgcacagatacataaagcaatttgctcttttgtccagaatagattatgtgcatagaattgctttcgtcttcttgaaaagggcagcatcccttggtgtggctataaccttgcctactcaggcctagaaggggcgagaggggtatgggttggggcagagtgggggagcagccggtgaaatttccagtaaggaatttgtttgccgaattaaatatacaaaactattctgctgaatagttaggtcatcagttgaggtgacggtgactctctctctagagaaaaggtgtccatgttcctttgttttattaagctgttaagaattcgagagtttcattgtgattggttttcacatgtcctggtggagacagaatttgtgtgtgttcatgtgtctttcatgtgtcaccttctaaactattactgtcactttgtatctggtcctctgttacctccagccaaactgaaatgatcgtagtttatatagtggaagttacgatttgcaggaaagcatttcccctttgttggaatttatacaaagtttttaattcctctttggaggaaggcagctataaagcaccacaggagtctaacctagaggttacaaaagcagagaagagctttggcagtgagggacggctggcttcccctcacacaagaaaaagccgtaagcacagtctcactcagatgtgtaggaaggacggatcagaggctgggggagccgacagtctgccttgcagtgaaggaggcatgtgatcaccatcaaagtcttctgctctgggaaggatcacacagtcgtccttcagcctgcctggggcgcagtgttttctttcctcagaccgaaactgcatgaagagagattccagcaaggaagatagagcatgccccgtacactcctctctggttttcttcctcaaaggaaatttatgcatgtaatccacaagccgaagaacccatgtttttctttggaaaaggctacgccctttcagggtttccttttctcggctgtgttgccttcccatcagaagctgtctcttgccctccccattatgggatgtgcgaaatgaaggaaaacagagacactgctgggcatttgtctccatgagttgatccaatcagaaatctttgacttttcagatatgtgtccaaaaatgagtgaaggctcctcacaggaaaaaaaaaaaaaaattctaggtgatctaaagatgaactgtggctacttctcaggctagcggatattttccatgtcccaatctgtagcagcccaagctctccctgaagtcatttactcctttaagagggagttttccagcccagctgctctgcctgtctcccacctaacccggccagctttcagtgctaagcccaggctgggtctggccctgataacacattctttcaacaggaagtgcctccattttcagttgtctgtgggagggtggagggcagataagccttgaatggaaacacagagccgatttctgctccaccctccttgcactttgatcagggagagagcagggacctccgcctggcctgtgctgcctgccgaaaggagggaggatggttgagctgtgggcattccggagctctccctcccttttgttcaggaacgtttgtttaggttggtctaggttagtgaagtgcctgcttttgcagggttgtgatgtctgcgatctgaactaaagtcctttgaagggttgaattatttgtgggaaaatatatcaaccaattgaaatttatacgtgtgtttgtatgtgtgtgtattaggtccaggatcatagtatatttttctctgatttcccccctccgcccccccctcccaacacacacacatcgtgttgattctcagtaggcatctcttgactatcatcagtgagggaaagggacttaaaagatgaacaataacaggacaaagccaggcttcttaagaagagtagctgtgccaactctgaacgccttctacttttagaatattggtttagaggccaggcacggtggctcatgcctgtaatcccagtactttgggaggtcgaggcaggcggatcacttgaggtcaggagttcgagatcagcctggccaatatggtgaaaccctaactctactaaaaatacaaaaattagccgagtgtagtggtgggcgcctgtaatcccagctactctggagactgaggcaggagactcacttgaactcgggaggcggaggttgtagtgagccgagataccaccactgcactccagcctgggcgacagagtgagagaatatcggttttgagagctgaagttacgctgatgcatggagctgacgtgttgattgttttaacttgtatagaactgtgagattcacatgtgcgtggctggccaggccctggcctgtgccaggtggcagggagatgatttcaggggcggatgggggcccttctgacccgccctcctgttagtgcctcgactctggttccctcctattttttcaagccactttctgatcccatgaaggttggcttgtccctcaagtgccttgtgtttctggtactcatgtcttctattcatccccaaagttattaggttggtgcaaaagtaattgtgggttttgtcattactttcaatgccaaaaactgcaattactttggcaacaacctaaatagatttactatgcaattcaatttaagtattcaaagaaaaatattcaaagaaaggtatagatggctaatagacttggccctctcagctagtcccctgtttctcccctcctcccaggggacctttgtaatacttacacatgtgcatggataaattgcagttatgacgtgtaattcatatcttgctgtttttcacttaacatggtattacaggattttttccattttgctccatgatcttattatttttaataattgcataatagttcattgagcggatgtgccctgcttttctaaaccgttcccatattattagacattagattgtttctatagtttctactattagaagtaaccttgcaacggttggcttcctttgcggagcctttcccttcttttgaattatttccttataatacatttccagaagtgaaattatagggcgaagtagggtctaaacttctggatggctcttgacattgcagctaactgccttctgtaaggtgggtgtaccagaatttagctccgccagccatgagtgaggggactggtgttaccatgtaagtaacatcagcctttctttgcagtatttcatgtttaaatattattatatgtacacataaaataaggctaccaagcattgggcacaaatacttgccccattttttttctgacaggctcagctattgcttttaattgcaaatgagcagatttatttctaggagtgcatcactcatggaatttgaggtctgtctgccctttgatagcaggactcttggcctgccaaatagcttaacattttgtctgaaaaaaagacaggttattttcgccaattgcttttgggattgttattcaggtgtaagaataacattcagggtgttaacgtttctttaatgtgggttgttgaaaaagagtcagtgagtcaccaggtgtggtagctcgtgcctgtgatcccagcactttgggaggctgaggcaggtggatcccttgagctcaggagtttgagaacagcctaggcaacatggtgaaaccccatctttacaaaaaatacaaaaattagctgggcatggtggcacatgcttgtggtcccagttattcgagaggctgagatgggaggatctcttcagcccaggaggtggaggttgcagtgagccaagatcacacccagtgcactccagcctggatgacagagcaagaccctgtctcaaaaataaaaaataaaataaaaaagagaaagagtcatgagacttttgaatggctacagaacactttgatttatttttgcgaagaactgtcagtgacagtttgaatagggtcattctggaggtggttctctttgagctccaactgtgttccgactgcttctgcccctgcctggtgatggggtaacttgcttgggctgaaggatagaatgaggagaataaattagatccaagcctcttaaccttaacaataataattagataacaagagtagcttatactgacataatctttactgttctcagacactgttacaagggctttacatatattagccaattctttttttttttttttttgagatggagtttcacttttgttgcccagactggagtgcaatggtgcaatctcggctcactgcaacctgcctcagccttctgagtagctgggattacaagcatgctccaccttgctcggctaatttttttgtgtcagtagagatgaggtttcaccatgttggtcaggctggtctcaaactcctgacctaaggtgatccacctgcctcggcctctctaaagtgctgggattgcaggcgtgggccaccgcgcctggcctagccaatttaattcttgcaataatcttatggcataggtgcctctttttatcccactttataggtgtggaaactgaggcacacaaagctgtatgtcaggcttctggtttacctctcccacatggtctgttcactcttttgcttcatccttctgtttttcagctggcttttcttctgaacaggccaggtgaccacctctcttcatccgccctgcctcccattttgaacatccttctctcgccaataacaatagcttccctttacggaatgtttaacatggcaaggcaccttgccttcgcttttacaaacgttagctcatttaattgtcgcaaccatccctgaggtgggaaatgtgaggacccaggcacagaggaggctcaggggggactgcactcagcaggggactgaatcaggacaggacttgagagtccaagctgcttcccctccttctcatactcctgtgtgggctgcctttggttccttgcccaggagtccttgccctctgctattccttttctgactcttggtctaccttcctgtctcagccactcatttgttgttcatgataagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtcagatttagtcagaggcatatgctgatgtgcctgttttcgaataagaaaatcaatgcaaagttggacgtgagatgtatcattataaggaagctcactctaatagttcctttctaaataaataattcttttgtaattgaatatcatccttttgcttatttctttgagggttaaatctggatccacactggatttgcttctggtggagtctctggaattaagggctaaagttaatcactatgtttataagtataaccaagtttatggcattcagtttgttggacaggattattttagctttttcagaattgccacaagaatccatctgaagctttagacatctcactgatttttgtgaaatttgctttttaatgcacctaaaaccctcagtttaagtctttacatttgtgttatataaacaaaagtttgggtgtggggccagtgttgttgctggattttcataaaacctcatttctgctgggaaagggaaggagtggttacctgtggaggggtcgggtttggtctgtctggttgggaggaaggaagtttgggtgcttagactcagagggcttgctcgcctgaagtcctgcctcccagcctcatgcccttatggtgagggttgagagcaaaccagatcttgttggaaaacgagtagagttggacctcattcacttgcaggccgtggaggctcggcacacttcctttctgttccgcctgtgtctggtgccagagaaatgctgttttaaggatttaatgggattatgtatgtaaaaaagaaattctgtgaaaagtacacaatgtcctacctctgtcaaataacaagtatctggtaatttatagaatggagccctgaaagcttggaaggaataagagctcctgaacttttagaaggaaaaaggtgattttaaaaagtacatgattatggcgaaatttttcaaaaagcttctcaaaagcaactttattcaaactgttgtctaaacagattttagttattttggtttgattttactaaattatatgatgtttcctatttggcctttttcatgtgaatgggaggaatgggtggaacagggcaaaggtgaacttgtgcttcaagaaatcattgtggccaggcacagtggctcacgcctgtaatcccagcactctgggaggcccaggcaagcagatcacctgaggtcaggagttcgagaccagcctggccaacatggtgaaaccccgtctctactaaaaatacaaaaattagccaggtgtggtggtgcatgcctgtaatcccagctactcgggaggctgaggcaggagaatcacttgaactcaggagatggaggttgcactgagctgagatcgtgccactgtactccagcctgggagacagtgagactctgtttcaaaaaaaaaaaaaaaaaaaaaaagaaagaaatcattgccatgatcatggcagatagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttagagtgtgtgtgtgtgtgtgtgtgtgtgcgcgcgcacgcatgcgtgcgctctgcattttctctttggaaatgatcaggttgtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggcccccacttgctgggggcaggggatagtaacgccggcttcatttctcctgccctgggtctgcccaggagcagctctggccctggctgcacagacccgttcattagctcccatgtatttcactaccaggattgtaaccgcttctcaccttctcgtctctcctctgtgtccccctcttctgccaggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcagtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtggctccctgagtgtacagtatttttttacttcttttcatgcacttattacagtcattctatggggttcagtctgaatctttcaagagaaggaatgtcttccttagtcctggtgaatgctactctatagagggacagtgtccatagccagtgtgtgtgtgtgtgtgtgtttctgggtaattcagtaaggcccacgtgcaccctgatatcataaggtgggccagaacaatggttaagagtgttgggtatgcaggcagatcactaggcttcaattccctgcttggccgtggataagctctgtgaccttgggcaagttatccagctctcatctttctaatataaaataaaggcaaatagtatataaatcacaggattaagtgagatagtccatgccaagtgcttagcacaatacctggcacatattaagtactaacttgactttgaaagagagtggcatgatttgcaacatagatcctttgaataatgtctgactacctggaatatcagaagtttatggtctgtaagagtgatgtcctgtgggtcacctgtgcttcttcaacaaggccaagaagagtgaaatgaaagactccctctaatccagggggttgcagaaatggagggaggatgcatgagagctgattgttttataatagaacaaggctgttctgacaacagaagaaaattattatccccacgaactgatgtctgttttcctccctccttttatggttctcattactttgagtgctttttggtgggttgggagttgttaaagttaatatggtttgattggaaaatgaatttttctttttggggcttccaaatgaccctttttctgggataatctcaaatattgctccttccaattctaaaaagaattctagtttttatgaaacaaattacagtgggcagaagacagagggggcttcttgtagcctgtcctaacacaatgaactccactatctgtttttaaatgattactttcttacctatgattgcataaagaagtttgttaaatttgctccaaatacacaatttcagcactcctctcccaaagtatgacatgtgcaactgaacatgacccaatcatttctcaaaagggaatgcattcaaatagatgctgcacctcagcttaaagaatccccagaccgtatatcgtggactggagaatttatgtcttctgtcacacatggctgatttgaggccatcttaaataagtgaaggctctgtctggggtctcttttcagggtcacttaatgttgtttcctggtgcttatgggagggtcaggaaagcaaagggaaccattcatttcccagtgcaaataaattaacttcttgctcatgggaaatgtttttcacagtccttggaaatttgatgtaatttcagatcacagataaattggctgctttgctgggagggcaacccagcgagtcttcaatgctgtgccagattccagggt

SEQ ID NO: 16025 - DNA, 7496 bp, Human
acaggcatgtgccaccaagcccggctatttttgtatttttaatagagacagggtttctccatgttggtcaggctggtctcgaactcccgacctcaggtgatctgcccaccttggcctcccaaagtgctgggattacaggcatgagccaccgcacctggcccgttctggtttttgaggagcatcacagaagcatctctcactggcactgtgacagtgttcatcacataaactaatgatcatcttctctaagcagcagtcactgctgtagaaattcctcctagggaggacatcattcaggctcactgcctcatatataggaggctcttgactgaactctttttttctggacatggaattttgctcttgttgcccaggctggagtgcaatggcatgatctccactcactgcaacctccgcctcctgggttcaagtgattctcctgccttggtttcccaagtagctggaattacagccgcccaccaccatgcctggcaaatttttgtatttttagtagagataaggtgttcttaaactttgaagatcacttttgggacgtttaaaataactgttgctttttgtgtaatatttacacatttcaatattaactattatttaccatctgtacttttttttttttgagatggattcttgctctgtcacccaggctggagtgcagtggcatgatctcgcctcactgcaagctctgcctccagggttcacgccattctcctgcctcagcctcccaagtagctaggactataggcacctatcactacacctggctaatttttttgtatttttagtacagatagggtttcaccatgttagcgaggatggtctcgagctcctgaccttgtgatccacctgcctcgtcctcccaaagtgctgggactacaggtgtgagccactgcacctggcctaccatctgtacttaattggaaacctattggtctttatattttttagatagctctttaaaatccatgatggagttctcatcaactgggcacggtaatacaggagaagtgattcacacagggacgttgcaaatacatgaaagtcatcacactggagatttttgcttcccagaaatcaagaaagatattcatcactttgagtttcagtggcaagaaatttaaagaaatggccatgaagcacccatgacagaaaccaaagagttgacaggtagtacagactgacgtgatcaaagacatgctggaaacaagcctattaaagatcagcttggatcaagctttcattcgcatctgcctgaactccacatgtttcagacccaagggaaaattggtaatcaagtggagaagtctatcaatgatgcttcctcagcttcaacatcccaaataatttgtaggctcaaaacccatatttctattaagtatgggaagaatttcctctattcttcattattcacacaaatacaagaagtacacatgagggaaaaacctttccaatgtaatgagtgtggcaaagcctttaatcatagctcatgtttaaggagacatcacgtaacccattcaggagagaaacagtataaatgtgatgtatgtggcaaagtctttcatcagaagcaataccttgcatggcaccatagtgttcatactggagaaaaaccttacaagtgtaatgagtgttccaagaccttcaatcagaagtcatcccttcagtgtcatcatagacttcatactgtacagaaacattacaaatgtgaagaatgcaacaaagtttagagttgaggatcacaacttgaaacacacaggagaattcattactggagaaaaaccatacaaacgtaaggtttgtgacaaggctttctgggataattcatgcctttcatgccgtaagagttcatactggagagaaatgttacacatgtaacgaatgtggcaaggcttttagtagaaaagcaaaccttgcacatcatggacttcatactggagggaaatcttacaaatgtaagggttgtgacaaggttttccaccatgatttatgccttgcacaacatcagagagttcatactggagagaaccttacacatttcacgagtgtggaaagacgtttgctcaaaattcagcccttgtaatgcataaggcaattcatactggaaagaaaccttacacatgtaatgaatgtggcaaggtttttagtagaaaagcacaccttgcatgtcatcatagacttcatactgtctaaggtttctaatcaacaatcaaaccttgcacaacatcagagagtttatactggagagaaaccttacaagtgtaatgagtggggcaaagccttaagtgggaagtcgtcacttttttatcatcaagcaatccatggtgtagggaaactttgcaaatgtaatgattgtcacaaagtcttcagtaatgctacaaccattgcaaatcactggagaatccataatgaagacagatcttacaagtgtaataaatgtggtaaaattttcagacatcgatcatatcttgcagtttatcagcgaactcatactggagagaaaccttacaaatatcatgactgtggcaaggtcttcagtcaagcttcatcctatgcaaaacataggagaattcatacaggagagaaacctcacaagtgtgatgattgtggcaaagtcttgacttcacgttcacacctcattagacatcagagaatccatactggacataaatcttacaaatgtcttaagtgtggcaaggtcttcagtctgtgggcactccatgcagaacatcagaaaattcatttttgagataactgttccaaatacagtgactatagaagatcataaagctttaattgacattagagccaaataggcattgacttgagattgagttgacttaaccttgagtttaagaattaatttacattaaagtgtttatgttaagaagattgggccaggtggggtggctcatgcctgtaatcccagcactttgggagcccaaggctgatagatcacagccacacctggctatgagagtgtgtaggtggccgttggggtgggacctgattagaaggggcagggccttgaacagaatctgggcggggcaagaatgaggaggctgcctggaggccgggccagagggtgatcgtcatcttgagggcaaggtctggaagtggtgttttgaagggcagggtctcgagggggcgggtcctggctttctcctcagctggaccccaggtgtcgtctgctgtcatcctcttgccctgcaggactagattctccgggtactaattggtggatagtttctgatgtgccgtgatattacccctaatatcacagggatgcctcctgtccattttagagacttgctctgtcgcccaggctggagggcagtggcgcgatctcggctcattgcaagctccgcctcccgggttcatgccattctcctgcctcagcctcccgagtagctgggactacaggcgcccgccaccatgcctggctaattttttgtattttcagtagagacggggtttcactgtgttagccaggatggtctcgatctcctgacctcgtgatccgcccgcctcggcctcccaaagtgctgggattacaggcgcgagccaccgcgcccggcccctaagttaatatttcaaacaatcgaaggtaaaacaacatattgtgttgggccacctgtactgaacgctgaatcgtttttcctcttaagttgaaaatggttttaatgcaaagcgccttttttgagcaggtagagtcacgcatccggcaggcggggcgagctcccctctgtctggggcagggtgggggagaggggcagggacctcggtaaaggggtggagtggcgcgctggttgccgcgggcactggcaattagaagggattattaaactaagcaaggtcctgggttgtttgagtggataatggaaactgaaaggtgacgtgcaaaactgcctattactcccaggagtggaggataatttcatatttcatggaaataaactcagggcccggagcggtggctcacacctgtaatcccagcactttgagaggccaaggagggaggatcgcttaagcccaggaattcgaaatcagcctaggcaacatagtaagacctcatctctactaaaaataaaaaaaaacagccaggtgtgttagtccacacctgtggtcccagctgcttggggtgctgaggtgggaggatcacttgagccagaaagttggaggctgcagtgagctctgatcttgccaccacactccagcctgggtgaaaaagctagaccctgtctcaaacaagcaaataaatgagaggtataagtcctcctttaaaagtaaaggaagagatttttctttccttttgtctcttagaacattcaattagaaaatttgtaaattcattttctctgtcttctgaggtttttttttttagacagagtttttctcttgttacccaggcttgagtgcaagccacgatctcgcctcaccacaacctccgtctcccgagttcaagcgattctcctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtgattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagctgacacagatggtcacctccattaccaagtagagtcaggatgaactatgtgtgactgttcaactatgtgtcctcttccctgaggactgattagtgtttatcttgaaaacatgtccttaatgggttgtatagaacactgaagcatctgatttcaaactcttagctcttttcctctatttcccatcacattctggtctaaggcttatttattaataaaatgatttttatttctttattatcgtggagatgatttttcatttgggggaagatcattttgttttcaaatatattgtctcaacatttaaatagtgaagtaaagagtatttcttgtgccaggcatggtggctcacgcctgtaatcacagcactctgggaggccaaggcaggcagatcacttcaagtcaggagtttgagaccagcctggccaacatggtgaaaccccatctctaccaattatacaaaaattagccggacatggtggcgcgcttgtaatgccagctattccggagggtgaggcaggagaatcacttcaacacagggtgtacaggctgcactgagccgagaccttgccactgcactccagcctggacgacagagaaatactctgtcttaaaaaaaaaaaaaaggaaattaagaaagtaatagatctcctccacaaatgtgctgggacaactaacttgatattcacatggaaaagaataatgttggatccctacatcacacaatcaaaattttattttaaaaagttagagaacgaggaagggagccctgcgggagggggtgttactttgtcgcccaggctggtctggaaccccaggctcagcaaccctcccgctgctgcttcctgagtagctgggacctcaggctccctccccagtgcccgcatctctgctgtgtttaagcagcaggtggtgacttcgctcctccctggcctgagcactccgtcccgcatcccaggcggtggccctagggaagtctctgaagctgagcacagggtggactctgcccccaccgccgacccgccctccccgaccccgagtgaatggagaatagaaagggagaggatttctgttctgtcctgtgggccctcagtatgaaatcgtagttctgcccaggcaggactttgcatttcacattctagtttgcatccccgttccagacaattccagggcttttgactcatgcctcagccttcccggccagtctcccttccaaaacccgaaaaacggaggcgctgggctcaagactgactctgtcccgccccggccccgccctctgccggttctaaagggcaaagtctctccgcctcgcgccccgcttccgcctgcccaggccccgcccacctcctcctggaccccgcccaggcctggcttctgtcctgcgcgagcagatcagcgcgaacctggaagcggagagcgtggagtgaaggtcccaccgcagcgcgtgagtttctctctgttttatattaagtctgtgcgtcccaggtccccggcgcgtctgtacctgggacgtggggtccccacagacctggaaattctcgcccgtcttcacccagagcaaattgagacttccctttgagagtccggggttcacttccttttgggtttaaaatcgccttgaagctggtgcggtctctggtcttgctgctatagggcaatgtatacactttgtattgggtagttttcctgctcaaaacctttttctaactcctcccgccccgcgctttttaaagtccttacaggtgaggtggattcccgccctgggcgcctcccaccctcgccttcgacggcccctcgagtgcagcgccgtgcccccagtcccgcggaggctgcgtcctctgcctggtcctgagatccttcagaccccaccattgtcttaaggcgccgtcgtcccccacctcccttctcgtgccgggccctgctgctccccaggtctcctctccgccgtcaccgcttcccctgagcccgcgttgggaaggtgtccggggcctgtcctgtgacacggggtgtccttgcctgcccagctccagcccctggaaaatgagctcccccgggatgcagacgtcttactccaaaccctcctgtaattgtatgggccaaaggaatcaggtgagagagagcagtagaaaacctgagataagaaaagagcaggaggagaaaagcaactggagaaatgtagagaaaagctagatgtacagagagatgaaggacagcaaggaagagagggggcagc

SEQ ID NO: 16026 - DNA, 50073 bp, Human
  misc_feature (1)...(50073): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaccaggcattattcttttgctctcaagaagcaagaattatttaccctcttcagttttttactaaaagagttgtaaaatagctccaatgcagtgaaaggcaaaagtgtctatatgatcaaatagtactctcccaagggtaccataaatgacagctcaccattactttgaaaggacacaagtaatattttttcccatttcaaagtctttcacagttgttccacacaattttgtttaatttgaaaataccaaatgttatatttgcaaactgtcaggtattactgctttcttgttttctataaaaaatagggcttatttataagtgatatcacgaggttatcatcattcataagtggcttatcgctatcaagccaatagattcatcagtttcaagcctattcctagaagtattatattgaactagacagctctccttatcccatgccctcagttataaggtgcagaccttaaaagttgatgaaataccataggaccacatgaaatccagttttgttttacttgaattacatccccctattttatgttttgcagaaaggccacagtttacgtgagaagttggctgaaatggaaacatttagagacatcttatgtagacaagttgacacgctacagaagtactttgatgcctgtgctgatgctgtctctaaggatgaacttcaaagggataaaggttaattaggctattaccactatttttacttggagaatgaatggattaaaagcctcttgatctcaaagggtaatgtctttaagtgataaaggtgtttatagtcattttttgctgcaaacccccagtgaaacagatttcagtgtccttgtaacttgggtacttcagttacacatactaattcattttgatcatccataccagatgccattgaagacctttattttatttatttacttttttgttgagacatggtttcattctatcgcccaggctggagtgcagtggcgcgatcatagctcactgcagcctcaaacttctggcctcaagcaattctcccatctcagccacccaggttgctaggactacaggtgtgcatcaccacacccagctaatttatttttctattttttatagagacgggggtctcactatgttggtcaggttggtcttgaactcctggcctcaagcaatcttcccacttcggcctaccaaagtgttgagattataggtgtgagccaccacaccaggcaaagactttcaaatgatactctttattccattaaaaaatgatatctattatcttggtattatggatcatttcacattattattatgtctgataaatttagcccatgatgagtcttagaggagataagtatatgttaaatccttcagatctgaaatcaaccagttgatctctttctctttctccctctcatttctctttttctccccttctcttttctttttgccttttcctctctctctctttttctttctttttttttttgagacagagtctcgctctgtcaccaggctggagtgcagtcgcgtgatctcggctcgctgcaacctccggctccctggttcaagtgattgtcctgcctcagcctcccaagtagctgggattacaggcacgtgccaccatgcccagctaatttttgtatttttagtagagacggggttttggccaggatggtcttaatctcctgacctcatgatctgcccgcctcggccttccaaagtgctgggattacaggcctgagccaccgcgctcggccccctctctctctcagtctctccctttctctaccctttttctcatagaagaagaatcagtaatagaaatggaagtaataattgtatgtacatttaaaaataattttattgagttcttatttaaaagaaacaagatatcttcaattaacttttagtgttaggtttatagtttaactttcctttgttagtcccaaaaatactgctgatgtcaacattgttcttcagctttttcacttaatttattgtgatggcaaaaattaactactctaccattattaccaaacaggactaagttcatccccaatataactaggtggcttgacatggtttcatttctcttttttattaaatgtgtttgatctggatccaagttctttttgtctattctatattccctttttctgccttctttggatgaaatttttttcatatatatataattccactttatctcctttgttagcttcttaggtataactcgtggttttgttattttagtggctactttaaggtttatagtttgcatatttaacttaccacagtctgccttcaagtaatataccactttatgtgtagtatcagaaccttccaataatgtagtagaatgttcatagctccctgtgaccttaaactcctgggctcaagtgatcctcctgcctcaacttccgaactggctaggactacaggcatacaccgtcatatctggttaatttttaaattttttgtagagatgaggtctcgctatgtggcccaggctggtctttaaactcctggcctcaagggattctcccacctcaactgcccaaagtactagaattacaggcttgagccattgtgcctggccttgaagttctatttgttaatataaaaacttttattaaaggttttggttcgttaatgtgtgattttttttttttcccctctaaaaatagaaaacacctgaacttctgtttctccttcattaaaaaagtataccttttaatcaatttaaatgttacagattagctttaaacaaaaacaggatacatatagaatatgatgccttgtttatcttaatggtccataccaatagcgtatagtattagaaggacaaaagtgatggtggaaaaagtggaagttggaatgcagtgataaccaggttgtgtagatgatttgaaaaataataatagacattacacggaatcttttctgctacatgtttaaataaatagcaaattgaagactgatgtattagtttgctagggctgccatatcaaagtaccacagactgggtggcttaaacaacagatttattttctcacagttctgagataaaggtattggcagggttggtttcttctgaaggccatgaaggaaaaacctgttccacgcctctctccttggcttataggtagcctccctatatcttcacatcatcatctttccctttgtatgtgtctgtgtccaaatttcttctgcatattgtacagtcatagtggattagtgcccatcctaatgaccccatgttaacttaattactgctttacaaaccttgtctccaaataacagccatattctaaggtactggagattaaggacttcaacatatgaatttctgagacacaattcagcccataacaactgatttccctacaaatgttatttgtgagatactgactgattgattgatcctttgatttttatttgatactgggtctccctctgtcacccaggctggagtgcagtggcacaatcttggctcactgcaacctccgccccccaggcccaagcagtcctcccacctcagccttcccaagtagttgggactacagatgtgcaccaccatgcccagctaattgttgtattttttgtagagacagggttttgccatgttgcccaggcttgtctcaaactcctgagctcaagcagtctgcttgcctctgcctcccaaagtgctgggattacaggcataagccaccacgcccagcctgaaaaagctattttgtgtctgttttggaggtggaaggttatggtaaaggggtagtttgagaggaagatttaatgtgctggtggctgagaaatatttgggtggcaaaaataaatagatgtctggctgatactgtaatcatctcggggagctttaaaaaagaaataattgtatcatacccttcaccatagtctcactaaaccagaatattcaggggttgaggggagagagagagattaacgttttgttctttaaaagttccttgataggtagataatcaaaagttccttgatatgtggataccctctctagtagaagtatgagctagcattataaacaagccttctgaaggcagaaggaaagcacagcagaaaggggaaaacaaatattgtacagaaggcttttgagttttccaagaaaacaactcctttaaattgtgagaataggtcaaatctagagcaaatgaaatatctcctgcttctgtagaaaagaatgcatgaaggtagagttgaagagtgagtaacaaactgttttaacttttcattgatatgatgcaaaaaagtagggaaatttgaaaaggccccgggaagtaaggatctcaaaaggtacttgaaggtcatctttatgggattatgccaggggactaatttaggaatagtcgtattataacttcaactgatggtcagcatgattttttatctgagtatggtttaaaaataatgtatctaaagacattgcacagcatatttattgagcatatgagatcttactcatctttgtattttcactggtaatcaagatatgctcatattgaagtctgtaggaatgatggaagtggaaaagaaaaagaattgaatattgagatcacagccaggtagaaatgaatacagggtattaatagataatagtttatgatttgtaagagttgttatagatgattgacaacattttcaagtggttataaaaaaatgaaatagtccagtaattagaaaatnnnnnnnnnnnnnnnnnnnncatgtaggctgggtccagtggcttacacctgtaatcccagcattttgagaggcagaggtgggcagattgcttgagctcaggagttgaaaccggcctgggcaacatggcaaaacctcatctctacaaaaattagctgggctggtggtgtgcacctgtgttcccagctgctcaaggggctgagtaggattgcttgagcctgggaggtggaggttgcagtgagctgagattgtgccactgcactccaggctgggcaacagagccagaccctgtctcacaaacaagaagaagaagaagccacaaaaagcttgataaaagcagcaaataatgttgggaactaagatgcaggaatttgcattatgagtggaatgcgtagtacagagaattaaagcatgtggcgtagtagaaaaagggatagcacatagaagaaagaggtatgttaaagtagaacaagagagattctgtttttgtctggaattagagaaaagggatgcctggatacagatacagcctgggatgaatgaaaattgatatcatggtcaggagattgagaccggattcctggctaacatggtcaaaccccgtctctactaaaaatacaaaaaattagccaggcatggtggcaggcgcctgtagtcccagctactcgggaggctgaggcaggagaatggtgtgaacccgggaggtggagcttgcagtgagccgagatcgcgccactgcactccagcctgggcgacagagcaagactccgcctcaaaaaaaaaaaaaacagtcgatatcatatctgcaagtcattatattttccttgcacatcagaaatagtatatataagaactctcgcctgggtgtggtcactcacacctgtaatcccagcacattgggaggccgaggtgggcggatcatgaggccaggagtttcgaaaccagcctggccaacatagtgaaaccccttctctactaaaaatacaaaaatattagctggctgtggtggcacgcacctgtagtcccagctacttgggaggctgaggtggaagaattgcttgaacctaggaggcagaggttgcagtgagccgagaccatgccattgcactccagcctgggtgacagagtgagactccatctacaaaaaaaaaaaaaagaacaactcttagaggcaagctaaggtgtcttctgcatagaaggcacccttatagtcctgttcagcccttctggtcctcttacagagtggaaatggccccacggaagggagcaagagataggaagactacagggtgaaataattcataactcagtaaccttcccttacacaaatgagagtgaatatggtttaaaaataatgtatctaaagacattccacatatttgggtggcaaaaataaatagatggctgatactgtaatcatctcggggagctttaaaaagaaataattgtatcatacccttctccatagtctcactaaatgagaatattcaggggttgaggggagagagagagattaagattttgttctttaaaagttccttgataggtagatatttattgagcataccttgattaccagtgaaaatacaaagatgagtaagacttcatactcagaatcagaatccagagtaaaatgactcagttgaacataagaatagacattaatttctatttcttttcatcctaatttccttaaatatattttatttagtggtagaagatgatgaagatgactttcctacaacgcgttctgatggtgacttcttgcatagtaccaacggcaataaagaaaagtgtaagtaatacatttttcccctcagctggataaaatatactttcagaagttatgtaacaactcacaagaaataattacctgattaattttttaaaaagcagtagaactggtggaatccaagtgaaaatatcttccaaggcatgcaggtaaaaatcacattctgacattatgtaataatggtaacttttacataaggatgtccagctgtcccagcatcatttgctgaaaagacaatttttttcccttgtcttggcaccttcgtgaaaatctgatagactgtaaatgcgagggtttatttctggattctcagttctgttgagttgatgtacgtgcgtattcttattaagaaaatataagctttaaaaaagctttattgagatacaattgacataccatttaaagtgtataatttgataaatttggatattttcgtgaaactatcaacacaatcaagatagttaacatttatatcaccttcaaaagttttctccatcccctttgtcattcctctctcccccattcctgaatagccactgatctattttctgacactatagattagtttgcattttctataatctaatataaatggagtcatacagtatgtattctttttttgcctggcttttttcttagtttgagattcatcattattgttgcatatatcagtagttcagttcttctcatagctcagtagtattttattgtatagatataccatagtttgtgtatctagtcattcattggtggacatttgggtcggttacagttttgactattacaaataaaactgctatgagcattcatatacaattctattcatggaaatttattgtatttattttgggtaaatacctaggagtagaatgttctaatcatatggcgggtgtgggtgtgtttaatttttaaagaaactgccaaactgttttttaccagccacatatgagagtcccagttcctccatatccccaccaacacttaatatggtcagtcttcaaatttcagtcattctaataggtgtgtagggatatgtcattgtggttttaatttgcatttccatattaactagtgatattaagcaccttttcatgtttttatttgccatttatatctgctctttggtgaagtgtgtgttcacattttttactcatgttgggcttggtgattattattattattattttgagacagagtttccctcttgttacccaggctggagtgcagtgtggtgatctcagctcaccgcaacctccacctcccggtttcaagtgattgtcctgcttcagcctcctgagtagctgggattacaggcatgcgccaccacacccagctaattttgtatttttagtggagacggggtttctccatgtttgtcaggctggtctcgaactcccagcttcaggtgatccgcccgccttggcctcccaaagtgctgggattacaggcgtgagccaccgcgcccagccagtgtttattattaatgagctttgaggttacttcatatattctggatagaagtctttattaaatatatgccacacaagattttctcccagtttgtggcttatctctttatcctcttaacagtgttttcaagagcagaaattttacattttgatttaagtttcacaatttgttctttgatggattatacctttactgtcatatctctaatcgtttttaaagtcaaaattgacattatttcatttataattattctactagaatgatttcttaactatagaatattatgatttcttgtttgcatctttgagttttaagattttttgtttaattcaaaagctaaccatgaattaaaatgataaaattgaaacgtaaaaggcattgagtttaagtgcattggtcctggatttaaatttgtatgtttatttttaaattgtatattattttattagattctttagtttatcttcagattttttttaattctaggcttttcaaaataataaggtagttcttgccataattaggtcctactctaagctgtcagaatgttattgttaaagtattgctcctcctaccatttgattaattgggtgcagcacagcaaataaatttcaggaaacagaatctagaaaaaaaggacttgaaagtacatatgctgccacgaagcttctttgcttatagagcttggataggagatttttaaatgttggcctacaggaggaaaattaaaatcccaaaacctgctctgacttgctaattttctaaacattttctaatcttaaattgtgatgaattatttcctcattagagatattttcagtgaataattttcattttcagtatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggtaagactaggtttttttccttttaaaaataatcacatttaagttttacgtattgtttgaatatttaaaacaagctaacttcttagggaagaatcttgggttgatagaaatagcagatgatactactactctgaagctttatgggcatcctaaactcatttgcctaacaagattcaccaattacttgtttagttactatacagtatgctttcttgaaagatttaatataaaagtttttgtgatgatgttagtaatgctttggaatagaagtgttgagccatttaacattacacacctttaggtgcatgatgtatgaaactgcatttaaggcatatgaactaacttatatgccaatttacaaagttaaacatttacttattatagtaatactcatgtattttttccatggtcagtgataccatttaacatacattatgttgtttgagcatttgccctatgttcacattttcccacctttgtttaaactgcagcactgataatattatagtatgactctttagtttctagtgtgaagcatggctcagtggatttgttaagtaggaaaacttctatttataattcagctttagaataatagtaaaatgttagagttgaaacataccttaaagttctagtccaatgccatcattttatagaagaaggaattgaggcccagaggcttgtcaaaaggtgaaaagtaatagagttagaggcatttttctctattcttttatatatcagctctggatgccagattagacatcagccagaatcatattcattctgagttatattgcttgcagagtttgaaggcctttgaatttgagcgggacactaaggaaagcaatgatagcactatgtgtttaggaaggttcccatgttttagaagaaaagagagctgttcagaatgcacaagtgcaggtgagagtaagccattttgattaggaatatgtcttcttttaaaataggtaatgaaaacatccttttaaggtatagaaaatttattatcattctggagccaaactattattatcttcaaagatttcaactctatactcagtgtggatcaaattgaattattagaagagtccctgttcacaaaaaaaaaacaatgtattgaaaaacaggacaactccctaaatacattagactaatggttcaagattatcattcagctagtccagactagcttatttccaactttttggcaactttctctctctttagtctctttttccttcactaagggatcatattctttggtcatatactctaaccacattgcctaaaataattttttttaaacctttgcacattatataccacttcctgattattttagcattcaagtttatttgccatgttgaaaaggggagatagatttttgattgctttcagcattgttaatcttaccagttctctttctttattgggtagcaatgagcagagcaaaccaaagatctgcgggaaaaaaaccacttttgttgcttctccatgcaacactctccaccaaagaacagccagaaaagatggcaggcagtattggttaaaatctggacactactgtgttttatagtcttcttacagatctatctgatgtcaaattttattaaccttttccactgtaattttttctcaaggttgaaataactggatcccagttacattttacatggaatgtaagtgtgtgtgtatttgcacatgtgtgtacacacagtatgtgtgtgttcatatatatatacataatatatgcagggtatgtgtgtatttattggtaagcaactctattcaagaactttctaatcttttgtatgtagagtgtgtgtgtgtgtgtgtgtgtatatatacacactaaagactagaaagttcttaaatagagaaagttgtttatcaacaaatacgtctttcaggtaattcttagaattgagaaagaaagtacaatgataacaatatggtttcactgaaattgtttcattcaggtgtgtgcctgctgtgtgcttgactctaagctaggaatgggaaaacagtgatgagcaggaaatagtctctcaaggggcttaaaatctaatgagagcaattaaataggtgataataacagctatttaataatagaattgtctatattatacttttatgtagatttataatgtcagttccaggattctttcagctaattgaaaatactattttgtagtgatgatttttattggttacctataataataatgatcctttccactgtagaagaagtgtacttaattgttagccagtcatgtccaggaaaaccaaaaattctaaaattaggcaattatggttaacagtgttaataagagataacctgttcattgaagatacattttcttacattattagattcacaggtgtgtacttttacatacattttcactttcctgtaagtctttaatattattgctgtgctgtgcatttttgttttattcatttaaaattaatacataacatacatacaatgaagtgtaccaatcttaagtatactacctgattttttttaacgtttgtatacaccccttaaccatagacagatcaagatatataacttttctagcaccctagaaggttccttcatgctccttcctattccatatcataccaccaccccaagaggtgatcatatggttttaacctatgtcattatagattagttttgcctgttctggaacaacatacaaatggaatcatacagtatacttttgagtcaggccttctctttccttcaacatttgactgtgagattcattcatgttgttatatttaatagtagtttattcttttttattgctatacactattttattgtataactttttattgtatgacttcaatttgcttatctattttcctgttggtggacatttagatttttttcattttttggctatcatgaatgaaactgctatgagagttcttggggcatatctttaggtatatttctcataccttggagtagacttcttgattcataggggtatatgcttaactttagtggatactgatgattttccaaagtgattatttctaccagcaatgggtgaggattccaattatttttaattcttgacagcattttggtattgttagggatgtgtgggtgtgtgggtgttgttgatgttgttcactcttgactgtacttggtattgtgtgtgtgtgcgtctgtgtgtgtgtgtgtgtataggtgttggtgttgtttgattttggggacagtctttctttttttgagagacagggtctcactgtgttgtccaggctgaagtgcaatgactattcacagacacagccattagtatactacagccttgaactccagggctcgggtgatcctcctgcctcagcctcctgaatgaccaggactacaggcacatgccactgcacctggcttagtcattctggtggatctgtagtcccattttctctttagtacacaaaaatcaattaatgaaatctttgggtctaatgaacccattgattcattgatttccactgtctttaacgctgatgtggtatttagaagtagtttgctttgtgtgagttcagtttagactttagccattaagttcagtgatacactgcataacgacatttccgtcagtgatggaccacatatacaactgtggtcccataacatgataatggagctgaataattccttttgcctagtgacatcttgatgatcctgaccctgtgtaggcctaggctaatgtgtgtgttgtctcttagtttataacaaaaaagtttaaaaagttaaaaaaaataaattttttaaaaaatagaaaaatgtttgtagaatacagtataaagaaaatatttttgtgctgctgtacaatgtttatgttttaagatatcttattacaaaagactcaaaaagtttaaaaaattaaaaagtttataaagtaaaagttacagtaagctaaggttgttattgaaggaagaacatttttaaataaatgtagtgtagcctaagtatgcagtgttaaaagtttacagtggtgtgcagtaatgtcctacgccttcacattcattgactactcactcactcactcaccctgaggaacttcaaatcctgcaagctccattcataagtgccctgtgcaagtatactgttttttatcttttatatcatatttttcctgtcccttttctatgtttagattcacaaatacttaaccatcatgttaaaattgccttcagtattcagtgcagtcatatgttgtaaatgtttatagcctagatgtgtagtaggctataccatctaggtttatataagtacactctatgatgtttatacaagaattaagtcgtcagtgacacatttctcagactgtatccccatggtgaactaacatgtgacagtaaatacatgtggctttcactagccttctttagatcacaagcataatctgttctcttatgatttttgatgatcacgctcttcagagtagtgtttttttgggaataaggggaaataggaagagctgtttacatttcctgtagccagagtgaccatgaatcctggtttgaccaaggcagttcttaattcagcaagattattactaacattccctttcgctttcaaaagtgtggtgcttacattacccaatagggggaccaagcaaatcagtcttttagaaaatggaatttggacaaggtaaaaaaaagaaagaaaagaaaaaagccatgtatgactatttgaaatgaggaaataaaagcattagattatttacaaacatactggactccagtatcagttttgacccagtgaaccccattgttgtggaaataagttttatatgggaccaacctttgttattttaagtgttgaccctgggtcttttaaccttttagagctataggccctatcattaaaaggagagtgttaaaatacataactaaagtctttttcaacgctaaaatacagtcttaagcagcagtgagaaagtataagaaggttttctttcttagaatatctttttagcattcattgatcccacctactgagttcttttctggtattacttgctgtttttcttcataccaaaataaatgtatctcttaactggggttggtgggaaggggaagtataagaatgtatagtaggtatttttcaggtgctaatttacctgggtttttttcttttcttttctttttaagtatacatgcagttacttaaccatttaaacacataacctacttttaaggtgattttagtggtgatttaaatcgtaggttgtggccgggtgcagtggctcacacctgtaatcccagcactttgggaggctgaggagggtggatcacgaggtgaggagttcgagaaaagcctgacaaacatagtgaaaccccatctctactaaaaataccaaaattagctgggtgtgatggcacaagcctgtaatcccagctacttgggaggctgaggcaggagaattgcttgaacccaggaggcggaggttgcagtgagccgagaccatgccattgcactccagcctgggtgacagagcaagactccgtctcaaaaaatacatacatacatacatacataaatagtaggttgtaagtaatttatagcctagagaaaagtgttttcttgggcagaataatactcttatttttcacaggagtggaatttttttgtgtcaaattgtaaaatttcagtgaaatgtagaggaattccacctaaaagacttcattgtaattaaaatgcctgcctcaaattacagatttttcacttctttttaataggaaactgagaagaaaagaagaacagaggaagcatataaaaatgcaatgacagaacttaagaaaaaatcccactttggaggaccagattatgaagtatgaatttatattttgatcttagagaaacacatagatcatgtctatcacaaaagtgattttttaataatactcttgtaacctttaaatattctaaatatataattttttcctcagtgtttatgttaattcagtgtatatttcatgatatataaatgccaggcatgctcaaatatatatttcttattgcctacaaagtttaggcttcaaaaggcttagtattaggcctgttcacttgataggacaaatttttatctcccctgtaaagatgatcatttttaatgttatctactttttttttttttttaacataaaagcaaactataaaggaaaaatctgagtactttgcagacaaaaagattttagtctgtactatactgtgagatctttttttttttttttgagaccgagtctcgctgtgtcacccaggctggagtgcagtggcgcgatctcggctcactgcaagctccgcctcccgggttcacgccattctcctgcctcagctgccctagtagctgggactacaggcacccgccaccacgcctggctaatttttttgtatttttagtagagacggggtttcaccatgttagccaggatggtctcgatctcctgacctcgtgatccgcccgcctcagcctcccaaagtgctggcattacaggcgtgagccaccccgcccggcctactgtgagatcttatccatagctgaacataaaactgttctaattgtctttgtttgaaaatgtctgaaaccagcttttttctccttgtgtttatttgttaagcaggtaataaaatctccttcacatgtatatacacacatacattaaaatcttataagctttctatattaagagaaaaaaatgtgtaagaaatatatttggtaattgccattaaacaatgttgaggctagcgcactggctcacatctgtaatcccagcactttgagaggccaaggcaggaggattgcttgaggccaggagttcaagaccaacctggacagcatagcaagacttcatctctataaaataaaataacaaaaattatctgggtatagtggcacatgcctgtagtcccagctactgaggagcccaagactgcagtgagctacgattgcaccactccactccaggctgggtgacagagcgagactttgtctctttaaaaaaaaaaaaaaaacgtgttggccagcacggtggttcacacctgtaatctcagcactttgggaggctgaggcggggggatcacaaggtcaagagctcgagaccagcctggccaatatggtgaaaccccgtctctactaaaaaaatgcaaaaattagccgggcgtggttgtgagtgcctgttgtcccagctactcgggaggctgaggcaggagaatcacttgaacccgggaggcagaggttgcagtgagctgagatcgtgccactgcgctccagcctgggcaacagagcgagactccgtctcaaaaaaaaaagtgttgatatttctgaaatgagcagtttaaaaatggggtatcaaggagtaccactgaggtggaacagaagaataaaatagttgtagttatatttatgaaaacagaagaattttttcttgctacttttgctctagaaaggaaaactaaacagctgctctgctgttgctgaatttttttgcattggaatcaatttccaactgtgagagtgcattctgatgagacttaaattgtaatatttttaaattattctcaatttatcccttctaaaatgtattaaaattacataattagctatcctctgaggttttaatatgaggtattataatgatgatttttgttttgaaactaaacaaattattttgctattttagaattattattttggaagaaataccaactttttaaagtaccttattttttaatattataaataaaatgtatattcattataggaagattgtacaaaaattcaaataagccaataaagcccatgttttaaatttaacaatatatggtacagtttatcatctaccagcagtatgtaagtataatttgtgtacatatttatctctgcttccatcaacacaggttttgttttttttttcctaggggtagaggacaggggtggagggaagaggggccttgtgctaggtacatgcatttactagtttcaaagccaaaaaattgctttatgtatgtaattgagcattttaaaaattatgtttatcagatattcatgtttcttttttttttattttattttacattggaagtacacatgcatgtttgttacatgagtatattgtgtactggcagagattgggcttctagtgtgccccttacccaaatagtgaacattataccaaatagctaattttttaactctcacccctccctcccaaccttcctccttttagagtccctacatttccatctttatgtctgtgtgtacctattatttagctcccactcataaatgagaacatgcagtatttgactttctgtttgtgagttaatttgttctgggaccaaactgaggttcgggctgctatttctcacggcccaataacgagatgcagatgaactggggaggaagagagttatttctgtaactggttacagggagaaggtctgaacatcatcaccagaccaactccaaattacaaagttttccagagcttatataccttctaagctatatgtctacctgtaagtgtgcattcacctaaagacataagttactaacttcttttaatctataactaaggtctgagtcctgaagaccttcctttggagcctcagtaaagtgctagagtgattacccttatcgtgtctcctactatatcacataggtttgaggagttccttcagacccctaatacacttgtttgtggaggactggggagtttcttcagacccccagtaaaacttgtttaatcctaaatggctcctattaagaattccttcattattgaagaaacaaggagttgttcaatgggaacagagtttcagttttgtaagatgaaaaagttctagagatcttttacattgcaatgtgcatatacagtaattaacactattgtactatacacttaaaaattgttaagatggtcaattttatgttttttttttttaccataataaaaaaaaaacaattgtgccaaaaaaaaaaaaaaaagaattccttcattattttatcacgctttaaggcccaggaaaggcctaggcaaaactcttgatgggcttttgttacatcccagcctttgtataagggcactggcttttaatatttaacttaaacattcagtcagtactgaaatggttgtttagtgagacctggcctgtgacaagttcactttggataatggcctccagctccatccatgttgctgcaaagaatatgatttcattcttttttatggctgccacgtttcttttttacgattaacttggccatgtcctttggttgttttcttattcgttttttttgtttgtttgtttgtttgggttttttttccctattgatttagaagatgtatagaatttgcctttttttttttttaatttttttccttcgtaccttaaaaaagtttggtagattttgacatataaaagttttaaaccttcgtgtaattaactcctcagtcctttgatccacttttctccacatttggtatcatgcttagaagggcattttctattttaaataatcatattttctaattttttattttccaatggtctcttctaaatatattaatacatctggagtttttaaaataatgatacaatatagaaacctattttattccactagcatttgttgaataaacatcctttattcacctatttgaaatgcactttactctttcttagtgaagaaactggttaagggtactctaattattttttttctcactaagttaaattaaatatacaattctttagataaactgggaactgtttttacacttccccttcttttggagttttgaaccatctatcttttcttgtaacaatattatagtcgtatgggttttagacacttaattcaaactatgactctttttggttataatcagacattcatgatgttctaattataaaaaagttctaagtgtttctgacttctgtagcctcagaaattactttataatcttaaatttattccttaagacttaccataatgtggctgggtgtggtggctcacatctgtaataccaacactttgggaggccgaggcgggcagatcacctgaggtcaggagttcaagagcagcctggccaacatggtgaaacgccctctctactaaaaatacaaaaattagctgtattaggcatggtggtgtgcacctgtagtcccatctactcgggagtctgaggcaggagaattgcttgaaccggcaggcggaagctgcagtgagccaagacctcgctactgcactccagcctgggcaaccaactgagactccatctcaaaaaaaaaaaaaaaagacttaccataatgtagggcactacactaggcttggagaatacaacaagaaacaaggcttataaggatcctgcctaagggccctacctgaatgcataatgggaacaaaggctaatagacagttatcataatgtatgtcatgaaacacttttaatgcagggaaggtgttgaatcagagatgtcttcccggagggaaagaacctcttaggaggaaagaacctcttagcagaaaccttaagaatgagtaaattgagtaaagagtgttttccagtagtcagaagcaaaataatatttttcctcaggggaactgaaagtaattctctttggaaggtagagcctccacaaattgagaggaaagaatggttaagagactgactggaaagatcaacaagaattagttcagatcctgagacaataggttttaatcaagaaaatgacattttcacatttgcagttcagaaaagtcattctccctgcagtaggaagaatggattgaaagtaacaattgtgactgggcacttggacactttttgtataatatagatgagagttgaaggtggcctaaattagagtcaaagcaggaggaatagagaggcactgacaaattagatacagtaatcccattgtatcagtggttgggggggatacattacaagacccccccccccccagtaactgcagatagtactgaaccctatatacactgttttttcctatatgtgctatgttttttcctatatgtatgtacctgtgataaagtttaatttttattttaacaataataaaatagaacaattatagtactgtattatagtaaaaagttatatgaatgtagtctctttctctctcaaaatatcttattgtatataaaccacataaatcaaaaccacagatgggggagactattgtatttggaaagtagaattgaagggtgtgatgattgaatgagggaaaaggaaggaatccaagattaggcccaggtttctgcagatacgtgtggagatagaagaggaggtttcagacacgttgcaattgaggtgagtcatatgaggaagtcttctatattagatacaaagatctgacccttagaagagagatggtctggctgtgaatttaggagtcatcaaaggatgactgaagcgttggatataagtaagaatgctgtgggtagagcaagtatggaaccctgaggaacaccaacatttaaaggataggcagagaaggggaaacctacaaaggagccccataagagtgcttagagagggagaggggaatttaggaatctaagggtagagaactcttcaaggagagttgttaacataagaaatgctattctaagggggcagataagtagctcctgcccttagtaagcatgatgagataaaagggttttttttaaagtcccttttaataaagaaaattttatgccaattcctttagttcctctcccaaaggtttaccattaaaggaaaaaccatttcatttggcaaaatagaatttttgttgttgttgttgttgttgttgtttgagactgagtcttgctctaccacccaggctggagtgcagtggtgcgatcttggctcactgcaacctctgcaacttccgcctcccaggttcaagcaattattgtgcctcctcctcctgagtactaggtttatagacgtgctccaccacacccactgatttttgtatttttgatagagacaggttttcgtcatgttggcctggctagtccagagctcctggcctcatgtgatctcccctccttggtctcccagagtgctgggtttataggcatgagccaccatacttggccagaatttttaaatgctgtagttttcaattagactcctgaggctctgacatgattgcttaaggactagaaatccacatgtactaaatcactgtagattgaatgaatattaatattttttaaatgtagatgtggttaaatagtatttaaaatcattagaaaatatgcttgagtttggatattttgtgttttctctgatcaacagagagcaaagttgtcctgctgtcattttactgtctttgaaatgttttgattttgtaaagagaatcctgcaggaggaaggcctctagggtgttgttactattttttcatgaccctcttgtcccagatggtcattagatggtatattcactttgtgatgcttcactaagatatgcactgttctgtatgtttgttgtatctgaatagaaagttgtttttttttttttttttttttttatgaagtaggttgtaggggactgagtcctcataaccctaaaagaagaactccattaagtcaacatttcttatatgccaaatgacaagaacgtgaccccatacctcccacccttccagtgtagttccaggttatggtggggataggacgatgttgctagatactttttaatggactaatgatgacttggggttatgagtttaactgggaagatttcaccaattgttcatgtgtcttattttatatattttaacatttaagaaatgctaaacccaagcctaccttttagtctctacttttatcataatacaaagctgttgttccacttacttggttcatcacagcaggaacatatgttgattgtttacattttgttattgttctttgtatgtttatcttctgatgcagctgaggttccacttgcatgggaatcacttgagggaattattaaacatgtatattccaaggttccactgaagacctactaagaaataatttttggccatggaggcctgggaattttcattgtaagaagtctcccacacaattccccaagtgattgatggccattattctgccatctagccagactatcaagcatcaactcaacttttatttccccatgaaacaattacctgtgcttaggaagatccgcctctgaatgcctagccgtacttattagctatagttcttgtgcaaatttttacttacctcattgcaattttatatctctgttgtctctgtcataagtctcaactctgctactaaagaagccctagataatatatagctgaatgagcatcactgttttccagtaaaactttatggacaccaaacttttaatttcaagtaattcacacatgtcatattattacttttattttttccagccatttaaaaatgaaattcttagctcacaggctgtacaaaagtaggcagcagactggatttggcccttgggccatagtttttgccaatctctgctctagactattatcccaacacaatattggtcaatatacagtaagtaaatatatgagtactgagtgaattaattgtaacactcgtgattttacacagagcatgcatatgatctagtatactgactgctttgtaaatatgtgttcaataaatgtttattaggtcaattttcaaactcaagttaataccagagttatcagagttttctgtttctttaaataaactgcttttttctccactgtgtgttggaataggaaggccctaacagtctgattaatgaagaagagttctttgatgctgttgaagctgctcttgacagacaagataaaatagaagaacaggtatatctattattgaaaattctaagctgaaatttattttaacactataggcattccttggtgtatattatttcatgtaaatagaatttgaacattgtgaacttaataacctagaagcttaactgtgaatacattgagtcacaaatgtaaaataatctttttttttttttttgagacagagtctcgctctgttgcccaggctagaatgcagtggcgcgatctcggcttactgcaacttccacctcctgggttcaagcgattcttctgcctcagcctcccgagtagctgggactacaggtgcgcgccaccgtgcctgactaaatttttttgtgtttttagtagagacggggttttaccatattggccaggctggtctcgaactccagagctcatgatccacccgcctcagcctcccaaagtgctgggattgattacaggcatgagccatggtactggccgtaaaataatctttataagtcagttcctttatatgtgaatttccaagcaatagaaagaaaaccaataattgttaaaaggaaccatgcgtaattaacatgaacttaaatagaaatgctctttttgcttatttccctttaagtgtccagcttaaaacattcttttaatataaagcatatatttagtctaagtaaaaagcttctttgaatttttcttcaccaagtatgatatgaaaaggaagatgaccaaaaacttaaggtttttcatctatattagtattgtttttattaacccctttattaccttcactacttcaccttcagtttctttctcacttttgctttgttcagtgttttgtcatcattattgagtgtatagcagttacacccagctgctgtggaaattgaagaaaagtatttcttaaacccattaactagcttcaagattaatttgatactttgtcttctttaatttggcaacagtacagttaccatacgttacaactagatggtacttaaggatgaattttgttatttcctccccttgtttaagctatgctagttatggtggaagcttaacctttttggggggcaagtattaataaactgtggctacagagtatcttgccaaataatcatgtatgtgtcagttttatactacaaatgaatttgcatagaaaagttggcttgttcgtttcttatcattgctaagacagtcatggctattatgctcttattggtctacctaagggtaaatcacctgcagtagtaactgcttctcatgtgtatctttcgttatttttttaaaaattactgataaaaagttcatgtcacattaatttgtaaagcttattgctcattttttttatacccaaaagatgctatgtaccactcaagaagagtgggaacttttagttcctaaatgggctctacttttggaaacctaaagtactacctgaagtagcattatttatttgtttcccttagttttttgtctaggatgtgctgttttgggaaaaagtagtgaatgagtcaagacacctcagtcttactcttagttttacctctaactaactttgtagctatgaacttatcactgaattctctgggccttggttttctaatctgtgaaacaaaggagacaagatgattcaaaacatctcttctctctaaaatgctactctactgaatatcagtatggtgattgagttgggtttgagagaattgatgaacccttccgtaagctttagaaaaagaaatattcatggggccatccaatcaacttcattctattcttgacactgtactagatgctctgcaaaatagtcattgaacagagcattgtttttcttgcctaagagccaggcatgttgatatgacagagatacagtgtggtaatactctatagagtagtgagagcttcagtaatccataaaatcagttccatagatttagatcatttccctcttcatattcagtgtatattgcacagatctctcaacaacacagccattaaatagatattctccaagtgacacttacatcacacatgtttgagtttacgttacttgcaaacatagggaaagaaagatacatgggataaactggtgcatgagaaatgagatcttagcagttggttgaaataaatgagaacaactgaggcaaactaaagaggaagaagggcaagtggcagcttaacaggagtaagatgatgagatgaagggcagaataccttcatggagaggaggcaaagagatatacatgatatgttcttaggaacataactgaagcaaacaatgatattatttctaattatatataaacctgtgagtcagccttccaggggcggcctgctaaggtagaatcattggaatgatttggccagggtttggataggagagaattggcagcagcgttaagattgacccatgataaataatgctatgcaggtagcagggagtctgactaggagcaaaatcaacgaacttatcccttgcctaacatagtatctgtggagtcagaaagaagaggttaaattgggatatctgaggcaagtatcaggatttgccatgtctgcggagtagtttcataattctaatggttataagcactaaggcgttcactaagtgaatgttggtagttccaggttatattatccattcttgagttacaaaatacactttaaaaccttcccatcttaatattatatgtttttttagtcacagagtgaaaaggtgagattacattggcctacatccttgccctctggagatgccttttcttctgtggggacacatagatttgtccaaaaggtaagctaatgtcagagtttactaaaagtacaccttgtattgttcttcattgttggtggaaatatcttttatttgagacggagtctcactctgtcaccagagtggagtgcagtggcgcgatctcggctcactacagtctccacctcccgggttcaagagattctcgtgcctcagcctccctggtagctgggattacaggcatgtaccaccacacccagctaatttttgtatttttaatggagacagtttcaccatggccaggatggtcttgatctcctgaccttgtgatccacccacctcagcctcccagagtgctgggattacaggcgtgagccaccatgcccagccggaaatatcttgtagtatataagttttctccccttttcattaatttaagtaatgagactgtttttggttttatatattgtattccatatacatcctccaaaacagttagaaattttgttctgaaaataaagttctttcatttttatttaaggggaaagttgggggtgggcaaataaggagtggctagtccaaaatagttaaccagaagtatatccagttatactaaatctctctcttctttggggttaaatggtattactttgtattattggaagcactacattcttttttggaatgattttggaacataatacataataggtgcatgaagtcagcagttgctgctgtgcttgtttcatatagtgctttgttttctcttccctttatcttgtgtttggaagttggtactgaatgctctgttgtgcctttgttctgattacttggttttttctttgtctgtctctggtagccctatagtcgctcttcctccatgtcttccattgatctagtcagtgcctctgatgatgttcacagattcagctcccaggtactgtatgaatgtatagagtggacttgagtctttctgtgctatatttcagcctgctttcccagttcctagaaatcttttggttaggccactgattttagttttgaattttaaatagtaacattaagcattaaaaaggtcttccttgtctactaaatagttcctctgtcaggtttgcatgtgtcctttactattcacagcttggaattttgtcatataggaggtactccagaaagattttcaaactgaattgaaacaaatagaagatactgggttttgtatatcatgtaatatctgtttcttcagtcaggatttagcagttttgatggacgtggtctatatgatatgttatagcagaaaagcagattttaacagtctcacttttaagctaaagtatctccaaattatattcaacaaggaaatcactttttaataatatgtttcatttccattataatactaagctctattgagcagattgtgttttccttatgcaaattacctttggatattataaatgaatatttctgttcatatgctaaatctatggaaatttgttttaatttttagcattggtaagggtttaggaatttaagacaggaagctggatgcttgcggtctctaaagtctgtaccctcaaaataaaatcagattaccattggaagaagttttttttagtgtcagcgttagttctttttttaattttcttaatcttcacatctttgccattcaactttttatctttctggtgattgcattttattggactagattatattatgttaatcttatattaaagacctgagcactctggtcagaatgactcagtttaaaccctggttaggtgtatgatcccagtaagttttctaacttttttgtgcttcatttttatgatttagctagaacctgacacataataagtgctcaataaatgttaccttgtattgctattataacataatttctttgagctaataaaagttatctacatcattattttttcctctgtgagagtattgctataaaagtttttaaaagtcatagtttaaagagatttctattatttttatgtttataaataaagtttacattagtttttaacctgcaatagagaagaatattaagactttaatttttctgacttgtacagcgtttttctccttgaatactcttaagaaaaagatttagcaattctggatcagaaatcatccataaccaaatataccacagtatattttaccttttgcttgtccatttatgcatttttttttaattttacttatttattttcgagacagggtcttgctctgttgcccaggctggagtgcagtggcacgatctgggctcactgcaacctccatctcccaggttcaagcaattctcctgcctcagcctcccaagtagctgggattacaggcacgcaccactatgcccagctaatttttgtattcttagtaaagacgggttttcaccatgttggccaggctggtctagcactcctgacctcgtgatctgcccacctcggcctcccaaagtgctgggattacaggtgtgagccaccatgcccggccctgcgtatgtttttaaaaagagactcatattcataatgaatctgtgacaaaactacataatactgggagactttggtttattgtgctaagctccacattgcattaaaatcatatcacagactaatcaaaaatgcaggaatacataggctataaatgaaagaaaatataatgacagcaaagaaagaatgtaagccagtaataaagaatgcctaagaattaggggttcagaacccaaaccagggccctcactgtagtgctgtagaacagctgaattgcttttaagtccaggtaactatatcactgagaagcaggtgcctatatttttacaaaattttgctgacagcttacttcttcgtaatattaataaccttttgtaaaactcatgtatgtaacttgagagaaatcttgctggatttttttctctaatatatggtgctcatgattgatcagatcctgttttagcctttgattatgtactgttttatatgccagaagaggtaaaaatgaagaaaataacattaaggtcttcaagtatttgttgtccttgctaaagcattagttgtcattagcagacgtggactctagcaattcactgttgtaattaaattgtgtgccttatgttcagcagttcctttataatagatgactaattcccaattgataagattttttgtttcagaggatgttacactgccttatcagccattatcaaaggatctagcaagttgattctgtatagtcacacttgagaatatagcattggatgtagatctggagttaatattagttgagaaacattgtgttatctggaaaactcttccagttcaacacagtgtaaaattatagtagtgactatacagtagtgttacattttacagttctcacaccctatagagacttttgtattaagcaaaataagaggctcaaaggttattcattaacattagaaacacttatgttatattacattgcatcggtcttttctgttttttgttttttttttttttttgagacggagtttcgcttttgttgcccaggctggagtgcaatggtacgatcttggctcactgcaccctctgccccctggattcaagcgattctcttgcctcagccacctgagtagctgggattacaggcacctgccaccacacccagctaattttttttcatttttagtagagatggggtttcaccatgttggccaggctggtctcgaactcctgacctcaggtgatctgcccgcctcggcctcccaaagtgctgggattacaggcatgagccgccacacctggcctacatcgttcttaatacacaaatatacatcagttactccacagcgcttgatatgggaggtaaccaaattctttgttttataatatcttcataattaattaaaaaactaagtcgacatttttaatcacctttaataatttgccaaaatattatataagcataatataatcaattcttacttactccaacaaattttaaaagtccagatacagataccatatctagtttcttgatcatttatatcagctcccatacagaagccttctaaatctctggtaatttcactttgctgtttatataagtgttggctcatgactaccttgttcttcttgaaatgatgttttatagccttgaattggctgaaataatcaagtgtacaattgagagatgccctgaaaacagcttaaaataaaatatgtacatctactaggaaattagtaccaacacatgaatctgtctgatgggcagatattaggaatgaagtcactccagatctgagaaattaaagttgtaaaggactgcaagttctgtgtttttgttgttgttgttgttgttgttgttgtttgttttttcatttttgttttttgggtttttttgagacagagtctcattctgtcacccaggctgtagtgcagtggcacgatctcaactcactgcaacctccgtctcccaggttcaagcgattctcctgtctcagctgggattacaggcacacgctatcacacccagctaatttttgtatttttagtagagacagggtttcaccatgttagccaggctggtctcgaactcctgacctcaagtgatctgcccgtctcggcctcccaaagtgctgggattacaggcctgagacaccatgcccagcattttttttttttttttttttttttgtaaagagacaaggtttcacttgtccaggccaagtgcagtggcatgatcatagctctgtaacctgacctctgacctctgacttcctggacacaagtgatcctcctgtctctcagcctcccaagtagctgggactacaggcattccaccacacccaactaattgtttttattttttgtagagacagggccttgctatgttgcccaggctggcaagttcttgaaataatggctgtggccacaaactagaaaataattttcaggtgtacagagaatagaaagaatttagattcataaattgatcattttgttcacagttatttgcataacacagttcacatttaaaggtgtcaccttagaaatcaaaggggaagaacatcatcctctattgaaaaagaaagaaatcaaaggatgtacagtgaatttgcagcttaatctatggggagcatcattgcaaaaaatggttctgtgtgaggctctttcccaccctttgtccataggagcacattattgttgtagtaattatttcacccctctccctttttcagtgtacaagtgatacatgctaattttaacagaacttgaaagtagaataaaattaaaataatagtttactaatattccatttatcttctctcatatatatgagataaatattaaggtgtatgtacttatccatatgtgcctgattttttaaaatccttgtatatgcatctttgcacccttatctaattatttccttagaatatattcctagaagcataattgtgggaacaaaggccatgaacattttcaagtgtttattttattattttattttatttttattaattttgatacagggttttgctttgttccccagactggagtgcagtggtgagatcaccactcactgcaccttgacctcctggactcaagcgatccacctgcctcagtctcctcagtagcgggggctaaggactacaggcacatgccatcatgcccagctaatttttttatttgtagcagagacgaggtctcactgtgttgcccaggctgctattttatttattttttaagagatagggtctcattctgtcttccaggctagaatgcagtggcacaatcatagctcactgcaacctcaagcgatctttgcctcagcctgagtagctgggactacaggcatgggccaccactctcagctaatttttttttcaattttttattttttgtagatatgggggtctcactgtgttgcctaggctggtcttgaacccctagcctaaagtgatcttcccacctcagcctcccaaagtgctaggattacaggccacaggcctcagccaagttttaaaaatttttactgccaaactcttcattagaaaagttgaaccagcttacattcccaggccagttttctattgatatagtagcactgaatattataattcagttaacttttgtcaatacggtaggctaaaagtgctatgttcttagccatctctcttttgggttaacagtgcactattttgttattaataattattctatctaacaagccccctctatggttttgtggctttgtagtaagcatagttgtatttccttttttgaggtggagtcttgctatgttgcccaggctggagtgcagtggcgcgatctcggctcactgcaccctccgcctcccgggttcaagtgattctcctgcctcagactcctgagtatctgggactacaggcatgcaccaccacgcccagctaattttttatatttttagtagagaggggagttcaccgtgttagccgggatggtctctatctcttgacctcgtggtccgcgtgcctcagcctcccaaaatgctgtgattacaggcatgagccaccctgcctggccaacatttcttttacatgcataaaagagatctgagctgtttttgagcccttctagactttcttttttttttttttttttttttttttttttttttttttttttaagtagatgaggtcttgctatgttgccgagacttaacctcaaactcctaggcccaagcaatcctcccaagctgctgggactacaggcatgaaccaccatgcccaacttagacttttattgtactatcaaaaggcaattttcttttcaaatttctgggtaatagtgttagaaaaatcctacttggtaacatccagaaatggcatcatactgagtgattcaaatgtgagatggaagaaaaggttagaattggagtgaacgtcccctcttatctcaaatgtattttatctccattttgtttcatagtttattagtttgaagatgctttgaatgtcacctaatcattttcaactctaggtccagaaaaatcaagggcatgatttctgaaattacacttagcctaattaaaacttagaaacactgttcaccttcttcaatgtttttgactgagtctttttcatttataagtgacaggaggtgttactataacattatttcctagaatgtcaaattttgagcctaatagcatggtaaatttggctatatttgttgttttttgtttttgttttttttttaatgaaacttagtatttccttgtttcccacttcttttttttttttttttttttttttttttgagacggagtctctctctgtcatccaggctggagtgcaatggcgtgatcttggctcactgccacctccgcctcgcaggttcacgctattctcctttcacagcctcctgagtagctgggactacaggcacccaccaccacgcccggccaatttttttgtatttttagtagagacggggttttaccatgttaggcaggatggtctcgaactcctgaccttgtgatctgcccgcctcagcctcccaaagtgctgggattacaggcgtgagccaccgcacctggcctcccacttctttttaatatgtcgtgtcataactgaacagtaaagtgagcagattatcaggttaaatctgaagtgtcagtctggtcaccagtgcccaagttactgcccctatggtaatattggttactttgtattttcctacagcaaacataaaatttgttatagtgagatttttacctgtatacctctcttaactttaatgttattacctcaaggaagatattatcatgaatgaagattccatgatgaaagttttgcagagtttattgcagtaatttagtacttcattagaatctttagttttttaggagcacagtactgaatgtttgtttctttgttggaccttttgaaaaccggttttccattgatgcagtgtagctgttacaggaatatcatttttaaaacgtttttatacagcatggctgaaaattgaacctgggcctccctcgtggcctaccattgaaggaacagcattttttgcctatctagaaagacaatgttaaatgtgctatctatatattttttaacttgtgctacctactacgcgtttatatttgtggaatctgttttcttttggacaaaaccacaaatcaaaaacacctcatttcttaggcatttgaaatccctaattcagaataatctcccaaacagaaacacaactacctgcattctttttgacaaaagagctaagtagcattagaaaattattttaaacccaattctgttttttaacagaataaaattcttctgttcttcacattcttctttcataggtaacctattgaaagtagggtttatttgggggaagcatttctttctgtctcttatctcataataaatacaggtgtgcttaactactagtttcctacctcaaagatatactcaaatctaaagatgtttaagattttgggatctgaagagtaaacatttctcctaatcacaatgtgacagagacaaatgaatcaagccaatgctacttttatttatgcatactaactggaacttttctttttggaaatcagatacattttgtatgtattagtaatttggaatcctgcattggttatcctcgccctcccaaagcagattctgaaattataaaggtgcacaggttctccatgcaacaccaaaagttatattttccaaggctttgtaaaattgtagaatgtcctgttaaatttctgtcaaatcagtaactcacactgttttgagaattatgaataaaggaataaaatattgttagtgtttatttagtacaaaagtagattatagaatctcagcatttttgtcaaaaaatttctttttgatgattgacagatcaggagacacttaaggccatacctgctttcagtaatcaaaaatgcatttaagatccagaaacttgaggtagcagaacatcactatcacatataacatatcctttggtatagaaaattatattcccagagtgagtttcttttttaaaaccattaatgaggccaaggtgggaagatcacttgggaccaggagttcaagaccagcctgggccagatggcgagaccctgtctctacaaaaaattaactggatgtggtggtgcactcctgtagtcccacctactcagaggctgaggcaggaggatcccttgagcccaggaaattgtagtggcagtgagctatgatcatactactgtactgcagtctgggccacgaagtgagaccgtgtctcttaaaaaaaaaaaaatgttaggcatggtggcacaggcatatagttttagctacttaggaggctgaggcaggaggatcacttgagcccagaagttcaagattacagtgagttatgattgtgccgctgcactccaacctgggtgacaaaataaccctgtctctggcgggtaggggggaagttgattatttactttgaaatatgttcaaaactgattcctgttctatattcctaatgaacagaatagactttatataaaacaaatagttaaacttaaggataaaattttaatggaagtataatatatatatcttccagctcttctgtcttctaatgtatttattacagaaaatgaaattactttgtttccgcaatctttgtatcacttcagttctccaataaatctgagaattctggtagtgtgaaatattcagctttctttgcttatttacataaaatgtataaggacaatttgtgataattaagagttacatttaaatatcaggaaaaagttataaatttaaattaaaaaattttaaaaggaaattattagaaattttaaaagaatgaactaaaaggtgattatatgtaaatgcttgcatatatgaatattagcattgtccccaaaataatttagaacaaagaaattggaatcaaataaataaaggtttgattatttttaaattggcttatattccatgataaaagagaggtttatcagtggcataagaaaggtttttcaccttttttgtattgaaatctttgacatatacatatatatctttgctcatctttgtgtatctttgctcgtatgagagcaaagatataggcaaagatatgctctctctctctatgtctttgttcataccagaccttcctgatatctccacataatcttaaatataggaacattagactggatgatctctgtgccccctttatctctactcttccattattttatactttaacacatcatctctgttttatgatatagaatggaatatttcttttttcctgaaaatgcttattttggtcacttgatacacattaggccaatatgtgttacttgagtgacccatcttccttcttttcatttctgtctcctgtcattaacctggatatctggaatgtggactaaactcttcaaacactatgtaaaacctactaacctttgtgcatttggttgctcagctactaagagcaccatttctgaactgaagttaactgaagaccattctgttttagagattatgacataccttttggattctcatgcctttttcctcccttctcaaggttgaagagatggtgcagaaccacatgacttactcattacaggatgtaggcggagatgccaattggcagttggttgtagaagaaggagaaatgaaggtaattccccctgaaatgttatagattgccaaaggcgtctctgtttcagtcatattatcattactattgatatgaataaggatagcactttcaacttacctttaaaacaaattattacatgtgatcaaagcagtaccatatattgagcaataaaatgtctttttgcttttctggctttgcctttactaaaggtttttatgattataatataaatatatgattaaacctttctgttttgactaggccatgaagaaaataaaatttagagaattagatatgaccaggtcacaattagctgatggtcctgtatttggatatttccttttgttttgtttttttaacatactgaatgttgtgcctagatgacactttgtttctctccctttttggtctataccctccttcttttcccttctcttactgcacctttatttgatatttggacattggtcagttaatcttgtttacatccctaaacacaaggacagaaaataagagcagggactgagagatacagagatggattgaaaagcaaaagcaacattgaattttggattttctcattcctaaggaactatgctaaataaagatacaaagataataagacactctccaagctaaagctttagttaaggaaaaagaatattgacatttaaaagatactattggccaggcacagtggctatgcctgtaatcccagcacttttaggaggacatggcaggcggattacttgagctcaggagttcaagtcaaacctgggcaacacggtgaaaccccgtctctaccaaaaatacaaaaattagctgggtgcagtaccacacacttgtagtcccagctacccaggaggctgaggcaaaagattccttgagccagggaggtcaaggctgcaatgagccgcgtttgtgccactgcactctagcctgggtcacaaagtgagaccctgtgtgagatatatatatatatatatatatatatatatatatatatgcatgcatgctatacttggctccatctgataatgtactgagtgaagagtacagatgagtggtggagaaaatcagaaaagaaagatctctgtgatttgaaacaattagattgttttacaatgcagagaagcatttgaactacatctggaattaaaaagaaagttgtgacaagggtgaggtgagggcattttaggaaaaaaattataatgtgagcaaaaacttgaaagcaaactttttagtcaggatttttgtataatactatgttgaccagaattattctagcaaataaggatataatatttagatgctgggattcctctccctgaataaggacaaagtaagaaatgagataaaagaaggacagataaatgagatatccagaatgttagctataattctgataaggtgattgtagaaaatagtttgagatcagctgctacagggtcttgttactccagaattaagcatgttcctggcattgctggataatcacaaaccttcactacagaagcaggccaggatgtatgctcttcgcggaagaaagggttgagccagacctgccttatttcttcttctgtagtcatcgttcagtcaccgtagagtcacctccctctggggaggaggaagtgaagtactaaagagaagccaggagtgatggtctggatgacgtccctctacctggaatgaggaatagaaaataactactcctacagcccacagtgttagagagaaattgggcctagataatgggaagcataaagttactctctaaagagaacaatcgttgtctataacaattgtctacaacagtagactagccactgtatgaaaagtatctttttttttttttcttttttttgagacagagttttgctcttgtcacccaggctggagtgcaatggcatgatcttggcttatcgcagcctccgcctcctgggttcaagtgattctcctgcctcagcctcccaggtagctgggattacaggcacccgccactacgctgggttaatttttgtatttttagtagaaatggggtttcaccttgttggctaggctggtcttgaactcctgacctcaggtgatccgcccgcctcggcctcccaaagtgctgggataacaggtgtgagccactgcgcctggcctgaaaagtgtaattttaagaagatcaagctgatagggaagaaactggagaacaagcagactacttaaaagagtcaggcacaaagtgatgaaagcctacctagaacagtagaaaagtcaaactgttggatgtcttagcgaagacattttagacaaaaaataataatgtgagctagaggcctccctgctctgcacctttggcaccacatctaggaactgccagtgccatggtgtcaatagattcctgcctcacccctaatcatctcttctatgctttattaagaacagtttttgactggtggcagtggctcatacctgtaatcccagcactttgggaggccaaggcgggcagatcatctgaggtcagaagtttgagaccagcttggccaacatggtgaaaccctgtctctactaaaaataccaaaaattagctgggcgtagtggcaggcgcctgtaatcccagctactcaggaagccgagacaggagaatcgcttgaacctgggaggcggaggttgcagtgagccgagacggcgccattgcactccagcctgggcaacaatagcgaaactctgtctcaaaaaacaaaaaagaatagtaaagagcttactagctgtgtgaactgtaaagggaggaatcaaaagtctagagtttctagtttgggtagctgggaaaacggtggtcccaataatatgagtaataaataggtaggggaaggtagtctgttgagagatactctaagaaaatctatgtgaaatgcctaacagtgtccagccccataggtccttcataaattggcacttggttctcccccatgatgacatgtttcatttctcaagagtatttatcacataattatctaaagtagcaaactctataattttaaaataattaattttacttagcatttaaggtatgtaacctcagtatttaaagcaagatagatctgtatttacgtttttgccatcttagctttcagccattgatttaacaaataactgagtgcctattgtgtttcatatactattctagctgttggggatacagcattgaacaaagcagacttaatttagtatctttaaggagaatatattctagccaggtttatttggttttcttagccatgttaaacagtcttttgagaatggtaaataatgcctaattcaaattgatacatttatttttaaacaactcacaataagtcatttatcacatatgcatgtttttatctgaggtttaccttggatttataattttaagtacttttttgtctgttaatttgaaatttttaattttcttttagcagaatatgttctataaatagactttcataaaaatctaaagagcagctgtattaaaagcatgctttcctgcttttatgggcttgatttttaattttcaaacagttttggaattatgttctctttaggtatacagaagagaagtagaagaaaatgggattgttctggatcctttaaaagctacccatgcagttaaaggcgtcacaggacatgaagtctgcaattatttctggaatgttgacgttcgcaatgactgggaaagtaagctgtcattattaatatattttaatctattattttgaatttaatatcaaatccaacctagttttctgcatctcctacatagtttacaaagtcaacgtagaaagtatttggaaaatcatatagaggactagcaatacatttatgtagagcttttcagtgtatgaaatgcttcctagtatgtaatttgatccaataacctcagtaatcctacagtgataggtaggtattattgcttattttacatacaaataaagtaaaattcagataggcaaagtgacttgtcaaaggcaacaagagctatatggtggagaagccaagactgaaattgaagatttctgtttcatcatctactctttcctaaactgtttccgtggtaaatcctaggtgaatccttttgtgattactttagaattattttatttttttagacagagtttcgctcttgtcacacaggctggagtgcagtggtatgatctcagctcgctgcaacctttacctccccagttcaagtgattcttctgcctcagcctcccaagtaactgggattacaggcgcacaccatcacgcccagctaatttttgtatttttagtagagacggggttttgccgtgttggtcaggctggtctcgaactcctgacctcaggtgttccacctgccttggcctcccaaagtgctgggattacagatgtgagccactgcacccagcctagagttattcttagtgtgtattccccttagacacaaaatttcctaagtatagatacttctcaacatcatcagatgtttatcattggcagtttgacatctctttttcacagaaatagccacctaagattagatataacaatttatttaacatcaataaattggggaaaagggaagggttttagtgttagggaattatttgtgcctgagtgatgcagtggtgattagaattgctttcttgctgtggaagatagataattgggccaaagaaaatgaggcttcctggtgatcagacctcacatccctaatctgtaaccataatactaagtattagctaccttccatttggatgtaacctagatagggcaggatcctgttcaatttaccatactgtccattcgtacttgactttcaacataagtgaattgatcacattctaggaaaagataatatatctttttattattctcttcatttcagcaactatagaaaactttcatgtggtggaaacattagctgataatgcaatcatcatttatcaaacacacaaggtaaagatctcttcattcatcctaaaaggatttcaatgtagttcaaactcagacatatagattctctaaagtaaaattggggaggttattaaaagccacaaaaatccaaagactttattaaataatgattcatgaatgtcatgtatttaaaaggtatatcaacttgttcagaacagaaatatgtgcaggcaagaatctgagagatacaatctagaaatagagtgcttgataaagatcaacggttagttccctttgtgcactttttatttttaaagagacagggtcttgctgtatttcccaggctagtctcaaactcctgagctcaagtgatcctcctgcctcagcctctcaagtaattggaactactggtgtatgccacactcttagctttctttatacacagtttaagtctagaaaagagccttctgaaatactgaaatccatttaaatacctttctagtatctagtttctataagaggtaaatgatagttaccaaatatgaaagtgaattatagcttcctgtgacaacaacaataagggtaatggctagcatggtattagcctatgttaagactaatagatataaaagtaaatggattatctgaaagcaaagaaaaatcacagagcgtgacttgagaggttagtcatacaccagagcatacagaaacataatttaagttagctccctttcaccttatttcttctgctattcttgatatttaaaattatagaatcaatagttctcttgccttattctgctctttctcttctgaaaactgcccaataacataatgtgtatagcataataaaaggaattaaaattttggagagatccaccaaaaacagtattaaacattataaaagaaatgtaatgatttaataggtactttgtttttccaattcagtgagtgcttcatttttctttttaaatggtttttgagtgcagtatatgaaaacattataagtctgttatgtatttcttaaactcagtcttgtcatctgagacatcttatatctaataattaggagccatacttaattttacacggtagctgctcagaaatgcataacaattaagattctgtttcagcatacaaattttgaagtctaatttgaaatctaaaatttagtaaatgtcagaatattaattaatcaccctataatttggaatgaagataaatgaccaataatttagaaccaaaagaaccttattatctgaaaataatccatcatggaaaacaatctgctgaaggtattctgctagataaatagtagatggagggagggtcatataagttgtatcaggattgaaaaataaaactaaaaattattaaaataatcttatatgtaacaaaatttgttacagttataattatttgccaattcttggaataaacaaattgtcctggaatcattttttcaagaaaatcacattacattcgcagtgtatgtaactataccactcacactatatctgaaatttatcatcaccccaaacagaaactccgtactcattaagcaacaactccccattccctctcctcccattccataataatgttctgcttagactcaaagtctatagtgttatttacactacaatatttttccctttaaatttgacatcttttgcagtatggtcttaaaagagggctactggtctcttgatatttaagtcattctcattctttaaatttctatcttatcatcctgtggatttgtattcattaggtctaaatttgccaaatcttcatgtattacttactgtctccacacaatttacccaacactatatttatcaactacatgaaattttgtatctttaaaaaatgaatcatttcatcttgcaaatgatttgtattgtatgctatttattactctcagtaatcaggaatgacgctgcataacaaggactagtccagatacatatacgagataaccaaaataaaagtaacttaaataggataaaaggttttttttctcatttaaagtaggtagtcccatttattgaagacctaggctccatgtcattcccatagtatatgtttccccttgcataccttaatattgaaatatttaatctaagtgacttagaattctttctaatgtgatttgattcaaataagtcttttttcattaaatctttgaatctaagtagaacataatcatggagtatgaggagagaggaatggaaagttgttgcttactgggtacagagtttctgtttgggatgatgataaatttcagagatagcaatatggttacataacactgtgaatgtaattaatgtccctgaattgtaccctaaaagttagttaaaatgacaaattatacgtgtatatattttactgcaattaaaaaaatagaacattattccttttattatattgttctgcaaagctattaactctgttcataattaatcatttggtagatatcctcagatgctttccatttaaaatttgagagattttaccttcaattaagacatttattggcattacgtttctcttgttagttccatgttagatctgtttttcaaaagatttttacttctccacagagggtgtggcctgcttctcagcgagacgtattatatctttctgtcattcgaaagataccagccttgactgaaaatgaccctgaaacttggatagtttgtaatttttctgtggatcatgacagtgctcctgtaagtacatgtatataaatgtgtataattaaacaatataaagctaaatacacaatgcgggacaaaaatgataaacacagcccatacactatacttgatttgataatggttcttagattttatgttggattgactgctaggaacagtatagcccatgtgttgtctgagggcaacagtcatgcctatgaacattccaccagggccgtttacctttccttctaatgtttcgtgaaacagccaaaagggcagtacatacactgggcagtaggctacttcccacagttatctcttaagccgttatcaactgccagccaaacctctgtggtttaccacaatttagctccatttactacttaagaggaagggatcctgggcaacatggttagaccccatctctattaaaaaaaattttttttttttttttaattagccaggcctggtgatgtgcacctgtggtcccagctactctggaggttgaggcgggaggattgctttgagcccaggagtttgaagctgcagtgaactatgatggcaccactgcactccagagtgggcaacagagcaagaccttgtccccagaaaaagtgggtggggaggaatcctggtgtcatatcagcttggtgcttataagatttcactggagatacttttaagagttacgattttggttaacctaatataatattagaccagcagagtttacaaaatactgggtatctactgatgctttgttttttgttttggcagctaaacaaccgatgtgtccgtgccaaaataaatgttgctatgatttgtcaaaccttggtaagcccaccagagggaaaccaggaaattagcagggacaacattctatgcaagattacatatgtagctaatggtatgtattttattgtttttgctctttgataatgtggctgttcttgatcatgacctatatgacaacaatttggacaaatgcctttttagttcttatccattagattactaatttttaatttggagaaaggtatatcagaattactagagaatctttgaaagtacagatgtctgaatttcaccctggaactactactatatgagtatttctgaagctagagctggataggaaaattttaaaactttatccctaggtcactgtatatacccttcttttttttttttttttttttttgagatggagtctcgttctgttgcccaggctggagtgcagtggtgcagtctcagctcactgcagcctccgcctcctgggttcaagcgattctctgcctctgtagctgggattacaggtgcccacaaccacgcctggctagttttttgtatttttagtagagacggggtttcaccatcttggccaggctggtcttgaactcctgacctcgtgatccacccacctcggcctcccaaagtgctgggattacaggcgtgagccactgcgctcgacctagccttcatattaagcaccattttcttagatatttgcctcatagaacagatttattattaggaatataagcaacagtggggaaggaaattaagagttcttttactcattgtcagcctttttagctttctgaatcaatgttcccctagtccttattagttgctagttacatatttatttctctttgacattcattgtcaggctttttgttttctgagtcagcgtttccctagtccttattagttgctagttacatatatttgtttcactttggataggtcttttcattgcttgctttgggtccttacttcacctgctttgcacctggagtaatcattgcaacctctctcatcaaaagtcataccttctttatacagggccataactgctagtatgttcaaagaaacagttgtacctgagtaagttactatttcattatagtacagatttgtgaataatctgccctaaataaccttaagtggtgctatactaatttttgcaggtaatttcgggaactaagaacattgtagaaaggttatagatgctttcttatttgctgtctgattatgtctgatggatagtgttaaggaatgaagggttgggacttaaaagatcataattggtccagctgggtacagtgactcagcctgtaatcccagcaccttgggaggctgaggcgggcggatcatgaggtcaagagttcgagaccatcctagccaacatggtgaaaacccatctctactaaaaatacaaaattagctgggcatggtggcgtgcacctgtaatcccagctactccggaggctgaggcaggagaatcacttgaaccccggaggcggaagttgcagtgagccaagatcgcgccactgcactgcaccctggcaacagagcaagactccgtctcaaaaagaaaaaaaaaagatgctaattggtccaatgtgaggaatattttaaaaacaagggaacaaattaagtgcttcacatatgtttggagaattgtatcttaatacattttaattttcctttatcttgcagtgaaccctggaggatgggcaccagcctcagtgttaagggcagtggcaaagcgagagtatcctaaatttctaaaacgttttacttcttacgtccaagaaaaaactgcaggaaagcctattttgttctagtattaacaggtactagaagatatgttttatctttttttaactttatttgactaatatgactgtcaatactaaaatttagttgttgaaagtatttactatgttttttgatgttcccctatagagtattgtttcgttggtttttgttgttgtcgttgttgttgttttaaacagggtcttgctctgtttcctaagctgaagtgcaatgacaccatcacggctcactgcaacctcaacctctggcctcaaacaatcctctcatctcagccttcccagtagctgggagtccccacaggcatgtgccaccatgctcagctaattttttattttttgtagagataggggtcttgctatgttacccaagctggtcttgaactcctggcctcagacaatcctcctgcctcagcctcccaaagtgctgggattacagacatgagccaccgtgcctggccttgaaaattgtagtttatagcctttaaaacttaattcttttattgtttcctttttcttctaatgcttatgtaaagaaattttgatattatagaactgtagaattgtagaagtgcaaacttcctgtattctttcctttcccagaaactgttatttttgttgtatattcctccagatttttctgtgtatgtactgacatatttttgaatgttaaaatgtttatacttactattatacaaaattcttgttttataacctttttttcacttaacaatgtatcttgactatctttctttataagacatgagatgtgtaaaacatctcattcttttaacatctgttacatgcatgttgcagaatttattaactagtcccatgttaatgtctgagttggttccatatttttactgtcaaccagtacagcactgaacacctttatgcaaagaggtagaatctttaactttattttggtgttgttgagacaaagtttctctcttgctgcccaggctggagtgcagtggtgcaatcttggctcactgcaacctctgcctcccaggttcaagcgattctcctgcctcagcctcccgagtagctgggattacaggcgtccatcaccacgcccagcctatttttgtatttttagtagaggcagggtttcaccatgttggccaggctggtctcgaactccttacctcaggtgacctgctctcctgggcctcccaaaatgctgggtttacaggcgtgagccactgcactcagcccaaaatctttaactttttaaagtaagtgatacgttaacatgattaaaagccaaaagtggccaggtgcagtgggtcacacctgtaatcccaacactttttgggagactgaggtgggagaatggcttgaggccaggagttcaagtctagcctggataacatagcaagattccatcttgacaaaaaacaattaggcgtggtggtatacatgtatagtcctaggtacttgggaggctgaagcaggaagatcgctttgtctgggagtttgaggctgcagtgagctgtgattacacgactgcactccagcctggacaggtaatgtctgtcaaaaaataaataaataaagtcaaaagtatgaaaaagttatacagtaaaatttaccctgtcttgcattcaccatatagtattaacatatgctattactagtttcttctagaaagtttttaatgcttgaatgaacaaatacaagtgtattttctacacagatacactttttttgttgttaaagaagcagcagcatactataaacactgttcaacatcttatatttgcatttattttatcttgaaggtctcacatatttgtaaggagcttcctcattttgatggttatacagtatcccattgtatagatgtacataatttatttaatcagttctgcattggcgaatattacagtttccaatttctgccagagcagtgtcataattgtatccatatgtcattttgtacttgcaagtttatatgtgggaaaattaatagatgtggtactactggccctgctaggggtttgtgcataatttagatactacttttcatagaggttatagtaattgaccatctcaacagcaataatgaattggagtccctgtgtcccacagtttttcatacaacgtgtaaaac

SEQ ID NO: 16027 - DNA, 95109 bp, Human
  misc_feature (1)...(95109): n = A,T,C or G
aatttgtaattttttaaattaatagactttgttcattatatatttcctcaaatatataaacagtatgcacataaaagtatgcctactatcaaaggactttgaacaatttgggggcaatagggaagcctgacattttaaaatcctgagaacttctgatcttgacttcaaaaggggcaaaagtctacatttggggtcctttagaaacagcaagctaggaactagttgggttgggagtcacatatgtcggagagaccaagtcatatcttgtcagcaggatatctcgaagcaagttaacctctgttttctttttacccccgggcttcagtgcagccctgtataggtattcttctggagcaatcattctcaaactctgggggggcacaggcatccccaggagagcttgcttaagtagtctcctggggccccaacaccagagattctgattcagtagtttggggtgaggccttcaaatttgcatttcaaagaagctcacactggatgcaaatgatgctggtgtgagaaccactgttctagattcttcgctgcactcagcaaactaagataggcaaatacagctcccggaaccagagaggctgacaaatgaattccaaagagatgctgaatacttggcgataagaactgctgctttgagataaagatgctcctcctttgtagaacacagtattttttggttggaaagcaatctgatgagcagactaatgcgaacattcacaggatattctgggagataccatgcctttaatcaaaataatcagattcaatgacagaatttcagaaccaaggaccattagacattgtggggtctttcgggggaagctttcctgtatctctaaatcatactatgtaagtagaaagcttgctgactgcttttttgttaatacgatttcttctagcttccgtagccaacttttttttttttttttctggctagggttttcattattttatgtgattaaggacacttttctgccccaagtattgtaatcctctcggccggctctgtccaaaagaactgtcttcgatgatagaaacgttctacatatgtactttgccacatagcagccactagccatacatggttatggcacacctgaaatgtggctggtgccactgaggaattaagttaatatttaaaatttaaatcccaatactggacagcacggctaaacctttcctaacccttcacgtttcttatgaagattatatagcaggatattacaagcactaaaaaagaactatcttaaatctgaagcaagatgatttccctaactagtacgtttgtttggtaaaagaggacgtgctattttttacagttaaatctaattcgtaagttgtagaacgttttcttaacaaggtatccctctcccaaattccgggagaggctggctgcctttccttttgctccagcggtttatttggcataaaatctgcaggcttacaggagctgacaccagggcagaaaagaatgaggaatttgtttccaagttggtcacaggccgctaatctgacctagatgatgtttaaaataatattcaaatacagcactttaaaaaactatgaaggctgagaagaaaacgagaaatgggaagcaagaaggaaggcggagcgtgccggcgacttctcaggggacttcctcagggagtcccattccagtaaccccgcgctacccacggaccaccgcctctctcttgtcggaagacgcaagcccaaggggcggctcacctcgtgccgcgcgcagggaccacggccgccgggtggtcccctggccccgccccctcccacctgggcaccccgagccccgccccccgagcgccccgccccgccccgccgccgacttcgcgccgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggtgagtcgcggacccacgcggcagtcgccgacctcctccgagacccggactcgtgccctgtccgcagggtccctcccgcctcccccgcctctcgcctctagcctctcgctcggggcggaagtggcggcgcggtccgcgtcaggggcgcgcctgcgctgaccgctctcttgctccttttggtttaaaaaaaaaaaaaaaaaaagcatacttgagctgagcagctcatggttagcgcaagcgcagttagttctggagggcggtgccacagcggcttcttggggagcgcgtggatgcgccaccagcgttgcgcggcccgggtctgggggtccttgggaaagccgtgggggcgctcgggcgcgcgcccccgggccgcagcttcgccgtagctcccacgccgctgtgcttggttcttgctcgcggacagctctttctctggccgggtgttttgtggccgggtgggcagctggcgtccccgggagcggtgagggcgggggcgggcgagccgggccgcggcgtccgggtccagctggcgcccgcgcaggacctgtgggagcaggccgctctgggcgccgggccggccgccgcagccctctgcgaggcgaagctcgctctcctggcggagccgcggtggttgggggtggctcgtggcctctggcgagggcagcgctctcgggaccctccgtcttcattttcccccgtggcccagcagcgcccagcgtgggttcggcccccatagaaccttcccggaacgaaagaggctttgcttgtgttcgtccagtgatagcgtgtcattctctttatagttttccttactgaggtatactttccctacagtgaaacgcagctttcatgtgtgctcccagacgggtgtcacaaatgaatcccctcttgcaagccccctcaaatcaaaatagcctttccttgccctgagaaagtgccctcatcccctccccgggggcacggtgttccgatgcctatcgccctaatcgtgcctgttcagctcacatagatgcaatatgtagtataaacacctgtgattcgctttttttatgtcaactagactaccttttaattcaaacaaaactttatctcttttaaaatgatgtaactgctttccccttcgtttaatccttgtcgtattattcccaagattgaatttggtgacggttaagttaatgctgcttctgatgtttggttctctctgtgtaaagtaaaagacgggctttcctgtaaatggatgatcctgggtttttcccctttccatttaattagatggcagtgaaaaatgtgttcagaaagtaacgttttcttcttgaacacattagtgggaagtataaatattctgattcccatgatacagagtatgttagaatagggatctaagttttaaagaatgctggtaaggactcttccaattatagacaatctgaaacgcaaattctggtaggaatcttcatgtgagagagcctgccagctgcatcttctccagttacatttgttttagcagaggctgctgtctctctaagggataggttatatatcgaaatagatttgaaaagagaaaagtgaatataacttaattcagcttaacattttggtttaagaaatttaattttctttggtatcattaatatccttgaaaattcaatgagaattgtgattcctctttccagaaaaatgaacttaactcgcatccactggagatttcacatgcattttcaaaaagataaggaaatccttctatagattcttaccgaggaatcctgtagtttccttggttggtcaatgctcatattattttttcctagttgaaaacaagaccattagtttggtcagtagaaaccatggcatgcacactggtgttacagtaaaagtaggtcacaaaccaagaaagttagtaatggaaagcaagtcaggaagtttgagctatgtgttctcctgtggccttagaacatccattcagccattccacaaatatgcccggacccccagtggagttgcagcttttgctcctggccttggggattcagcagagaatgctcctggcaagtttcctaccctcgaggtgctcactctagggcttattcttttggggcctcattgtagttccatattttcattcattcgttcataacatgcttgttatgtgctagtgttagacactgaggattcttgttaaaagacaggagtcccagtttttaaggatgcagccctgtaaataggtaagctgatgaaaacgttaaagtgatacatgtaaagctagcttgaagcacagggtcttgtggagttgagttacctaggagtcctgtatttcccaaaaaggggtacacatgggagttctggtgaagcttctcgagggagggaggacctcacctaagtcttgaaagacattggccaggggaagaggacaagggaggtgaagagaattactgttccagcaaggagggagtgcacaaaggcactgagggaatgctgagagaaccacccacagtttagcctggagactggtgtgaagttgagatgctggagagtaaggcagagcctagatcagactaaggaatttgagctgtttaataggaactcattgtggaattgtaagtctggaaataccatgatcatatttgcttcttttttttttgacagagtcccgctctgtcgcccaggctggagtgcagtggtgcgacgtcagctcactgcaacctctgcctcctgggttcaagtgattcacttacctcagcctcctgcgtagttgaaattacaggcacacaccaccatgcccggttgatttttttgtacttttagtagagacagggtttcgacatgttggccaggctggtctcgaactcctgacctcaggtgatccgcctgcctcggcctctcaaagtgctgggattacaggcatgagccactgctctgggctgatcatatttacttgttagcaagatcgttctgactgctagcagactggatgaggaaagtgtaggcacgcagcacagggcagtagtcggttggagtaaacctgaagagacatgatgagcttctgttaggcagtggcaggagggatggaggggagatacagatttgaaatgaaatggtaaaggggtatacgttatgtacaagtttggttttgaaactttaattctgtttgaggtacctgcgagacactgaaatgaagctagttgaatgtataaatttggagttcgggagagagggtctgagtaaatgtgattttggaaatcatgaacacatgggtgatatttgaggtcttagacattgatgagatcatctagggaagatacagagcgtttggaaatatcaaaggccaaggacagaatcttgacagacaacatttaaaaggatgggtggagaaagaggaacttgcaaaaaagactggtgaggaacaaccacagaagtggggaggaaagcagtggagggagttgagggtgagcagggccacctgacaggtaagggccagcctgagagggccatgacattgagcagctagattaacagataccttaaagggagttgtgtcagcggactacacaagacagatacctggagttcaggagagaaggtaggaggaaatgcaaactaccaagtgtacactgctctttttagaagcccaacttgaagaagtggggagaggtagctaaaatgaagcaagattgtgtgacttctcacttaaacccttgaacggctttccgttgctcacagtgtaaattcagcccctcctccggctcacaagacctcatggcctgtgtctcttgcttgatttcccctatcactttcctccctcttttccactgtgttgtattcttggaagtgtgtgtgtccattctccccttagggcgtttgtaaatgttgttctctttgccttggcacaactttccccccttctctttcctttcttgcttaaactgcctcctactcatccctgaagtctcacttccttggcaggccttcttgacctgcccatgctgggtatgagcccctgttgcgtacttctttagcatcccaagacttcccctttcatagcgggaattggatgtcatacagcagcaaatgatttcgggaacacaatttgcattaagcaaaccactatcttgaaagtaacacagcttgagtaggaaaaaagtgtttaaggtggctttctgctttgtttagcacagcagtgggtgatgtttctgataatgtttttgaagagttgtgctttttttggtaatgctcatggagctgggaaaagaaaggctttgctcttgagcaaaaactgagtacaactaaaagctggacttgcttagtggtaggagaacttgataccttgttgaaattctagcgggaaaaatgaatttagtattttgagtctggaactctggtcccttattcctttttgctccttttgaaaagtgtcttttatttcatgagtttgataataggaggtttcttagaaatgaattattgggttggagcagaacagactctgttaatctgagtttatattttttattacttcttcagagtttcatgaaggcactgccagtgctttgcacagtatcaggtgcttagtaagcacttgaaaatatgtgctgaatgaatgactttttatgaggaaagggcaacttgatatatttatgtgattgcagggatgaacctaaagagagaggtggaggttgaaatagaagggatgattgttggagccagaaatcttagaaagcaagagtcaatgggaccaagagcacacaggtggaagaattgatcgtgaaagagtgctggccaggcggtggctcatccctgtaatcccagcgctttgggaggctgaggtgggaggatcacttgaggtcaggaggttagggctgcagtgagccataattgtgccactgcactacagactaggtgacagagtgagatcctgtctctaaaacaagaacagcaaaacaaagggtgcagttggaaaagtttaatttggtctgattgtgtgaggttaattctgactttttgagtaatgttcatgatccctttttggcttttccttttgtcactgctgattgctgtcttcatcaggctgagctttgagaaaggcagagagaaggaatggagtctgtgtgcctactgaggaaaagactaaaactggggaatcgcaaaagctatgttatgggttgtttctaagaagtgatggctcagaaggaatttggcttatttatttttaaattcctttcttttttaaagagttctcactctgttgcccagtctggagtacaagtgcagtggtgcaatcatagctcactgcaaccttaaactcctgggctcaggtgagcctctcacctcagcctcttggaaattggttgattaattagggtttataaacaatggaactcctgactgacttcatttttctttttttgaaaccaagtcttgctctgtcccccaggctggagtgcagtagtgtgatctcagctcactgcaacctctgctccccccaggttcaagcagttctactgcctcagcctcccgagtagctgggattacaggtgcccaccagcacgcccagctaatttttgtatttttagtagaaacggggtttcaccatgtttgtcaggctggtcttgaactcctgacctcaggtgatccacctgcctcggcctcccaaagtgctgctgggattacaggtgtgagccaccacgcccagccacatttttctttttctttctttttttcctttttctttctttttttttctttttctttcttttctttttgagactgggtctcactttgtcacccagtctggagtgcagtggcgtgatctcagctcactgcagtctcgacctcttgggctttagacatcctcctgcctcagtcccccacgtagctgggcctggctaatttttttgtattttttgtagagacagggtttaactattttgcccaggctggtcttcaactcctgagttcaagcaatctgtccacctcagccttccaaaggcttaggattacaagcatgagccactgtgcctggccatttttcttttttctttttctttttttgagacagtcttgctctgttgcccaggctggagtgcagtggcgtcatctcggctcgctgcaagctctgcctcccaggttcacgccattctcctgcctcagccttctgagtagctgggactacaggcgcccgccaacactacaggcgcccgccaccacgccaggctaattttttgtatttttagtagagacggggtttgaccgtgttagccaggatggtcttgatctcctgactttgtgatccacctgcctcggcctcccaaagtgctgggattataggcatgagccactgcgcctggccgccatttttctttattagaaatttgtagttcaaatattgctagagaacaatttttaccatttgtgagtcagctaatttttagaagtcagatatcaagtgcacactgttcttctcatacttacagcggggcagccagttaggcaggtgaatcaaagctgtcttattctaaaacacttcccttgcctactagttacacattctcctgcctgctgtctaatctcagtgcttttacatggttgcacaaactctgaattcccttgaagattggctactctctcacaccttggagtcttcatgtgttggatatactccatgcctaccatatctatttgggaaacatcttcaagactagaccgtagtctccttgggcaaagttaaatgctcccccttctctcatttcttagttctctatattcttttattagaatatgaaccacattgttttgtaactgtctacttgtctgttctgtgtagctccttgagggtggtctttttttttctttgttttcccaccacctacctacgggacctgaaacatgttagatgctcagtaaatattcagtaaacacaggaaaactgttcccttttaaaatgtcagcaccttagtttattccaaacccctcatttatggctgaggaaacactgggccaatacagtgttgtgacttatctgatgttacaatatctgctagtgtcataactgggactcaaatccagtccttctgattctcgtttcagcactgccctaatttacccatgtgactacctgtagtgctttcttcttatgatctatttgagatcagtggcacagagggaatcgtcttaattttgatggctaggagggagtggatgtgttataataggtagggtcattttgggacttgaggcctttaaaacagtgtctgggatccagggatcagacttgaaaggtatttgcaaatctcctgaaactgctaaattttatgtacgtgtgttcccaggtatttcgtttctaggtgattctgtagcttttgtcagtttcttagtggatttgtctgtgatccctcaaaaggtaaagaccactgcttgaagggaaagcagccttgggatgggtgccccaatggggaatgtatacctagaaatcatattgttttgcctttgacatgtgtttatagattactgatatctataattacggaaatccagatagttgcgtttgtctcctagcttttctagttgcctcttttttgatttcttgattttaaccagaatcttctttttttcttgagaaggggtctcattccgtcacccaggctggagtgcagtggcacgatcgtaggtcactgcagactcaaaactcctggctcaagtggtcctttgcctcagcctcccgagaagctgggactacaggcacacaccaccacgcctgacaaatttcttcttcttcttcttctttttgttgttgttcttgttggccaggctggtctggtcttgaactcccggcctcaagtggtctgctcaccttggcttcccgaagtggcgagattacaggcatgagccaccatgcccagcccttaaccagaattttgttttgttttgttttttgagacagggtctcactctgtcacccagactggagtgcagtgatgagatcacggctcactgcacagatgcacgccaccatgcttggctaattttttatgttttgtagagacaggttctcaccatgttgtccagactggtctcgaactcccgggctaaagcgatcttccggcttcacccttccataatgctggggagccacagtgcttggccaaccagaatcttaaaagccctttttactttttccagatagttactctgcagagaatttctgattcccagttggagaactgttacagctctctcagtcccctgctgttcttttagctaccttgtctttgtcctcttacctgtccactctctactccccttcttccctttggtctccaaatagtccagataaaccagagagatggacagataaggtctgggtacgcgaaattaaaattaacatagtgtgctcttcactttcttgaataaacgttacgtatgatttgtttcccttggaaatcctcatctagattctctactctctattccttaacttaatgccccattaaggtagttttttcttaatggaaagctgttgagagtcagaggatatttaaaccaactaataaactgaacttttaataataccacccttactttggataagagtgattagccatatactaaatcctcaatcagtttagcatgtaaaatttaagacatagcagctgataactgaggaagagatacatttccacaggctaactttaaagaatataagctctcactttcctgagtagaagaaaactaaacttttctgttctatgctttttttttttttaatttttatttttattgatcattcttgggtgtttctcacagagagggatttggcagggtcataggacaatagtgaagggaaggtcagcagataaacaagtgaacaaaggtctctggttttcctaggcagaggaccctgaggccttccgcagtgtttgtgtccctgggtacttgagattagggagtggtgatgactgttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttccacacagacacggcaaccatccgatttctcaatcttttccccacctttccctgctttctattccacaaaaccaccattgtcatcatggcctgttctcaatgagctgttgggcacacctcccagacagggtggtggccgggcagaggggctcctcacttcccagtaggggcggccgggcagaggcgcccctcacctcccgggtggggcggctggccgggcgaggggttgacccccccacctccctcccggacggggcggctggccgggcggggggctgacccccccacctccctcccggacggggcggctggccgggcggggggctgaaccccccacctccctcccggacggggcggctggccgggcggggagctgacccccccccaccttcctcccggacggggcggctggccgggcagaggggctcctcacttcccagtaggggcggccgggcagaggcgcccctcacctcccggacgaggcggcaggccgggcgggggctgatccccccacctccctcccggaaggggctcctcacttcccagtaggggcggccgggcagaggcgcccctcacctcccagacggggcggctggccaagcggggggctgacccccccacctccctcccggacggggcggctggccgggcggggggctgaaccccccacctccctcccggacggggcggctggccgggcggggggctgaccccccaacctccctcccagatggggcggctcgcctggcgggggctgacccccacctccctcctggacggggcggctgccaggtggagacgctcctcacttcccagacagggtggctgccgggcggaggggctcctcacttctcagacggggcggctgccgggcggagggtctcctcacttctcagacggggcggttgccaggtggagggtctcctcccttctcagatggggcggctgggcagagacgctcctcacctcccagacggggtcgcgaccgggcagaggcgctcctcacatcccagacggggcggcggggcaaaggcactccccacatctcagacgatgggcagccgggcagagacgctcctcacttcctagatgggatggcggccgggcagagatgctcatcactttccagactgggcagccaggcagaggggctcctaacatcccagacgatgggtggccaggcagagacgctcctcacttcctagacggggtggcggccaggcagaggctgcactctgggcactttgggaggccaaggcaggcggctgggaggtggaggttgtagcgagccgagatcacgccactgcactccagcctgggcaccattgagcactgagtgaaccagacaccgtctgcaatcccggcacctccggaggccgaggctggcggatcactcgcggttaggagctggaggccagcccggccaacacagcgaaaccccgtctcccccaaaaaaatacgaaaaccagtcaggcatggcggcgcgcacctgcactcgcaggcactctgcaggctgaggcaggagaatcaggcagggaggttgcagtgagccgagatggcagcagtacagtccagcttcggctcggcatcagagggagactgtggaaagagagggagagggagaccgtggggagacggagaccgtggggagagggagaggaggcagagggagagggagaggcttttttttttttttcttgagacggagtcttactctgtcaaccaggctggagtgcagtggcacgatcttggctcactgcaacctccacctccctggttcaagtgattctcctgcctcagcctcccaagtagcagggactacaggcatgcgccaccacacccagctaatttttgtatttttagtagagatggggtttcgctgtgttggctgggccagtcttgaactcctgacctcaggtgatccacccaccttggcctcccaaattgctgggattacaggcgtgagccaccgcgtccagcctgttacattcttaattggaatagcattgccctgcagtgccattatctgaaatagcttttaagaatgaatgtaatgccattttaaatgtatttaaatgttgtgccgatttaatgttctatgtacggtacagtactactaatggttcaagaagttgttttgacttaacagtgaaatccttgcttttaaagatcatagatacctttagacacctttaagatgaaacatgtttatgagaggaaatgtccgcacaaatacaatcccccgcaaacttagcatgtggttttagtaggttcataggcccacctggtgatccctaggataagaaattgtggtcaagaaactgatttcaggggccgggctggtggcttacacctgtaatcccagcactgtttgtctcaaaacaaagaaactggctcaaggttggatacttttcaaacgagaggaatggaggaagggaatgcaatgaataacttttcaaatccagtatgtctgatttaatatgccgtttgctctgtcagtttcatttggttcgtgtcactgatcatttataaccttttttcaaactgctttcattcccctaaggaaaatctgatactgaattattttatttcttctttcactatatttgaacggttttatagtctgaaagctatcaatttctcattacagtttacttcatagtacttctaggaattcttcctgtggtttgaggtaaggctacaggattcctagagtttgtacccctctagtcccagtaaaggacctggtacatcaatcagggtagccctagaaagttggagtaacttcgtaacagtgggaactgcttctgttctatgttttttgtgggttttttatttgtttttgtttttttgtttttttgttttttttttgagacagagtcttgctctgtggccccaggctggaatgctacggcacgatctcggcttactgcaacctctgcatgctgagttcaagcgattctcctgcctcagcctcctcagtagctgggattacaggcgtgcaccaccacgcccagctaattgttgtatttttagtagagacagggtttccccatgttggccaggctggtcttgaactcctgacttcaagtgatcagcccacctctcagagagctgggattatacatgtgagccaacatgcctgccctgcctcattctttatactacagtaaagtcccggttgggcaataatctaaacataaaagaaatgaaaccataaaattatataagaaaacaatggagaaaattttttgtaatcaacagagtgaaaaaggattttttaatgccatgtcacagaaacctagagaaaaaaggtttaagtttgatttcataaaaatttaaatttttgacataaataccataaaggtcaaaagataaaaaattttaaatattttcaatatataacaaaaactaaactttcttaatatgtaaagaactacatatcaaaaagagagcggaaatacagatggcttttaaaaacaggtaaagctgttcaccttcacaataataacaatttcaaattatgactataataataccatttttcacctatcagacaaagatgaaaaagttcattaatataattgtgtaggtgaagctcaggcactttcttatattattggtgacagtatacattgatatagcttctttgaaaggttattcatagcagcattatttataacagctaaaacctagaaataacctatgtgtcccattatagatgactggctaagtgatgaatactattaaattgttaaaaagaactcattatctatatggaagtacttttaatatatactaagtgaaaaatcaaagtgcaaaacagtatgctaatatctgttttgtgagggtgggatggatacttggatggaggaagacagacaggcagtctggcttatatatggatagaatgtctcggaaaatatacaaggcactggttacagttatcacctaagggaaaggattgagggagaggagaatgtgacttaactttttcactatatacccttttgtacggtttaatttttgccaagtccatgtaatccatgtatacatagggagcatatgtatataaatatatgtaaatataagtaaaaaaatatgtatgtgctgccgggcgcggtggctcactcctgtaatctcagcactttgggaggccgaggtgggcggatcatgaggtcaggagatcgagaccatcctggctaacacggtgaaaccccgtctctactaaaaacacaaaaaaagtagccgggcgtggttgcgggcgcctgtagtcccagctgctcgggaggctgaggcaggagaatggtgtaaacctgggaggtggagcttgcagtaagccaagatcgcgccactgcactccagcctgggcaacagagtgaaactctgtctcaaaaaaaaaaaaaaaacaacacgcttttctctctctctctctctctctctctctctctctctctatatatatatatatatatatacacatatatatatacgtatatatatacatatatatacgtgtatatatacatatatacgtatatatatgtatatatacacatatatatacacatatatatgtatatatatacatatatatacacatatatatgtatatatacacatatatatgtatatgtatatatatacatatatatatatatgctaaagttaagtactggattcctatctgtatctgctacctaactgcagtataaatcttggaagttgagtctgttttctcatttgtaaccacctcttagataacacacataaaagcacatagcacatgcctgacacacagtagggttcagtgacagtgagctgttttagtctctaaactctcttcctcaaagagagcttctcaaagaaaaaaaaatgtagtgaagaaaagaacttactccaccagggatcttctctccccagccagtggcaggcatattaagggctataagtaagtggttattttaccatcctaaagtaatggtgtttcaaagtatgcaagattcttcatacttcactgtgtccttttctgagcatctttgtagagagtatatgcacaaacatctgactaacaaagggaacacttttcatcatataatttaggattcacttagagacctaaagtataaagaaagaaacttaggtatgttagcccataaggagaaactcattatcaatttgggattatcttaaggtcctaccttataaaattaaaatttaacagaagattattctttttcaatttcctaagttcttatttgctactacatcgtagcagttcgagggagaatttggtctaacgatgtaatgttttctgtatgccatacatagaacaaagctatgtacgaaatactaaaaatattatttgacattatttaataaaatattataactatttcaccccgataatgatggaaattaagttgcagtaatatagatttttaaaataaaaacttcaaaaccaggcgccatggctcacgcctgtgataccagcgctttggaaggccgaggcaggcagattgcttgagaccaggagtttgagaccagtctaagcaacatagcaaataaaaataaaaaattagccaggcatggtggtgtgcctgcagtcccacctacttgggaggctgaggtggggggatcacttgagcccctgaagtcaaagctgcagtgagctgtgatcacaccactgcattccagcctgagtgacaaggcaagactttgtctcaaaaatataagtaaaataaaattaaaattttacttgtttatttttttgagacggcgtctctctttttcccaggctggggtgtagtggtgtgttctcggctcaccgtaacctctgcctccggagttcaagcgattctcctgcctcagcctcccgagtagctgggattacaggtacgtgccactatgcccagctagtttttgtacttttagtagagacagggttttgccatgttggcaaggctggtctcaaactcctaatgtcaagtgatccgcctgcctgggccccgcaaagtgttgggattacaggcgtgagccaccgcacccagccttaaaactttaaaattcagaatatgagcctttgttttatagcttcacttgttaaaacaaatcaggagctgggtgtggtagctcacgcctgtaatcccagcacttggggaggctgaagcgggcagatcacctggtctcaatctccctgaactcgtgatccgcccgcctcagcctcccaaagtgctggaattacaaacgtgagccaccacgcccggcctgaagtttgaagtttttaaaaagaaagagttgttaggcataattgtgtaaatagaggtaaaaattgacagcaagaaaggcagtagaaaactatgacaaatgaaggtgatggctcacgcctgtaatcccagcactttgggaggccaaggcgggcggatcacctgaggtcagtagttcaagacaagcctggctaacatggtgagaccctgtctctactaaaaaatacaaaaattagccaggcatggtgatgtgcacctgttatcccagtcacttgggaggctgaggcaggagaattcacttgaacccgggaggcggaggttacagtgagctgagatggcgccacttcactccagtctctccagtcagtccagacagagtgagactcaatctcaaaaaaaaacaaaaaacaaaaaacaacaactatgacaaataagtgtaatttcccaggactattaaggtcttgtaatcccatgcactggaagcttttgttgttgttttctgatttatcattgaagtgaccaaagcgcagtggtaagaacaagcctttgtgattacttcacactagagaagggtctttcccacatatttgagacttaaggagttgatagtgaacagtgtaagcggccacacaggtgtgggttaagaactgatgtgtgtattcactttctgtaaagatgaccaaacatatgttgttagacaaacgaaaaattcaccccaagatcattgagggcatgcaaaatagtatgaggtagaggcagctgtaattcaggtgtccaaatacaagagcaggtggagaaaagaaaagaaactgagaacagtaaagagtttttaaagttataacacacaattgttaaaatagaatgttcagtaccaagtagcagagtagataatgcagaacactgaggtggcttgagaaaaatctctcagaactcaggaaagaggtgtgcgaaatgagcgttaggagagagcacttccccaagtctgtgatagaaattcctgaaagggaacagaggagactgaagcgaaactctattaagcgacaaggaagactcaaatggagaagctaacccagttccgatgaagacttggcacatatctataatgtattttttttgaagtcagccaaaagaaagtttaaatttgaggtacatctgaaagagtaagcaatacagaaaaatcttgacaacatctgaggacaaaaaaaaaagtactgatactgttgagtgtgaggcaaaacctcactttcagtctttcttgagaaatattggcaaaatatgcccttaatacaggagttccatttttatttcatttatttatttatttatttatttattgagacaggttctcactttgtcacccaggctggagtgcagtggtacagtcactgctcactgcagccttgacctcctgggctcaagtgatcctcccagctttgcctcccaagtagctgggactgcaggcacgcatcactacgcttggctttatttttatttattatgtgtttatttttatttttattttttgtagatacgtggtttcaccatgttgcccaggctggtcttgaactcctggcctcaaatgatcctcctgccttggcccagagtgtttttgttttttttttttgtttgtttgttttttgttttttggagacaatcttgctctgtcacccaggctggaatgcagtgagtggcgcgatctcggctcactgcaaccaccgccttctgggttcaagcaattctcctgcctcagtgtcccgagtagctgggactacaggtgcccaccaccatggccagctaattttttgtattttttagtagagatggagtttcaccatgttagccaggatggtctcgatctcctgacctcgtgatttgcctcggcctcccaaagtgctgggattacaggcatgagccaccacgcccggccgagatatatttcacataccataaaattcacctaaaaggtacagtttagtggtttttagtatattcacagctgtggaactaaatcttaatttcagaatattttcaacaccccaaggagagactgggtacatacagttattctccattctcacccacatcccaacccctgacaaccactaatctactttctgtctccagatttccctgtcctggtctcataccatgtgtagtcttttgtatctgtttttttgttttgttttgttttgttttgttttgttttgttttgtttttgagaggagtctggctctgtcgcctaggctggagtgcagtggtgcaatcttggctcactgcaagccccgcctcctgggttcacgccattctcctgcctcagcctccccagtagctgggactacaggcgcccgccaccacacccggctaattttttgtatttttagtagagatggggtttcactgtgttagccaggatggtctcgatctcctgacctcgtgatccacctgcctcggcctcccaaagtgctagggttacaggcgtgagccaccgcgcccggctggtttctttaacttagcataatgttttaaagtttcatctgtgttgtatgtatcattactttgtttcttcttctaagttagtaagattccattatatagatatataccattttgtttatccattcaccagttgatggacaaatgattgttttagctattattaaaagtgctaccatgaacatatgtgtccaagtttttgtgtgaatgtatgtattcgtttctcttgggtatgtgccttggagtagaatagctagttcatatgttaactctttgttcagcatttgtttttctaaagtggctacatcattttaacctttagttttttgttttttggttttttttttgggagtggggtggggctggagtgcagtggcgttatctcggctcactgcaacctccgcctcctgggttcaagcaattctcgttcctcagccttccgagtagctgggactacagacacatgccatgacgcccagctcactctttttgcccagctcactctttttattttagtagagacagggtttcaccatgttgcccaggctggtctcaaactcctgagctcaggcaatctgcccacctcagcagggtttcaccgtgttgaccaggctggtctcaaactcttgacctcaggcgatccacccacctcagccttccaaagtgctaggattacaggcatgagccactgtgccccgcctctctcttttttttttttttttaataaagacagagtcttgctctgttgtccaggctggcatgcagtggcgtgatcacggcttactgcagctttgacctcctgagctcaagtgatcctcccacttctgcctcccaagtagctgggaccacagatgtgtaccaccatgccttgctaattttaaaattttttaatagagatgggggtctgtctgtgttgcccagactggtctcaagtgattctcccacctcagcctcccaaagtattgggattgcaggcatgactcacagcgcctggcctcagtttctttcaagaccatcctataacaccaagttagtttgaggattctatgaatgtctgcttaaagatatccttctgaattctgtgattctcttgaaaggcttgttgcaatgaaaaacaaagtataatgatgactttatgtgaagtatacttttggaatttcttaagcagaagtcctgagacttgagagtccctgtatttaaacagtaccatttaggcacagttactgcttatgaaatgaagagtagctagatgaatataaaaaatcttactcttacatttcaacccagcattatttgaacccagcaaaattatttctatagtagaatcaatttagttccttattttaagccatgcatatatatctcaaagcaaatttcaagagggattaaatgttattatgtgaaaatattaggaggtgaaataataggagaaagtaaacacattgaaagtaggtatgttcaggccaggcgcggtggcttatgcgtgtaatcccagcactttgggaggctgaggcgggcagatcacgaggtcaggagatcgagaccatcctggctaacacggtgaaaccccgtctctactaaaaatacaaaaaaaaattagccgggcgtggtggcgggcatttgtggtcccagctactcgggaggctgaggcaggagaatcgatttaaccctggaggctgaggttgcagtgagccgagattgcaccactgcaccctagcctggcaacaaagcaagactctgtctcaaaaaaaaaaaaggaaagtaggtatgtttacaatttaaaatctttgggcatggagataagctataaggccattgatcagaatggaccatttcataatgttccaaaaattagactactttggaaaaaggtggtgtgtggtcttaatgtaggcaatgcacatgtgtgtttaagtttcaaatacagctaaggagctaagtggaattttttttttttttttttaccaaatagcgtgtattaataatagctcagttccatttactgatttgtttttcctttgtttatgtcatatattatctttccaagagattgtgagtttatgctactgccaatttggtatgagggcctgtttttaaaagagctgcatgatattcacttggatgtaccacgatttattcaaccagtcttttctttgtcattagacatttagtttatttaaagcctttcaacattataagtaactgtgaaagatatctttgtgctatgagttgcctacattttggatcattgccactaagaaagaaattaactagtgactcaattattccttgctttttttgagcaaaaatcatattaaaaataattagatttaaaatttttggttaaattatactttaaagcaaagatccttgccatttagatctagtttggtattaaatgagaacggtggttctctactgtgttggtgggggatatgttcatgatggattttgctgtggaaggacatttggcaatgcctggagagagttttggttgttacagatgcagggaggggtgccactgacatctaatgggtagaggccagggatgctgctgctaaacatcctgcaatacacaagacagtccccacttgcccccccccccaaaaaaaattagctagcctaaaatgtcagtagtgctgaggctgagaaaccttggattaacaggtttcactgctgatgggaaacttttttttttttaacagggccttactctgttgcccaggctagagtgcagtagcaggatgctagctcactgcagtcttgaactcctgagttcaagcaatcctcctgtctctgcctcccaagaagctggaactacacatgcacaccaccatccccagctaattaaaaaaattttttggcagagctggtgtcttactgtgttgcccaggctggtctcaaactcctaccctcaagtgatccttccagctgggcctcccaaagcaccaggattgcaggtgtgagccactgtgcccagaggaaacattcggaatctgtgatagaaggggaaagttttagctccagaacacaagtagagctggctttgccttatgtgatagacctagtgaatagctcagctgtctgctttcctaatgccatttagacagatactgtatattttattgcttatgcaatgtgcttataaaattgtttatttttgtgtcttgggtattcctgaaaatgcctcatcagtgtcagatctagttgctggtgagatttggttttgctgcgtatattagttacagacctgatttagctacatgggaaagaaaattaatcaatagctgatttaacaaccaggagtttatgtttctcatgtgatatgaattctggagagagacttaagggctgttactgtggcttcttgatgtcacccatgactcaatgctggtatttctgcttacctttcttaggaatgtgcattttaccttgctgtcacaggatggctcctgcctgttcccacccctcacccccggcagcaaaacctatgttccaggcaggcagcagtgaggacaaaggtacctggagccagtcctctttgtcagcgttttcctgcagcccaacccagtggtttctgcttattcccattggccagactgtcacaggaccttagaggctgggacaaatagttttcagctgggctcattgtggtctgaaaacaaaagcagttacctttagtaagaaagaaaggatattggggctgggtgcagtggctcacgcctgtaattccagcactttgggaggctgaggcgggcggatctcttaaggtcaggaattcaagaccagcctggccaacatagtgaaactccgtccctactagaaatacaaaaattagccaggcatggtggcgcatgcctgtaatcccagctactcaagaggctgagacaggagaatctcttgaacccgggaggtggaggttgcagtgagctgagattgcaccactgcactccagcctgggcaacagagtaagactctgcctcaaaaaacaaaaaaaaaaaaagaaagagaaagaggatattggaataaacagctaatatgcacctttgggagctgctttttgaaatattggttcttgtaagttcactgaaattttttttataaagtagaacaatattggagatttgaaagaatggactcaatgcaagagatcttattagctgagaaaatgtatttatgttatgaatgtatttcttaaccccaagaacttggctgttgtattgtgttttgtaaattttaaatctccctactactatactgggggccttaccctcttttgtatagtgcacacaaagaagtgtgtttctctgggctaaaaatagaaatctgcacctgacagatggccttaagtgtggaaaatgggtgtgtgtgtatcacagaagtggaagaagtggagggagtcctgctctgcctgttgttttaagcctcccctccctgcaaatctatatctttcctatacactagtaatggtcaataggtttttgttgttgttgttgttttaatcccatttacagtagcgacaaaacttatcaggtatctaagaataaacctttattatacatttatgctaacctttagcatacctttatgaagaaaactacaaaattaattaaaatatcatgaacggcaatgcaaatggggagaataaataggggacaacttgccttccagatgcattgattacaaagctgtagtaactaaaatttgatactgtctcaagggcaagcaaatgcttctgtgaagtagaatgaggatctagaaacagactcctgcgtgtgctgaaacttggtttatgatagagcaggtgttactgataaatgcagaaaccaataaatggtattaagtcaattaactttccatttggaagggataaaattaaatttctcttccacgtgcaggctaataacagtgtcttatatcttgcaaaagtacttaccagtccattcacttccagaaaaatggagaagtttcgtattagaaatttgtgcatcatgtttcataaataaaaacttcagatactcggctgatggtgttggctcaaacctgtaatcctagcactttgggaggctgaggcaggtagatgacttgagcccaggtgttcgagaacagcctgggcaaaaagtgagaccctatgtctataaaaacaaataaacaaaatggcacctaacttttaaaatgctttttcttacatgtaataatgtgagcaaaagcataatttaatttttgctattaaaatgctttttttttggtttctgttacatttctgtatttacttgaattcttagaacactgtttcctgggagatcaaacctggccattctggatacatcagtagtgagagcttagtgcggacatagccttacagaatgtcttctatgttgaaatgcagagaacccgaaggcgcctaggatgagcctcaggcctgctggttgttgcagtggcgcaatctcagctcactgcagcctccgcctcctgggtttaagcgattctcatgcctcagcctcctgagtagctgggattacaggcgctcgtcaccaggcttggctaatttttgttttgttttgctttttccgcctcactctgtcacccaggctagagtacagtggtacgacctcggctcactgcaacctcagccacccggtttcaagcgattctcctgcctcagcctcccgagtagctgggattacaggtgcctgccatcgcgcctggctaatttttgtagtttcagtagagacgaggtttcaccatcctggccaggctggtcttgaactcctgacctcgtgatccacccacctcggcctcccaaagtgctgggattacaggcatgagccaccgcgcacagcctaatttttgtatttttttggggttttttttgatagagtctcactctgtcgcccagactggagtgcaatggcacgatcttggctcactgtaacctccacctcccgggttcaagcaattcttctgcctcagcctcccgagtagctgggattacaggcacccatcaccacgcctagctgattttttgtatatttagtagagacggggtttcgctttgttggccaggttggtctcaaactcctgacctcaggtgattccccgcctcggcctcccaaagcgctggtattacaggtgtgagccaccacacctggccaaatttttgtatttttaatagagctgggttttcacaatgttggccaggctcgtctcaaactcctgacctcagggaatccgcctgcctcggcctcccaaagtgttgggattacaggcgttagccactgcgccaggcttgttgctgaacatttatggctctagaaataattttttttttaaggagaagtaatgacaaacgtgatagaaataaaatttgaggatatttctgggttcaaaataaagtaacagttaaatagcgtgaacatgaagaaataaatattttcaggtagaaactccaaaatttaggtagatgctgtgagttttagtcagaatttgaatatgatgtggctgaccatagatacctccattgcattaattctgcttcataaagtgtttgatgcttgcttgtaggtgttgaatagagcctaattagcagtaagtaaacagatctagagcacagactttggcatctgaaggaccttggttcaatgctgggactgccacttactagctatgggatctttggtggatttttaacctttgaaagcctttcatccctcacagatataatggggaagaaaatcgtttccattagtattgtgaggattaaatgattaattgatgtaaacaatgtgctttccatagtacttggcatatcataagtgcttcatgttattttacgctggctgggaagataagttttgctgtggagaatttaagagggatattaaaatatatttttgttattttaaggaaattcgaaatgagtcccatgactatcctcatagagtggccaagtttccagaaaacagaaatcgaaacagatacagagatgtaagcccatgtaagtacttgtgggtttgtgtgcatgtgtattttttggtttgttttaggaggcaggatgtagtgaaaaggagggcttggggtcagtgttgataaatacagtaatttttttcctatttacgtaagacacgttctttaagaatttaaaggtgtagaatagtggaaggaaaaataattacccataattatttcatccttcaaacataggcaccattattttggtgtatttcccacaacctgtttttcttatgcacagttttcctttctttaaaataattgtaattatagatgtctatataatatccatatgtatttccttttcatatcattccatcgcctttgtaagttttgcttaaaatagttattggtgtagtttggtttttttccttccccaagttataagagtagtatgtactcgctgtagaaaacttagaaaacagagaagagtataaggaacaaacttatttaaaaataaataataacttgggtttatattctttggagtttttaaaaataaacatgtattttaaacggaaaattagaatcttgccacgtactcatttgtagctcttttcttagcagtacattgtaaacttttttttattataaacacaatttttaattgctttgacagtggctttggatataccactcttttgcataagttccctgttgttggacatttagattatgatgtatacacacacagacgcacacaattgtgtgaacaattataatactagagttctttggtgtattcatcatcatgcggtgattttattttttgttctgattcatgcagcttattcagatattaaattgggcctccttcgtgcttcagcatgtttccctatgtttgactttagtgggctaaacataggttttctctttagggctccctgttggtagggacttgaaaaacagtatcagattgatcacattctggtttttgcttgttactgattgttcgcctgttgactagggtatggtgctgcctgctaagatctcctgtgtaggttgaaccatttcactgttcaaggacacagactgtatacctttatatacattgtagtcattggttatagataagatatttagggtctggatgtaccactgaaaaatccatcagttactggaaaaaaatccttatttttattcttacatgaatagaatgtttttcttatgttgaccaaatacatttccaagaagggtgtattggctgattttgggcaaatcaaatgagaagcagtctctgaaaatctttcatgtttgttataaattactattaaatactatgtttctcttaatgcttttttctttactaccagttagaagtgttcttaaagacaagtagctagaagagtggttttccattttcttcagttgcagcacacttgaagatttaacccacttcctctgaaacaggtggctcatcacggtggcagttccagtgtgggtgtgcgttcagggaatagcgggtgtgggcagtaattctgatacttaggtgcccttcccctgcctccaaatctctgattgagaatcactgagctacagagaataattctctaatgttaccatgagttttgaagacagtattttccagttgtacaccttgctttgatgcctttaattttttaaaaacttttgattttgaaaattgtagatttggatgcagttgagaaataatacagaaagatcgagtatacccctcacctagtttcccccagtggtaacatcttgcataactacagtccaatatcacacctgggaacctgaaacaatacagtccatccaggtttcaccagttttacatgcactcatttgtgtgtgcgtgtaagttctgtgcagttttatcacgtgtagattcctggaatcaccaccacagtctagatgcaaaccagtggagcattcccatcacagggtcacttgcactgcctttctggggccacagtctccttgcttggatcctccttccctaacctggtgttgcctttaatttttatatatttgttgtaattgcaattattggatgcactacactacatttgagtcccctaattagttttatcgaattgatctaaatgggattttttttttttttttttttgagatggtgtctcactctgttacccaggctggagtgcagtggcgtgatcttggcttactgcaaacccctgcctcctggattcaagcgattctcctgcctcagcctcccaagtagctgggattacaggtgtgcaccaccatgcccggcttatttttgtatttttagtagagatggagttgcaccatgttggccaggctggtcttgaactccttacctcaagtgatccgcctgcttcagtctcccaaagtgctgggattacagtcatgagccaccatgcccagctgataattttattttaactggaattgagatgttttattttaaagtaaaaacatttgcaacttaagttatcctcaagtatatacatcaataaaacttatgatttttctcctcagcttttagacttatgttgtatacctgcagttgaaggctgcagggagactctttaaaatatgcgttatcaggcctccctccatcatcattgggaccaggctcttcctgtatgccttctcattgaaaagcacttagccttgagagaaccaagcttccctcctgcggaccatgcagtggttgtcctctggagctgtgctctgctgggagcagcccccagtgcatgttctccttactcttcttcttctttgccccctccctccccacacatgcctccctagtaagccatgttctcctgatctctcagaaagagactgctcattcttgcttctcacgtagccacaggattttctagtctgagccaatatgcttcagcctgcaaatggaaatgatctcttccaaggcttgtgctggccagcacatccccacaccgccttggcacctctcctctcctgacttcagtcattcactgtctttctccttaccctctccttcccaccttcctcatcctgggtgacttcatgtctctgggaaagaactacggctcattgcgctagagttcctagacctgttcagctccgctgacattgacctttagtcatcttcacctctgaaatctgaaactctgctgccttgagggctactttctgtcattccagctttcacttgcttactcccactgtacctgctctttgacttcagcaggatctttagttgactttttcatgtattgtgaagttggaaatgtattgaattgaaatttcgattaaaaaatgtagtgaagcatattactttgtcctctaacctaactattaataactttcttgttgtttttatatttaaaaaataactctggattttttaattccaccattttgtgaagctccaacttaggaaaaatcagtcattcatcctctctgcactttgggcaaatgagcgtgtgccttgggtggactccagtgttaggtgggcttggggttgccttgctgtcctcatgccctcgtctgccccactgccaccctgttccagctctgcaccgagtaaatcatctctcagagctcctcaccatgctcaggatatcgtcctgctttcaattctacagataaaaattgtaaaaatcaggaaacaccaccttagcttcatgttctatcacctggaaactcactttcttttgcccctatccttccctaaagtcccaggagagaagcctcccctccctctgtcctagccgaatccttcgtccccatcctcctcatgggccctgctcttcatcatcactgctttttgtgtgttttcagcctctttctatctcataacttcttctcttttgtataaatatggttcgctctcttttgtctcaacccttatatcctaccccagcccccacttcctttcttacctacatggatggacatttcttacctgtacacaggcttaaaagaatcaatgtgccatttgtctctccaccctccccaccatgcacacttcagcccatgcttcttctccagcctccccactgaaacttattctaaaagcactgtagctgtagttgtcaaatgcaatgagagactttccactggtttccttctctgtgacttttgacattattctcctgcttcagcctcccgagtagctgggattacaggcacgagccatgacgcctggctaatttttgtaattttagtagaaacagggtttcaccatgttggctgggctggtctcgaactcctgatctcaagtgattggcccacctcggcctctcaaagtactaggattacaagtgtgagccactgtgcccagccgaccgtgccttttttcctaaccccgtaatttttctgattttcctctttggcccctcccctattttcagggtgtctcctcctcactttgcctttatttcttcaggagtctgtttctctctccttctcactgtaacacttggatgaatgatctcatctgctgtgggcctagtttccatctctgcttataaccccaaatctcatctgcagtcgtggacttttctgtctacaggtctgtgtatccaagtcatcatctctgtctgggtgtcctgtagccacctcagactcagtatacactgagtgagtgttcctccctgacacacttcactggccttagccccacacctgccttttctccttttccccatgtttataagtggtgccgttatttacacattttctgaagccagaaacagattcttccctcattcatttcccacgtcactaatactaatttccatttccatgatgtattcctatttctttttcttttttctttttttttttttttttcaagacagggtctggctctgtcactcaggctggagtgcagtggcaccgtctcggctcactgcaacctccgcctcccaggctcaggtgatcctcccacctcagcctcctgagtagctgggactacaggtgcatgccaccatgctgagctagttttttagattttttgtagagatggggtttcgtcatgttgcccaggctggtctcaaactcctggactcatgtagtccacctgcctcgacctcctgatgtgttgggattacaggtgtgaggcaccgtgctcagcctccataatgtatttcaaatctgttttcttctctgttcacattggcttggttcaggccctactacgcttttcctcgtcattacagtagcctccaaacccatctccttgtttcccttctgttcccacttcagtccattttcatggtatctggagtaatctttgtataatgcaagtgtgttttccactctcctctctaatagtgctgcacaatttttatgaaaaagttaaacttctttagcattatcatactgggctttttggagattgacccctttacacacctctctaaatcttttctacccattttcctagaaattattcatttcagtaaaactgaatcacttggagttcttctagcgtgactggtttttaatacctcagtggcttcaaatatgtcattccctttttgaaatattcttcccctcctctctctgacccatctcaatcaaagttctccttctgcaaataccagctcaacaacctctttcccgtgagtggtattctcatccagtggaggtggtggttctcgttcactaagtccagaggggctcaggaatgtgtattttttaaaagctgggatggtgttgctgtaccttttccaactgatagtcattatgtcatttaaaaatgtgtttctggctgggtgctgtggctcatgcttataatcccaacactttggaaagctgaggtaggaggattgcttaaggccaggagtttgagaccagcctgggcaacatctctacacagaacttttttttaattagctgggacgtggtgatgcatgcctgtagtcccagctatttgggaggctggggcaggaggatcacttgagaccactaattcaaagctgcagtgagttgcaatggcaccagtgcactccagcttgggtgacagagcaagactgtctctaaaaaattttttaaatgcatttctatacatagtacttgacagttgctgatttggttcagaaaacatttgttgaaaaccagctacatgtttgatactatgctatgtatcgaataatttatggtatacttgaggagattaacacataagcatgttacagatattgtaagatatgacagtgcattgatggagctgagaagaggctctgcccaaggaggcagggatggcttttaagaaaaagaatggtagcctgaactaggtaaataaaggggaatggaaaaagaattttttaaaaattcagagtcccagatctttcttttctagatttggattcagccggtctggaaatgtttatttttaaacaatcttaacatgattcttttacactcactatggcaccactcctcagactgacatatggaaactacatttggagttctgaatacgagaaacataaaggaaaaaggatattttaaattaggaagaatttgggctgggtgcagcagctcatgattgtagtcccaacgctttgggaggccgaggagggaggatcgcttgagcccaggaatttgagactacagtgagctgtgattgtgccactgcactccagcctgagcaatgtgagaccttgtctcaaaaaaggaagaaaattgaaaggatttgaagaggtccataatctgctacaacctagagatgcctcagttgtctcagttaactgtgagacattgtagaagagatggacaagaacttcgttgtttgaaaagagagtagcttgtaatggttactttgggaaacgtctttatactattagagactaccaccaaattttgagatcttcctatttgcagtacaggtagaaatcccagtttactatttggtctaaaagggagtgccagcaattgagtcaactgtcatgtcttttcactggccatgaaacaatctgtgtgtgtgtgtgtgtgtgtgtgtgtgtgtgtgtgtgtgtgtgtgtgttaaaaacccataccataaatttcttgtaggtgtatattaacagtattgttaactgtatgcacattgttgtacaatagatttctggaacttttccatcttgtataactgaaactctaaatccattgaaaaactccctatcttcctcttcccccagcccctggcagccagcattctgctttctgtttctatgagtttgattactttagacactaaatatatgtgtaatcatgcagtatttgtctttctgcgactggtttatttcatttgacatactgtcttcaaggttcatccatgtgaaacagtcagattttaaaggaaattaacacagagactcatgattctggtagtgtcaggttacatagtccatggtttgttgctctacaaaacaaaaagattctcaaataaacatactttttaaatgagttactagagggggaagaaggaagggaaaacttctatgctttcggcacgctccctgcatgatcttagcaaatggcataactactttgaatgcagatgtcagtatcagctctgagatttgtatgcagctaataaagtagccccaagatgtattaagcaaaaatgaatagaattttggggagaaattgacaaatccatgttcatgggcttcttaataagacaagatatttgtaaagaaatagatttatataatattattcttttttctttttttttttttttttttgagacggagtctcgctctgtcgcccaggccggactgcggactgcagtggcgtttttctaggactgacatggtctatttgtaaaaaatggaccatnnnnnnnnnnnnnnnnnnnntgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggtgaatgcagatgtcagtatcagctctgagatttgtatgcagctaataaagtagccccaagatgtattaagcaaaaatgaatagaattttggggagaaattgacaaatccatgttcatgggcttcttaataagacaagatatttgtaaagaaatagatttatataatattattaaccttaatataagaagaaaaatacatagaaccctatatccagcaattagaaaatgcacatttttctaggactgacatggtctatttgtaaaaaatggaccattgactaggctgtcaagtaaatcttaaaatttaagaatgcctggctgggcgctgtggctcacgcctgtaatcccagcactttgggaggcctaggtgggtggatcacctgaggtcgggagtttgagaccagcctgaccaacatggagaaacctcgtctctactaaaaatacaaagattagccaggcatagtggtgcatgcctgtaatctcagctactcaggaggctgaggcaggagaattgcttgaatccgggaggcagaggttgcggtgagccaagattgtgccactgcactccagcctgggcaacgagagcgaaactctgtctcaaaaaaaaaaaattcctatcttatagctcataattttttatcttaatgcaattaaaatataggttattaataaaaagataaacatttccataaatttggaagttttaacatttctaaatcgtgggtcaagacaaaattataatggaaacttaaaaataaacaatatataaaatactgcttatcaaaacttgtgtaaaggagctaaaacagtactgcaatgaaaatatattgtcttaaatatttatattatattttatttattattttttagatggagtcttgctctgttgcctaggctggagtgcaggggtgtgatctcagctcactgcagcctctgcctctcgagttcaagcaattctcctgcctcagcccctcgagtagctgggagtacaggcacgtgccaccaggcctggctaattttgtgttttttagtagagacagtttcactgtgttggccaggctggtctcaaactcctgaccttaagtgatctgcctgcctcggccttccaaagtgctaggattacaggcatgagccactgtgcctagcccagtattttaagatgaaagttaaaattaatgtgctgtctaacctaatttagagtaaaaataagagaatgagaaaaaaaaagcagaaagaagtaacaacaacaaaggagcagaaatagaaatcacagttacagcacaagggaccaactaaactaaatgttagcctcggtaagactgatcaactctgtcaagatcgagcacgatcaatcaaacaagaaagaaagaaggtgcatataaacaatatcaggagaaagagtgggcacataaatacaggtatacaaagaaagcgtgaattgaatactgccaacaattttatggcagtaaatatgattttttagaaaaaatggaacagattcctagaaaaacataatttaccaaaactgactcaagcagaagtagagtctgaagagtccacttaaagacattaataaacaaaatccacaaagaaaacactgggccagctggttttaccggtatgtttcataataatgcaagtgaatatagatgtagaaatcctaacaaaggattagcaaactgaatatagcaatgtattaaaaagataatacattatgttcacattaagtttatttcaggaatgtaagggtagctaacattagaataccttttttattttttatttatttatttattttttgagacagggtttcgctcttgttgcttaggctggagtgcggtggcacgatcttggctcactgcaacctccacctcccgggttcaagcaattctcctgcctcagcctcccaagtagtttgtattacaggcgttagccgccatgtctggctaatttttgtattttcagtagagatggggtttcaccatgtttgtcaggctggtctcgagctcctgacctcaggtgatccatctgcctcggcctcccaaagtgctgggattacaggcgtgagcttctgcacccggcctagattattttataattcaccacagtaacaaaggagaaagagccatatgattatctcaataagtgtggaaagattatttaaagtccttgctgaggattaaaaatgacacatagcaagctagaaatagaagggaacttctaagatttctaagagataactgcaacaacatcactcataatgatgacatgatgaaagcattgttttaaaaaaatatcgggaacaaggtaagtgtgttcattcttaccacttatacttaacattatacttctgtctccctgaccttatactctaggtcctagttagtacagtaagcaagaatgagaaataaaagccataaggattggaaagaaataaattaactgtcttttaatctgtttatgaggccactatagaactttcatagccaaagcaggaaggttcagtaagaggaataaaagtataaaagttttatctgttgctatataacaaaccaccccaaaacagtggcttaaaacaataggagacatttattatgttcacaaatctaggggttgactaaccccacataggtgattcttgctcaaggtcttttgtgtaattgcatttcaaatgggggctggggctggagtcaccttgaagaagcaacttctttactcttgttgactgtgacctcaactgggctgtcaccaggaacacctacacaaggcatctctatgagacctggactttatcacaaggcaactgagtttcaagagtgagcattcttagagagcaaggcagaagcttcattgccttttgtgacctagccttagaagtcacatacaacttccacaacattccgtttgagaagtaactcactaaggccatgcatgttcaaggagagggtacttaatactcttattagtttgatggaggaagtatcagtgaattgtggacatattttaaaagcatcaccactatagatgatacgaattgcttcgtagataacccctctagaaatgtgcagacaagtcaaagaattattaagaaacattttgatagtcttagaattataagatgatagaccttcaaatcattaaaaagaaacctttaaacttaccagaaagtgcttgtcatctttcttagtaatagcagatttagataaaaacttagttctataataataatccgaataagtatagatttaagttaaattttatggtaactattatgtaaatatttgctaacattttttcttatcccattaaagtttgaaaataaagaccagatgtcagtgtagtgctttaccttctcaaaatccgttgttgacagcttttttactaaaagattttctcactcactgttagggtctttagttctatcttcaattttttttttttttttttaaatattcagttttggcctagtgcagtggcttatgcctgtaatcccagcactttaggaggcagaggtgggtggatcacctgaggtcaacatggtgaaaccccgtctctactaaaaatacaaaattagttgggcgtggtggctggcatctgtaatcccagctacttgggaggctgaggcaggagaattgtttgaacctgggaggtggaggtgacagtgagccgagattgcgccattgcattccagcctgggcaacaagagcgaaaaaaaactccctctcaaaaaaaaaaaaaaaaatctttaattttaatcaaagccaaatcaaagctatttatgatgttaataatttattcctgcgggctattgatgcactggagtggttccaaggaagaagaactagaactcttagagaagaagctagcattgattagacagggaaagagaaaacctaaacagagcagcatgatagctgactttagatacctgaacttttacatggaaaaaagagttctttatcctgtgttaagcccaaaatatagaactagggttcatgagcgaataatagcactggtgaatatcaggttagcattagctcttaagagctgttttaaacctacaaacgaaccctctgaactagtacacttgttattggaggtattcacgcagagggtggatcttctcactgtcagatcttctagagaatatttgtgaatgaattatagagggttgcattagattactttggtctatttcttgtatgcttcatttcttgcccctattcatctctttctcaccaatttcccgcattcacctttctgtcctattacattgtgaattccttaacagatgaaacttttttttttttttggactgacaaaaatcttgtacatagttttgtcatagggtagtaaagagagtattaaagatatcattaagtttctctttctctgtccctgaataattaaatctataaagcacttggggttgggcccacatgtggaaggcatgtgagtaaaggtggtaatgtccttgaaaaagaagcctgtaatattgggttagcattgctgtatccaggtatgaatgcatggttttcagtgagtatagatacacagataaatatgaacataggtatgtgtatatacctatatttcttatccctgtccactgggaaatcttgagagcagcgatagctgatgagccattgggcatgcttagcttttgataccaaattttattctccactaggaggagaatagagctttggagaaatggctggttccacgtctgcgacagggaaagtgtaagaatagcctggaatgtcttgtagtgacagaacataaagacatgcccaaaaaatgatgaagacatatcagaaggatgtagaagccaagctgagtccactggccaaacctgggataatctgagcatgaaaataaataatggttacaacctattgaataaaataggaattaatgtgtctatactgatgtaaagaaacaaatgaatacataaatgagggatagggaaagttctacctttgtataggttgccaactaataaatattgaaatggatactaaagttggtgggtgaaaatttggtgaagaacaaggtatttacataatcttgaagtatccctttacaaaatacttattaaatataagaagaggaatagtacctctacactggagaagtctggccaacaccagccttaaatatgtggtcatgaccagtcatgagatataccatgtcagaatcctgaaccacccgataagatgcagtgaatacttagcatctttctgagatgaacatgccaaaaatatacaaactgaactcatctatagggaaatagatatctgacaactcaaatggaggaacactataaaacaactgacttacagtttcaaaaggttaaaaaataccgtgaaagaacagattgtatccttttgtttaaaggacattattgggacagttggtagaacttgaatggtgtctgggttagtaaagtatcactgttaattttataatttcgatggctatactatgagtaagtaggattatgtcattgtagaagataaaaaaatggaataatcaggtatgtttgcaacttgctgtcatgacttgggaagaaaattctttgtgcttggaatttttctgtaagttttaaaattatttaaacatacaaattaaaaatacatataaacttgaggtactgaatcctagccagtacatgaagtcaagaaaaggaaataaaaggcatacaggttggaagggaagaaataaaaatgaccttattagcagatgacatgtagaagattgcaaagaatctacccaacaatgtcctagaactaataagtgagttaaacgaggttgtgggatacaaggtcagcatacagaagccaattgtattcctgtatattaacaacaaacacgtggaaaccaagattaaaaacacattgttgtttacagttgctctaagaaaatggaatatgttggaataaatctaacaaaatacatataggatctgtatgttgaaagcaccaaacacatggataaaagaaatcaaaagatgacctaaataaatgaaaaaggcctaccatgttcatggattggaagacttagcatagtgaatcagtcctccccaaattgttctatagatctatagtgactcatagtgtcaaattgttcctaaagatctaacacaatttctgtcagaatttcaggaagtttttttgtagataaaaacaagcttattcttttatgtggaaaggcaaaggaactaaaataaaatggctaaaatgatcttggaaaataaaaactagaagaatcactctacctagttttaaaacttaatgcataaccacagtaatcaaaacagtgtggtagtggcagagggataaatacataagtcagtggaacataatctagaaatagacttgtaaaaatatggtgaactgattttttgacaaaggtgcaaagcaatttaaaatgaaatctcacaccttacacaaaagttaactgaagatagatcatagatggatcataatgtaaaagctttcataagaaaatgggagaaaattcaggatgtaaggctagatgaagagttcttagctatgacacctagagcacaattcatttaaaatatcaataatttatactaaatcgaaataaaaaacttctgctcctcaaaacaccctgttaagaggacaaaaagatgagtacagacttggagaaaatgtaaaccacatatctgacaaagaacttagatctggactatatatagaactctcaaaatgtaacagtaaaaagaaacaaaaaccccagttaggaaatgggcaaaagatatgacacagatggcagataagcctatgaacatataaaaaacttcattagccattaggaaaatgcaaattaaaatcatggtggtgggatgtcactagacgcctactaaaacagctaaagtaaagagatcacaataccctaaaaatgcagagaagctggatctcatatatgggtggtgggaatgtaaactggtatagccactctggaaaatagtttggcagtttcttaaaaagctgaacgtatacttagcttatatgacccagcacttgcactcctgggcatttatcccagagaaatgcagtcataatgtccacacaaaagtgtgtgcatgaatattcacagcagctttatctgtagtagccccagattcgaaacaacccacatgtccttcagtgggtaagtggttaactatggtatattcataacacagaatactactcagcaataaaaaggaagaaacttgacgtaacaacatgggtagctctcagaggacttacgctgggtgaaaacaatccagtttccaatgatgacatagtacatgattccatttatataacattcttgaaatgatgagaattctcgagagggagagcagatcggtggttaggggtggaatggggaagagtgtgcctgccaaggggcacacagaacctttgtgctgatggaataggtatgtgttgttttggtcatgtgaatttgtttgtggtaaaatggcatagaactgagcacacacaaatgagtgcctgtagaactggagaaatcaaaataaggtctgtggattgtagcagtgtcttttcatgcttctgagtttgatggccttctggaactaggccctggacagcgcattgctaggagtggggctctgtggtgagtctgacagcgtccctggctgcaaagagcttaactgtggcaagaaggctgctactgggtgcctgggtgctcctgctgccctccaccagcggagctgatcagaatcttgccctaagaggcccctcttaaaagccacagcaccttgggtgggctggtctgccctagagcacttacgctgggtggagggagctgtggaagcgtgcagtgggggagtgctggagtccaggacagtcagctgtactcgggattggggtgagggtgtggttgtttctagattaaaatacagatacatgatcaagtagaattctgaaattcctttaaatgtttaaggtaaaataggaattaccaaggaattttgtactttaataccctcttagggtattaaggagggtttgtcagtgaaaataatcaagaaggactggtccattcgagccactgattttgacagacaagaaaacagacccctgagtgccccttatcataggactgtcggcgactgggatgctgatagtgtttctcaagtagtagtcacccttttctgggaaatcatgactacgtctggaatcatgtaggttggtagagccaaaagagagatcagaatccacatctttagatccctcaaactcccctcacccatgtttttcatctgcgtcgcaaaattccaggtacctgtactaagaagtcctgaaggtttctgcgcttttcctttctgccgaattagtttacgcttaagaaagtcagttaacgtcatttcatttcctgcttatggttcagaatgggttgatagtgatttgtcattctaacaaaattctagcaggtgtaggaatttgaatatgtgaaaatcttctggaattcatcatataaacaatgtttgaatacttgctgacttaaattgttatgacactctactaggtaggcccgctgagaaaatggaagtagcagtcctttttccctgacagtcaaatttaggagaaatgaatcagtacaggatttcttgactctccgaacctaaactgcagactgctcctctccgctttgtccccgtggctccagccacattcttcatgtccctcagacatgttaggtatgtaccaccttaagtcattcgccgttctctgtgcttggaacactgttaactaaaatatccgtgagactgaccccttccacatctgtgcttacatgtgacccacctgggtggtcagccacaaggcccatcctgaccaccctgtttagaattgcaacctgcccctctccccagcgctgtgagtcccgttactcttttttcttagcatttattactcatatactttacttagttatgcttattgctatatcaccaatatagatatttggtccgcattgtttgcatggtgtctcatgggcctttggatgtgatgaaagttaaatcttttcccctaagtccctccaccttcaatttgtttaggctctaactctcctagaagcggagagtctgagtttcaaagaaaatggtgcaatactgctgagcgccgtggctcactcctgtaatcccaacactttgggaggccgaggcaggtggatcacctgaggtcgagagttcaagaccagcctgaccaacatggagaaaccccgtctctgctaaaaatacaaaattagctgggcgtggtggcacatgcctgtaatcccagctactcaggaggctgaggcaggagaattgcttgaacccaggaggtggaggttgtggtgaactgagatcgcaccattgcactccagcctgggcaacaagagcgaaactccatctcaaaaaaaaaaaaaatggtgagatacttactgattattttaaagtgaagattagtatgtcttattttatacaagctaccaaagaggaaaaatgtctgttttccaaactaatgaattttacctattttgtaaagacatttctcaggtattcttttcattgcagactcttggggacagattaaagaggactttttcaattaggagatttgtggaatcagaatttaattagtgacattgtcctgtcaagtttaggatcttgaaatcatgatgggttgaaagacgctgatgatttcaaggacagtaaactattgtttggaaaaggttgaacttaccaaatgtttcctaaacaatgtatactttattagcaaagctgtgatggtgctaccttggaaatactctttacattcccaccgccactacttgattcaggcctcatcaccttttgattacgctttcagtgtattggtgtatgaagttgccttcttcttggttcagtccatcttctatgctgctgagagttattttcatgaaaatcaaatgtgtttataccagtcctttaaagaacttcactggggccctgtccagagcctgtgcctgtagcacggcccacgtgcccttcagggtccgcccttaatgtgtctggggagccctctctagccagctcgccagcctttctgaatctgccagtcctgccgctacaccattccctttcattcctctttatgatgtgccctctgctggaatttctccttcctgctgatctcactaggcctattcaggtagcaactactcaagctccttcccacaatattttatgcaataaagtatcagtactcagagtcacggcttaatataatttcttttttcctttttaaaagcttcaaacaaataatgtcttacctttagatccctataggttaaaatatgtttgttgactaaaaattgtgtatgattgctgaaagtattcaatgcagggaacagaccagttcatcatggaggcattccatcagagcgtctagttagagaagatatgtcatggactgcatcggcacagaagtggggtttatgtgagagaggagttggaagtcacacctgagtggagagcaacgtgaaaaggtgatgtcagcaagaatttaggatgtatggaaaggatggtaaaggcaccaactggatggatcagggagacatggaatgcagaatgcaggaaataggtaatctcttaaattgcacaaatctaggtttcatttttgtgctctagtgtgttacacttgtgatgacttgacttccctgagtgacagtgcgatgggtgtgatccatattcatatgcacttcatagggctgtgaggactgagagaggtgacccagtgacgagtgtcacacaaacctgacatgtcgtaggcaccaaatggttctagacagtggttctggttggttttgtggtcaattggaaacctttcatcaagtagaattttctttgcagagcaaacaattgaaatgttaatattctatgtgtactaaagtttgtattctccattaatatgggggagtatatggtgacctggtgtttagtgccagctttgtttttggttcattgctcgatttatgagagagaatgcataatatttgttgttcgactattttacttgcaggattgaagagagttgacaaatctagaaaatgctttgagttcttggacatcactgtttgaaaacgtactgattacccttagttgagaatgggaaaatctaaaggggaaaagtcactggttcacgctgtactattagaattggtcatcttcttgcctgacttgtaagttaaggatgcttgatctttgctgtgatttaacctgttcaggatgaattgtaaccagttacaatgaatacaaattctcctttctgtttgacctggaaaactttccaaaaggagatgtctttacaataatgatatatttggtgaaagctgtgggttgtttttttttttttaaagcttatgatgacagtattgaaagaggaaactaatctgtattgtcagcacagccacagctagcactagtcatttcttgagaggtggagctgtttctcagaaaacatgctgtttgagggtaggaggtgaagggactccttgtcagaaattggcttaattttaatccaagttataaaccacagttctgtttgggtattgcatttcttcatttactcagtgacaagaattaaggcagatgatgcctgtagaaaaaaaagtgtatgttcttgatagttctgctactagtgctagtagaggttgagaaataagatttcctgtgaagtgtggtttggttgcttttgtggtatcccatgcaaaagagtttgaactatcttcatttttctccctttactggatcctttaaaagaggaaagggtgagataaccagacttacaaggatggtaaagtatagtgggctttggggcttacttatacagcccaaaggttatgggatgctgctgttatgataatctcatgtcagaggttcctatggaagaggagaaaggatgtacctttctgtgtgttctcattcagaagtcaaaagtttgttttttaatgattagtttacagatttggggctgactgatagtatctgggcagggaaaagagacctgtgactcaggttgttaagggaacctgtgtatatgctctcacaaactcgaaaccgtgtgttgtgatccttaattggagaagaggtagtgcccttctttgttatcatcactaaagagtataaattataaagtcacagtttctcataaagaggctttgatagtttcacttcctgaaatgtgtatattcacaatcttttgcaatagttattttaaggtgatgtgttttatttttttctctactgcctcttcgaaatcaaaaagttatatatactttttattttatattaatctttttcaatttttgtttttataattttaatgtattttaaatttattttaaagttttatttctcctttttgctttaatatttcttcctttttaaattgtttttcatttttcctttgtatgtgtttttcttaaaagaacagaagaattaaaataatatctagtgatgtaggtatttcagttttgtttttaatcagccttgagaagaaaatacaggctcaaataacatttgtagtcagttctaaatagctatagagttttcccaaggattacctttcttttttagtattatctgataacaaaataaaaaaaaattttcctgagaaaattcaccgttcctttgcttttgttgactctgtatattaatgttaaacaggaagcgaggccactgccaggggctgagccctgcagacccagtgccctgcaggtagtgccctcctccctactgcctcccaggactggatctgggcttttctggtgtgtggttactgtgcttatagagcattgaggtaacacctcgtgcatattttacagatagaaggaaaatagcagtgaattttagttcagagtcctgagggtgaggtatcaaatactctggctgaaggtctttctctaggtttacttcctgcatagctgggcaagggtgtggggtggtgccatgtggggtaaccagattcccagcaccctgtgaggtggaccttcccgggttttatggattcctaccgcatgttagctaaatggctgttttcagttgtgcaatagatatgagtagcctttggttagtgttctttctgtgattacaacatgaggaaatacattcctttggtgtgatattttagtggaactttaattttaaaatcatgtagttttctaaaaccaggctttctttttttggtatgttgtctaggagatatgtggtctttattttaattaagttgctgacctttttactattttacataatataacagttaaagggtgattaaactgttttttaaaaaagtgatttttaaaaaaaagtgcttgttgacatcatctttctgagaacactagtatatgtgatttactataacaagatcttagtttttcctgttggcaaatgacatgtaatatttacagaggtcttgggttcagtccagcagaaacatctcagataaattgatgtgtgaaactaaagccattttacattttctttcatatggagataatataaacagttttttcatttaaaagtaaggagagactggctatttagtatggatttctttgagagggacaacttgtaatagtatgcattctctagagttaaacatcaaacaccatgtttttagttttataattcagtgatatgcatccggcagttgtgtgttgaggattctgagttaattcatgggctttttctcctggtgtcatgcttctcttgctttcccatctaaatgtataaggtcacattttgtatttcacatatttaaattagcataaattctcaatctatgagatttttacttttaaaaactagaaatatctctaaactgttaacagagtctaagtagtgaagtatcttcagtggtcttttaaagaatacagttggaatattccaactgtctttaaatattttcagcatttaacctaaacacagttcagtgctaaaatttatttaaatatagtggaattcttatctgttgagaaatgaagaggttgaaatatagtaacctcggaaatctagtctcatctatttgagaccagttatcgttttgtaggtagaccaatcaattcttaggtaccaagaatctgaatgatccttttacttttaggaaggtaagtactttattcatttaactatgtttactcctggtcgatttttcaagtcacaatggctaatgtgctacaaacagaagtgcttcctttccagcactatagtaataaacaagattgcattttatactccttacaaaaaaagtagagaatagtttaggatttgtctcaactctattatgatgctaattcatttttcttatttcttctgtctttttataaatacctagaatattaatatgaagataaaaacagtaattttgaaatgacagttgtggtttatcattctctattttcagatgatcacagtcgtgttaaactgcaaaatgctgagaatgattatattaatgccagtttagttgacatagaagaggcacaaaggagttacatcttaacacaggcaagtaatacgataccacgcaaatgtctgaaaatgatgtgtttgtgcttgttctgctttaaatcataggtaaaagtatatcttgacttcttttggaaatgaaatggtatttcagtttttttctgacgatgtaatgaattatggacattataaggttttgaagctttgagtatttaagataaaaggcaagttatttttgatattacacgttctgtgaaggaaaattcttaggaaatggcttaggccagttctttggcagattgtgttccttacattatatctgacacagagtgctgcttatgcttcttagtgtcttcttttctcttcccataccctgtggcaaaaccagaggccctggacagctcttctgtagctccccctgcctcgcatatatcttcagagagtacaccaagccctggatggtgtctggtcgtcttcaaggacctgagcgggtgctgagaccaggtgctccagaggcccagccgcaaggccttgtgctccctgtggccttctgcccagttgcctctgagcgcatcagccacacctgtgtgcaagcatgattcttccttccattctgagatagtaggagagatttttgtgtatccacagctactctttattcatcaagtaataaagacttgattatcaacagggctgtctttccccctaaagatttttaaatattcaaaagatataccataatatttgagatttttgaaaacataacttaaatcagaatgacttatttgaaagagaaaaatatttgataagtaaaaagatatgcagattaatgtaactatgagctattatactacgtcaattcacaggaaactaaaatgcattttttacttgaggtagtacagctcctgcaagtcaaaaagaaaaaaaacagcccatggaaaaaactggcaaaggacataaactcctagttcaaagaatcaaaggtggacactttgcacatgaagaaatgctccattcagtaaccagggaatgggcctttcacctgtcagaaaaggagagatttcaaagtgtataatactcagtgttcaaatactctgaccgaccaagaaagtctacttagagaaatacagtcagacataaagatatatgtgatcggccaggcgcggaggctcacacctgtaatcccagcactttgggaggctgaggcagatggatcacctgagatcaggagtttgagaccagcctggccaacacggtgaaaccccatctctactaaaaatacaaaaattagctgggcatggtggcgggtacctataatcccagctacccaggagtctgaggcaggagaatcgcttgaacccgggaggtggaggtggcagtgaggcaagatagtgccactgcactccagcctgagcgaaagagcaaaactgtccaaaaaaaaaaaaaaaaaaaaagacatatgtgatcatgttcattgcagtcttattttaacgcatcagactcaagcaatctgtaagggactggttaaataagttaatcatacatataccattagtaataatttgtggagcttgggaatagagactttaattttccattttattcctttctgtaatattggaagttttttttatgtgcatttgtattttaaactactatttagagttaaaaattttattttctgtttgaaatacctatagttgacccttgaaccatccagggttgaactgtactagtccacttacaggcaaatttttttcaaccaaaaacgggtcggaaatacggtattcatgggatgtgaaatccatgcatacagagggctgactctttgtatctgcaggttctacagggccaccagtggggcttggacatgtgtggattttggtatactgcagtgggtggggggcaggttgggtcctggagccagtcccttgtgtatattgagggacaactaattacattaaaaaatagagaagaattaccaccctagatcccttatcacaaccctttctccctctgtactgttcttctccattatcacttactggttttttgttctcttcttagttcttaaaaacataggtcttaagattctaaattagcttttttttttttcctccagtctgcactacagccctttaagaccatggttttcaacctttgtaacctaagatagggtagactactgtcatggtacctgtgctggaatcttggtgccagcatttcactgggtattcactcacccagcaaagacttactgagacctactctgtggcaggcattgtttaaataaaacagactttcataaaaaccctattatgaattttatgaattttacattataataggaaataataacagttaaaaattttgtaatggtgtttttacatgctttgtataatttaaaccttaggacaaccctctgtggtaaatagtattacctttattttatacacgaggaatctaaggagatccagagacattaaataactttcttttttttttttttttgagatggagtctcactctgttgcccagcctggagtgcagtgatgcaatctcagctcactacaacctcctcctcccgggttcaagtgattctcgtgcttcagcctcccaagtagctgggattacaggtgctcaccaccactcccagctaatttctgtatttttagtagagacaaggtttcaccatgttgctcaggctggtctcaaactcctggcctcagatgatccacctgtcttggcctcccaaagtgctgggattacaggggtgagccaccgtgcccagcctcctagtaattgtttttgaacttcttgtcgctgtgtgtgtcctgaaggagccctgcccatttaatgcgagaactcagaagcctgtgtctggctttttcttctctcctgaattcctctctatgtttttcaggtctctattggatatttttactggatttcaaagtctgcatgttctctgtcttttttaccaaggtagctgccttcctatttttctcattgggattgagactgtcctcattgtctgccaagttctttctgatcttctattgcccctcgcttttttcagagctctcttcaattacacctgtcctgttgcagcagctttttaaggtctccccttggcaccatccctgtcactctagtggtgtagtcaccaactacatccctccacttctacctcactgatctatttgtcttttcccaaatatgccctaaactttcatgcactttgccttatgcttggagggcctggagtggaccctaactccctcccattcttctgcattccctctctgtattaggacctttttcgaggctcttctgtagtttccttcccagcctttcctgctccctaagacctgatggtttaatttgcccatactcttgtactacttaactgtgtccattagtcatacaagtacttctccttctacctttgcaagctcttaaagagccaagactgcatctcagtctagctcttggccttgcatctagcaggttgtttggaatggaggatacagaaaactagagatgcagtaacccagctcttctgattgtcctttgtagattgttacttcagtcatctttttcttctgagttttatgaattagtatttttttaaaagtcacctccttggtgtattatgtctgttttgcagatgaagaacattggtagcattgctggtaaatggaagagctgagatgtgaatctctgttcctctgatttaaaaacctatggctgggcgtagtggctcaacgcctgtaatcccagcacttggggaggctgaggcaggcagatcacctgaggtcaggagtttgagaccagcctggccaacatggtaaaaccccgtctctactaaaaatacaaaaatcagcctggcatggtggtgcacgcctgtaatcccaactactcaggaggctgagggagggagaattgcttgaatccaggaggcagaggttgcagtgagccgaggtcgtgccattgcactccagcctgggcaacagagcaagactccagctgtgttcctgtttattatttagtctttagaatcaccagtggaatggcatgggttgtgattgtgtgtatacactaaggagtaacctcactggcaaattgctacatccattttttttttcctaattaaagaaaaaggtattcattttactggggatttcctcattgctgtttttacctttagactgtgttttgttttagaagtagatcaagtaatagaaaaataagttgagtgaggaaaacgccactctcaaatattaggttgtagtttgtcaggatcctcagtagacttctagcatttttacaacttaaccttggtttattcatttaagtaatatttattgagtatctgctacataccaaggagtacaccaggcctaaagatgcttttagtcagctgggcaccatggctgatacctgtaatcccagcactttgggaggctgaggcaggtggatcacttgaggtcaggagttcgagaccaacctggccaacatggtgaaaccctgtctctactaaaaatccaaaatttagccaggtgtggtggcgggtgcctataattccagctccgtgggaggcttaggcaggagaatctcttgaacctgggaagtggaggttgcagtgagctgagatcgtgacactgcactctagcccgggtgacagagacaccatctcaaaaaataaaaaatgcttttagtctagaaccactttaacccccttgttgtatgtgggtctgaagctctgggcagccctagcccccactcctgactctgcccctaactcataccactctgctacattccatgtgagttgaatgcatgttcatagttattttaggtgtagcaaaactacatctcattttaaccttctcatttaaaactcgttaaaatttgtacataggcttttcatctcttattagatcttccttttgccctatgctatcattaaaatgtgaaagcaattggaaatacatgaaatattttgcttttatccccatggcattgttgtaacatggactgttgcccctttttaactctgcccaatactcttccattgaggccgtacatactgtgcatttgtagattaacagtttcattgtggttcaggtactttaatgattcctactttttctagaaatctttttgtagttgacttgagttggttggctggccagtgatggtacagacttttttctcatggattttctatgatgtgtgggaggcacatcctcttggctgtagaagatgaagaggacagaaatttccttggtctaccttctttgcagctagaacatgatcagtcagatactcctactcgtgattttgtctctgatttgcctatagattgtacatgaatactatagccaccttcatatggcagtgccagcaaaagcaaggagatagtagtgacggtatcaagagcagcatcccaggttgactttctttggggcaggaccttgcttgtgtcttaacccttggttcctacccaagtttgtctctctagtcctcaactctgaaagccacttgatatcttacacaattccttttttgcctgagaaaataaaagtcagttttgatcatttacaaccaaaaatcctaactaacacagacctgtttttgaaatcaggtagattggaagtcttggtttacttcttataagcccgtccgctgtctgtcttgtaacatcccaggagcagacttaacaaggccttcctggagccttgctctttctgtctgcttccctcatctgctctctctcctctctcttcacagggtccacttcctaacacatgctgccatttctggcttatggtttggcagcagaagaccaaagcagttgtcatgctgaaccgcattgtggagaaagaatcggtgagtaatatttaatatttacaacttagtatactgtatgtgatcattagcatataaagattttcattttggggccaatattcattccttagttttggcctttaattgctaaaggctagcggtcaaagtgtttctgtccggaaaaactcatgtatccttttcctttcttaagtatttttataacaattgcagacctttcatctccaagatagaaatacaatggaataaatatggactagcagtgacatatagatctttggaatccctaggaatccttattgacctattgtcaataagtcctcttccagctttaagatcttgtactgttctacttcagatttcttactttattctacatttcataattgctggtttttaatgatgatgaaaatttcctaatccatttctaattagatgtggcaatgacatgccagaatttccagcagtatcagcatagtcatttacaggggtttttcctgatcttcaatatcatttaaaaattaaggattaggccaggcacggtgcctcaaacctgtaatcccagcactttgggaggccgaggcaggcagatcacttgaggtcaggagtttgagaccagcctggccaacatggtgaaaccccgtctctactaaaaatacaaaattagccaggtgtaatcctagctacttgggaggctgaggcaggagaaccgcttgaacctaggaggtggaggttgcagtgagccgagattgtgccactgcacctcaacctggatgatagaatgagactccatctcaaaacccactgcactgcagcctgggcggtagagtgagactccatctcaaaaaagaaaaaaaaaaaaatcaaggattatgacattgtcagtttgagcaccattgtagactacatgatttgcaaattttatttctctcattttggagtataattactgtattaataagataacactgccaccagaatttagaaatcatgtttatggtggttgaacctagatggttaacaagagtcaggtttaattattttggggaagattacttcagaggtggtgggtaatgtgttattcatcaagagacccataatgtctgattattgttctttttatttcattaatagccattattggtcagtgttcagcttcttaattcattatgggttacaaatgatgataatccaattctgtcattacttctcttaaaagcagttttccaaaaaaaagttgattccctattgaggtcatctgttctcaacagatgaccaattaggagtttttctggtggagagtggcaggagaggttgaattattatgggtttggacatactggattaattttactcctttgcagttattttccttatttttgatcaaattaccctgtcattggctagcagcaatgtctttaggttgggtcctgagtcctcttttttttttttttttttggagacagagtctcgcctgttgcccaggctggagtgcagtggcatgatttcagctcactgcagcctccacttcccgggttcaagagattctcccgtctcagcctcccgagcaactgggattacaagcacccaccaccatgcccagctagtttttgtagagatggttttaccatgttggccaggctggtctcaagttcctgacctcaagtgatacgcccacctcggcctcccaaagtgctgggattacaggcgtgagccacctcacccagctctgagtcctttttaacaaacctttaatagtttccttggctgggtgcagtggctcacacctgtaatctcagcactttggggagctgagttgggtggatcgcttgagcccaggagtttgagaccagcctgggcaacatggtgaaactctgtctctacaaaaaatacaaacattagctgggtgtggtggcgcatgcctgtagtcccagctacctggggtactgaggcaggaggatcacttgaggccaggaagtcaaggctacagttagctatggtcgtgccactgcactccagcctggggacagagcgagaccctgtctcaaaaaaaaaaaattttttttgctgtctgtaatgactgcatctcaggctcatctcaaactcttgctgcccagacctggaaccagccatttctctaaggagttttggtttcttttaatgggcagcagtatttcaagatcacagcaaaaataaggatatatattgcaactggactggtcattgtttttagggcttttcagtggacaaaagctaaggaacaatatgcatatgttaagataacatacttcaagagttcataatgatattcccagttcaaatttggaactataagtgttgcttagccccttccatcttacatctgctatttcctttttcataccaagaatcctggttctcaaagatatgagagatgtaaactatcttgtaatgactcatttccttcttcccatatcatatacaatatataaccataatcatgatatcatctgctaccaaaataattactgaaaatggtttacaatttttaatatttttttcattctcttcctggtgtttctgagttgtactttacaaactgtagtctctcccttacatctcttgtagactcttagttctacaagcaagcattatttaatattcatcaacagtctttgctgatgtctctccagtcattctgactaaagctcattctctagtggctcctaaggagggacttgtgagcattatagtctgatttttttacatgtcagtgatggttcatctgctgtcttaatatctgaaagtcagtttggcgggatataaaatccttggctcatgtgctattctttgaacaactttttttttccatttccttctggtattccaccaaagtctaatggacatcttatttcctttataagtctcttgttctttttatctgcactacccaaagaattctttttttctttttcttcagatattattagttttaccaaaaatatgtcttagtaattggccattctgggtcagtttttacaggtacatgatgtgttcttgagagtttgacttcaagtactttttaaaattttttaaatactttttgttaaagaaatatttgttgaattacagtccttagtatttgttctgctcccttgcttgctttaatgttcttctttgggtcttcctattatacgtatgttggattttctttgcctaccttttttatttgtcacgttctctttaatcctgtttatctctttatttctattttacttaaaaaaaatttttttttttctggccaggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaattatttatttccctcttaaggcattattattattattatttttttttttttttgagacggagtctcgctctgtcgcccaggctggagtgcagtgctgctatctcgactcactgcaagctccgcctcccaggttcacgccattcttctgcctcagcctcccaaatagctgaggctacaggcgtccaccaccacacccggctaatttgttgtatttttagtagagacggggtttcactgtgttagccaggatggtctcgatctcctgacctcatgatccgcctgcctcagcctcccaaagtgctgggattacaggcgtgagccaccgcgcttggccagcaacatttattttgaagataaaattattgcaagagtttgataattttagaaacataaagtgaatgtcccatgacgttaaaatataggtaatcatgctttaagaatgataaatttatttttattttatgaatatgatacctatggcttttttagtttataagttacaggaacacttaaaaaataccttataagaccggacatggtggctcacgcctgtaatcccagcactttgggaggctgaggttggtggttcacttgaggtcaggagttcaagaccagcctggccaacatggcaaaaccctgtctctactaaaaatacaaaaattagctgggtgtggtggcagacgcctgtaatcccagctgctcagaaggctgaggcaggagaattgcttgaacccaggaggcagaggttgcagtgagccaacatcacgccactgcattccagcctgggcgacagagcaagactccagctcaaaagaaaagaaaagcctatggagacagaaaatggatcagtgcttgcctgtggcttggagtgggaataggacacaaggggatttctgagtctgagagaaatgttctaaaactggcttacagtgatgactgcacacacataaaaaatgctttataaaatttcaatctctacccgccctgctccccgagatggagtcttgctctgtcacccagactggagtgcagtggaatgatcttggctcactgcaacctccacctcctgggttcaagcgattctcctgcctcactctcacaagtagctgggattacaggcgcccgccatcgcgcctagctagtttttgtatttttagtagagacagggtttcaccatattagccaggttggtctcgaactcctgatctcaggtgatcctcccgcctcagcctcccaaattgttgggattacaggcgtgagtcaccgcgcccggctataaaatttcaatcttactaaaatacattaagcgtagaatatagtagtgacttcttagttttgggtacttgaaaaaatatagcatgtatatatctggtttgttttcattttttaactttatggtttcatgatgtctataaactaaaaaaaaatcatatacatatttctaaatttaggttaaatgtgcacagtactggccaacagatgaccaagagatgctgtttaaagaaacaggattcagtgtgaagctcttgtcagaagatgtgaagtcgtattatacagtacatctactacaattagaaaatatcaatgtaagacctttcttgcccgaaattgtggactttatatgatggtttaaagaattattctttattattagatttgaagtttgataagcacatgcatttggataatacctatagtatctagccataatcacgtgtttttagattgtgtgtctgcatctagtagctttctgaggactctgaagaaacagtagaaactaagaatttcaaagttcagtttgatatttggggattaaaaattaattaatagaaatacatgaggattaatagagagggctttagaatcaggcaaacctggattcagatccagctctgctgcttagtagagctgtactttagacttgttccccaccctcactgatcccttcctcatctgtaaaatggaggttaccacgccttccctccggggctgtcctgaaggtcaaatgaggatgtgtatgcagagcacctgaccttagtaaatgcccagcaagcaatagctcccaggacctgtgactgccaagaatagcaaaatagtcaagaaaataacttacaaagctattgttaagtgattcacaacacaaaaatttgtccctattgagttggaaaaaaaatggtgttttatatatatatgtaacacgcacacatacatacatacatacacacacatgtataaatgtggcatgtggtctcaagaacatttacttgggtgtttgtttggttggttggttggttggttgattggttttttgagacagtcttgctttgccacccaggctggagtacagtggcataatcacagctctcaatgaggcctccaactcctggcctcaagaaatcctcccacttcagcctcctgagtatctgggattacaggcatgagccaccatacctaattttcttatatttttttaatagagatggggtcttgccttgttatccaggctggtctcaaactcctgagctcaagcgatcctcccaccttggcctcccaaagtgttgagattacagtcatgagccaccatgccaggccttacttgcatttttcttccccagaaacatatgaactgttccttgggccttggttgaggtacatacacatagtgggttatgaacctgctgttgccagggtgatgattgaggcatttctccccctttcgccatttacctcttttgccctctttgtgttgtaatagaataaactagaaaataatgaaatgagagtaattctgagatgctaatagaaactgtgatagcttgaaaataggagaatgtttagcctcatatgactttaggaatgtatgtagtctataagtgaaatactgttttagttaaccattaagtaaattaagtgatcactaacaatacaaaaaaaccttaaagagaagggagatatatacatgctttttagatgtgtggcagtcccttttatggtggatcccttgaaacacttgtgttttttgctgcattgagtaagcacaggtgcatgctctgtgcgtgaggcctaggttctggttttccttctgtccagcttcccgtgacatccgtactaagcttattatacagtctcttgagtcacctaaaaaggctcaaaattacgaatgataatgcttagatttatttatacattcccattactatatttattttgtcccaactctttccatttacatgtgtcttaaactgcattgagatacatcaataactctttgatactggactgagctgtacattgttcattcccagaaacagaactgtatttccacaaggttctgaaagttctctgaatcatcttctcttggtatttatcccaggtaattactcatttgcttatggcattaaaattgatttagatgaagggcatagatgtgtttccctgtttctgaaacagtccttattgagaattgattataccttaagtaacaataaaatagaatgatttttgtgttttgtttatcagattccaaaatgctttcacatatatatcatctgaccagtagtcttcagttagtgtagatagtgtaaatattcttattatccccgtattttatattataaaaaataatagttaaaatccattaggttataggaatttttccatcgattacttagctaataagtgacagactgatctcattagttctcctggtcccctattttttaagacaaagtctcattctgttgcccaggctggagtgcagtggcatgatcttggctcattgcagcctccacctcctggattcaagtgattctcctgtcctagcctcccgagtagctgggaatacaggtgtgcaccaccacgcctggctaattttttgtatttttagtagagatggggtttcgctgtgttggccagactgatcttgaactcctgacttcaggtgatctgcccgcctcagcctcccaaagtgctgggattacaggtgtgagccaccacgcccggccatctcctaacttttgacatggggataagtccttttgaaaagatgctaattgttgtaaagagagattattgattctgaagcatctttctggagttgaggccatcatgtgagttggccagccactctgttttagttgctagcaactgtgtggtataatgacatgatcactggattttttattggcctgggtttagaacataccacaatataatagcaagaatttgtttgtgttctactttataatttttaattagaactagggattctttattctttagaaggataaagtagcatttcagtatgagaggcagaattacatttgcctaagtagataaactctagaatcagatagcccaagtttaaatcctgactctgccattcttgctgagtgacttgggtcacattactttactatagatgataaacagtacctgttttatcatctataaaatgagggtgataacgtacctacttcataggattgctctaaggatcaagtgagttaatatcatgatggtgcgggagccacaattacctttttagttgatcagtttcctttttgtaacagtaatgaattggaagggacaacaggaaccgggagtagttgaaaaggatactagcaagaaagaaagaaccaatgggagtgagaaaaagtgatgatggagtagggggctgatagccaatctcaacacgcagatctctgtctttattggagtcgctggggtgcagagatccagtttgcatctaagggagtctgacacgtatctattaacaagtccaaaggtaaagctgttgtctaagcaagccctgcgcctcctccagtctaatggaacagcaaaatgacataccaggagccctttagtgacttacttaaagctaaaagtttgaactcttgcccctgaagaagagattgcatctcggctttcagtgtggcctgtggcttaagctatggagataattttgagggattttaaaaatataaggtcatctagagtacttgtctttcagttttttctttttagttgcccttcactatttctgtaatgttggcccgctttatgtttagtgagttccaggaatactgttataatgctgactgtcttctatttccctgtccctaaagatttagcaagatgagagtctctaattattatgatgcttagctgggatttggttcaaaatagtttaaacagtttattctacctagaatgtcctctctcttctctgcacgtccttagtaacccctgtggcccacttcttacttaggtctctcctaacatgtatctatgacacattgatccctaacagctatgattcttcttatactttttcagtaatttaaattttatcattctactgcttgttcaatacatctctctatgtaaatcttgactccataatgaggtttttaacttcgaaggggttggaagttatctgctgccttggtacccccccgccattacacaagagtacattttaagcacattacacctgagtgattgttgtaaaacacagatgcaatctttccaccatcctctaagaattcttctgtggcttccattggttaccaaaaaaagtctgtgtccagtgcacaagaccatgacccagctcagcctggtccttgcctccttgtctaactccctctccttcgggtatccaggatttgttcgtgctaacagacagacttctctaataggtgaattccttggtgggggtgggtggcatgcctttgcatattgctttctctctgctgagaatgcaagcctgtccctagccgtttctgccactcctcctgatctggtgagtttgatctgcctttcacaatgaatcccagtcagtaaatatttatcactgacatgctgaccctggcaaaaattgatgagagactcaactaaggcagtgatagtgaaggtacagatttgacatctggttaggacatagggttgacaaactttgtcactctttaggtgtagaggaaatacccaatgaagaggttgaaaatgtgttgagttttacaattgactggagctttctaggggccacaataaaggcaattggtgagtatagttgttttaaaaatatccagtatctgttaagcatttaccatgtgcagggatatggcaggcacttcacattaattgttttatttattccttaacaacagttttgtaaggtaagtagtattattaaccctatttacagatgacagaactggggcttagtgaaagtcttttagaaacaaaatcttggtaccttccatatatacctaaagtgtgaaagtaattgggcctggggtcatagagctgtatagattttttatgataattggaaaatgtataatcttattatatatttatgatgattattaacttgcatttgaaggctgtgaacagggcatatgcttaaattgctgtggcctaacaattcctgttgttacacttgctcaactcacaggttattttcctggcttcatatatgcaagtttgacattgctgttcaaagactttaaatttagaattctcttttaaaaatgtaaatgggattttgccttagaacagcaagccactgacattttgtgcagaatgtagtatacataatgcagagttttacacagaaaacttggcaggcatgtgtggaacggctgcagacagggacagcctataattgtgggtgcaacccgcgtgtgtgtagggaggggggtgaagcagcgagaagggtggagggcagcagctggggaccagaggagaagtagtgtgactcggtgaccaaggagaagaaaagggtgcttccacagttttgaaaataaggagtttgccaaaaattgtaaagtctaaatgcagaccttgtttggaataaagatgaatttcgttttagctctgtatcctttggcaaccctttttttcccctctcattttttttcctgcgtgaaaaagagggaaaggggtccatccagtcatgcatatgaatgtttctataccagagtagtaaatatatgcatcttatgccttcgtgtggtcctttgtaactgtgaattatgattttggaaagctgtgtttttttaatcttgtttctgtaaggataaattaatcaaagttaacctctcaaaaaagtcctggttctgtaggggggaaaaaaaacaacaactgattttcaaaaatctattagtggggaagactatattatacaaatagtcatgagcatttctgggaactggcttccaatatcccagacagcgtgacctgaatgtgaaaaaaattgagaccactagttttgagccaaaatcatacaagcaaagagaaagcaagctgttgcccaagattgtggggtaaccatatgtttgagccaggacttgatgaagtaattgtgcgcaggaccccgtaggggtactgggccgtagcccacagagcactgcaggcccctgctcaaagcagaccacatgaaggcccacacagactgagtctggtcctgctggtggccgcagcaagtaagaaacaaagtgggttattaacatccactggaatcttaacctcatttaaaggaaaacttgactttgagttaactgtatcccccccaccccccgctgtcaagaacccacctctctagctcattcctgtgtcagtgttgccgtattaactgcccacctgctgctttgtaaaaggagactagagtttacccttcttattttagaatgttttgaattctcttttttaatgcaataaatttaatttaccttttttttttaacctacaataagattgattccttttggtgtacagtcgtgttgtgacttttgacagtgcattcagtcatgtaaccactgcccataacagaaacatagatcggttctgtcacctctcccctgccccagatgttcttgtgttgcttgtgtacagtcagtcctgtcctctacccccagccagaaaccagtaatctggtttctgtttctgtttttctgccttttccagaatgtcataaaaatggaatagtatagtatatagcctttagtctggctttgttcacttaccataattaatttaaaaataaatgtcttaaagcgtagaaaccatgatcattttaatttgtaatggagaaattttttattgcttttagtatattgagaacttgtggatcacactgtatttgaaattattaatgctggatgttaaaaggtcactaaaagtatgtactttttagaaaatttatttcactgtattttattagtattataccttatatactgagtctgggacatagaagtcttaatttctactgcaaaatggattttttttttttttttttgagatggagtttcgctctcgttgtccaggctggagtacaatggcacgatctcggctcaccacaacctccgcctcccgggttcaagcgattctcccacctcagcctcccaagtagctgggattacaggcatgcacctctatgcccagataaggtttgtatttttagtagagacggggtttctctatgttggtcaggttggtctcgaactcctgacctcaggtgatccacccgcctcagcctcccaaagtgctgggattataggtgtgagccactgcgcccggccgaaaatttatatttttaaagcgaaagctaacttctaattttgaaaatttttattgggagcaggatattataataataatctttagttgttaaaccattaaacatcaaggttttttacattgtttctatgcctcctccctcaaaaaaaaaaaacctcctacaataaaactgaaaaattgcacaaagacatattagtggaagaccactgcttcgtttacacaaatgaagagtataaagcagagaagtgctccttggggcaaaaggcaattggcaaaaagctaaggaacattttcataatgagttagaaatacagatcatcaggaatatccaggaagcgatagtgaataccaggcaggcttaagagacaggaaacatttagcatgttggtaaaccactttagcacatcagcaaaagcatataaacagctttaggattggaaattattgccatggggaaaggcaacaatttagaggagcaattccaattaaaaatataaagatcgtttctttagattaattcttgagttgctcccctatgcctgtgtagcagaatctaaaagataatcatgtgaacgggagattatatttaaaaaataaactttgaaattcataaaaaggaaaatgttaaagaatgtaaaattatactggtagaaaaaaaatttttttttttgaagatggagtttcactcttgttgcccaagctggcgtgcaatggcacgatctctgctcactgcaacctccacctcccaggttcaagcaattctcctgcctcagcctcccaagtagctgagattacaggcacgcgccaccacgcctggctaattttttgtatttttagtagaaacggggtttcaccatgttggccaggctggtctcgaactcctgacctcaagtgatctgcccacctcggcctcccaaagtgctgggattacaggcatgagccattgcacccggcagaaattttttaaaatagaaaaaaatagcccattcatgatacatgaattaaagaaaatattggtaacatgtatggtaacagattagtagctgagaacccaaaggctgccccaggttgcttcaaatcctggttctgccatgttccagctgtgtgaccttgggcaaactatcttaccctttgtttcagtttcctcatcaggaaaatgggctttaataggattattgtgtggattgagttaataagtaaagtgcttagaacaggcctccaaaatagtaagtgttgtatgcgttagctattattaatacatcacaaatttccactaaagaaaatcttccctagtttgtatatgggattgtcagaaaacaaatggaaaaatcatagtataaacagcctatatggctttaaagaattatataaaacacatgatctttctgaagtagttttttaaaagaaaaaagttagaactaacttctcccttgattttcactttttagagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttggtaagtgcttcttacgatctcattttaatctcattgatttttttttttaaattgcttccactggcagtgaataaactctgatgctgtatcccagaactgaggtttttcaacttaaacttctacttttggaaaaacctaaaaatctcatttccaccgttgcaactgcctcttattcatgactggtaggaatgtatccatgatgattttagagatccctaagaaggtgtttttcttcctggtagctttatattacagaaataataggtctctcccccacattttttcaaatataaattcatatgtaatattgaattccttcctcctcagacagatactttatctcattttttaaatttaaaaactagggataatgatagacatacttcacagggttcctgtgagaattcaatgaattaatacattaaggagacttagaagagtccctgatgttttctgagcattccataaatgtcagtattactgttactcccctgaggttcctgtctgtgcccccaacggctaattctttctccaccagtcattcccagtcccagcctgtatacagcctagatcttttcttctctttttaggacctttattttttcgttacttgggatacatgaaacttctgtttgcccttatacttctcctaacttctgtctttacttcttcctcttattataggatcaaacccaacaataatactgtctgctttgatttccatgccatctactccttcagtagtccctgcagcttagtttctgctttctgagcgtgttctaagattatcaataacctaagcagtttagcttgtcctggtattcagtctggtggggattttgtttttgtctttgtttagacagagtcttgccctgtcacccaggctggagtacaatggtgcaatcactgctcactgcagcctcaacctcctggactcaagtgatcctcccacctcagcctcccaagtagctgcctgcaccaccacacccaactagtttttgcttttttatttttagtagagacaaggcctcactatcttggccaggctagtctcaaattcctgggctcaagtgatcttcttgcctcagcctgccaaaatgctgggattacaggtttgagccaccacgcttgacacaagactggtgttcttaaccttgactttaaggccctgtattagtctcttcgatgtttctgtaaaacgtagctatgcttcattgcagttatgtcagcattcttatgctttccaccatgactgccagcacaaagtagattcccaggtgaattaatatgatgatgcttttcattgtaaacacacacacaaggagcttgatcaatggagtgatactcttggaaggagtgatactcttggaagaacatttcagacgttgcatctctaatgaaagctaggaattgggaacggttgagtcttaactaaacatctgtattactttaccactctgcgtatatatagtatacttcaatcaaaattagattgttacatcaaagttttaaaactctggtgattattttgttaatgacacctgttccctgccaactataacttcaacaattttttttcttttatttttggtgagcctgggtgtggggattctaacactaggtcagtagtccagagcagtgctgtagctcagcagtgttatcgtggatctgggcttttgctgtcttttccaccgtctttcttcattttattttattattctatttatttatttatttatttatttgagacgaagtttcgctctgttgccagggtggagtgcagtggcgcaatctcagctcactgcaacctccgcctcccgggttcaagagattctcctgcctcagcctcccgagtagctgggactacaagtgcgtaccaccatgcccagctaatttttgtatttttagtagagacggggttttaccatgttgtccaggaaggtctcaatctcttgacctcataatctgcccaccttggcctcccaaagtgctgggattacaggtgtgacccaccacatttttatttatttatttatttatttatttatttatttatttatttatttatttttgagatggagtctcgctctgtcgcccaggctggagtatagtggcactatctgacctcactgcaaccgccgcctcctgggttcaggcgattctccagcctcagcctccaatgtagctgggattacagacatgcgccgccacacccagctaatttttgtatttttagtagagatggcatttcgcgatgttggccaggctggtctctagctcctggcctcaagtgatttggcctcccaaagtgttgggattacaggcatgagccatcatgcctggcctcttttccaccattgttagatgggtgctgtatatccagacatcgtgtctgtagtgcagacatgaaggaggcggaaggggaatgagcagaaaggttgactcctgccatgacttttaaaaaaaaaaatagtccttatactagccagaactggttataaatccttcctttaaccaatgactggccagaaggaatgagattactatgattggtttggaatcagttgtgaatcagctaaagaatcaaagtcctccaactacttgaggggttgagatgtggggagggatgagtaggctgggatagttgttgtgtacataacagttatagctggagggttaaattatcgttgttctttcagaggagaaaatgcatagcaaaaatcttagcaatgatcttgcattgattctgtttcctgggttccaataacaagacttgtctcattttttgcctttcttgcagatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacaggtaaacttcatacaggttttaaatcatatctatttgttaaatacacatagcatcaaataactgcactccacttgagcccttgtctttgtttcaaagagtgtatttgaatttttgtggtaaatccagctggctgtcttaaaattgtaaaattttagctagcttcctcatatatactcagcctcaggttaaatcctgtgtgttacttaaaagcccttgtagaaacaagatttcattaaagaaactgaatttttcattttgggggtggttaatcttttaattattaaagtaactggaaacttgagatacttttgccttcattaaacactgatacttggtttatgtgatatttgactttataacaacaagcaacttgaatatttatggcagatataatgaaattccagcaaaatgttatattcttctggttggtggctttattctcattaagctatttttactgcatatttgtagaacctaagttcaaagactgatcagaaacttgtgttatgtactaagttaaaatgtaaaatagaaacaaccacagactccattttttgtctggtttaatcacatagtattggacataagcagatactgtaagttgatgcataatataagaagatcgactgtcttttcattatgtttctcatgtgtgaacatatttactagcactttcatttctctgattactagccaatataagaatgtaaattagatcggaccattggtgtcagaataaaggtttatttaaaaagattttttccaaatctttaaatagcattaaaatattcttaatgcacagaaacattagggcactcagagccaaaatacgcaatgtttgggaaactcagcccattagaacatgtcctgcttcagacgccagactttgggaacactggatttgccagggtcactttggcagtgatcagtgatttaggtgaagtaaaagttatttcagatgtttaagattaggaaaatttccctttctaatcacagtgagctttcaccaacttaaatctggagttcaaaaagaaaagtagttcaatcagatttccccatgccttcacagcctgcatgccgccttccctgcctgcttcctggctgtgatgagacgggtaactgggagggaaatgtattgtcctttggattgtgtctttcctaccactgctttttttttttttaagttttgtgtctttagttttagaatacatactttatctgagggtggatctttttttatcacagagatgagtttttctggacacacttttttgtggagtctttgacagtgcagtttgtggctagcaaggattttttttctgttaatttatctggtgtgatattgtcctcaggctctcaattctaaggcattttctgcccctattccagataggatattggaaacatctttatccttcaggtactcaggatcagaaaagcatgctgcccattccaaggggttaatttctgcagaaatggtcttggcattctgagaatcttttttaattggtgcatttagaccatcggcatatgaagtgattactgataaagttggattaataaatacataccacacatgctactggtttttttttctttttttgagacgcagttttgctcttgttgcccagactggagtgcaatggcacaatctcggttcactgcagcctctgcctcccaggttcaagtggttctccccactcagccttccgagtagttgggattacaggtgcctgccaccactcctggctaattttgcatttttagtagagatggggtttcacagtgttgaccaggctggtctcgaactcctgacctcaagtgatcgcccacctcggcgtcccaaagtgctgagattacaggcgtgagccaccgcacccagcccaaagtgattgtatcttaagtctgtaaatatgtgtaattataatcttaaagcatgtattcatttacagaaaacttccaatgactttgacattcctatagacatataggctatttgcaattgcctttcagcacaaggtcaggcataaatacttaagctggttgctggtattaccacatatttattagcatattcccagtattgatgatgacagttaaccccccagagtaaatatctagtttggcaattcagaactaatgttgtaagatctctagctggtaatttgatattactaataaagtattaaatgtaaatgataaacttttaacaaattacagaggatttgaagtttaattgcattgcttaaagctttcttcagtgagagaaatgggtagagctagggttctaggcattgtgtggggggcatggctcctagtggcagtgactcatgggttggtgcaacgtgagcacagaattagaaagaaagatgaaacagtaccaggcctcaaaatgagagctcctttgaggttatagtttagtgaaatgtaattccttggcttcaccagtcagcattgatgacctgaggcaggtgactcaggagtgctggctcccttgtgtgtcacagggaggacagagacgagtgagtttgctgaacctatataggcatgagtgagtttgctgaacataggcacgagtgagtctgctgatcatagccatgaatgagtctgtcgaacatagccatgagtgagtttgctgaacatagccatggcaaaatgacattgttgggtttgtggggtttttttaattcactagcattaaatatctcttttatttctctctctgccgagtgctttccttgttgacgtattctgaatttgttgcatattctgggaagtggtccagtgagacttgatttttggtgtcatcttatttgttgacattgttgagtgttgtccagctataaggccaagttacataactaggtctcagtcaagagtggaaacttcaaaaattgaccagtgtaaattctggagacaatttaacatttttgtggggtactttgttgaacacacatctttataaggggtcacagcatagtcaacccagacttgcctaggttaaaattctgtctctactatttgttaggtgcatatccttgggcgagttacctaattattctccccacatcttccgtaaaaagggtgtaataatggtaatattagtattagtgcttatctcctaaggttattgtgaggattaagagctagcacatttgaagtgttagaatatggcatggagagtagcaagtactccatgtcttcactataaaagatttggattgagtaacaaaacaaacaagggaacaaagaaaatagacagtcatctaagtgaagacatccttaattactcctgtgttccattatattgtagtttcttgattgttggcacagtattctttcggggacatggtttgcgccctcttagggctcaggattttcagttctaccccactactcatgaagtccagagacctctttcccggaggtctatttcctttccagcctcatctctcctactcaagctttgcgtgttttccatcctctagacaaattgtaccaaactgtactactaactgttctccaaacacaacaaactgtagaatttcacattttctaaatcttctgtaaatcaactattataaaacaaaaaagccagccgtggtagttctctcctatagtcccagctactcaggaatctgagacaggaggactgcttgagcccaggagtttgaggctacagtgagctgtgatcacaccattgcattctggcctgggcaacagagtaagaccccatctctaaaaaaattaaaaacataaaaagaggtacattgattatgcagctaagtaaaatagccatatctgggaacggtgaagtgtggaaaatgcttttttttttgaaacagagtttcactgttgttgcccaggctggattgcagtggcgtgatctcggctcactgcaacctccgcctcccagattcatgcaattctcctgcctcagcctcccaagtagctgggattacaggcttgcaccaccatgcctggctaattttgtatttttagtagagacagggtttctccatgacaccgagtctcatctttcacccaggctagagtacagtggcacaatctcagctcactacaacctcggcctcccgggttcaagcaattcttctacctcagcctcccaagtaactgggattacaggcatgtgccaccacacccagctaatttttgtatttttggtagagatggggtttcaccatgttgcccaggctggtctcaaactcctgacctcaagtgatctgcccacctcagcctcccaaagtgctgagattacaggcatgagccactgtgccaggcgtgcctttttctttttaatacctctggtacatgatgacaatgagacaaattagaaactagtttatccattgtatgaatggatttcccagagattttttaaagatctgaatacaagcattgcttttaacagtaccatattgcacaagagtaactccagggaatgaatattccataagttctaaaaaactttaagttgcaatgttacatctctgtccaaaatcattagactcctcgggcaataagtagagtattccttatttattagatccaagactccttgcgtccttgataggatcttcaaagaaggccatccctgtccataccaagtcatttgggccagtgtcagtcataggtaatcaaaaccattggctcccactgcttctgcctctaccacttgccactggcagatacatagatggggatcatgtttcatcctttcaaggacttgagagactatagtcccagtgcataggttatatatgcgtttttcttctctggcatgtacaattgtcactgctttcatctgcaggggcccagatacactcttcttcctctacctttgtccctaggaatggtgacaagtgagagcacaggaaacatattttctagacatgatgctgggcgcttcacatgccatctcattaatcacaactgtctcccagggtagatgatgacatcctctttcatagaagaaactgaaatttgtcttcatcttggtccgaatcctggtttgtgttgccatctactcctgaaggccatgctagaggcatgctggagggtgtttctctagcccagtggtgggctagccagctgcctggagctgctagcgtacctgatagacacaaccaaattaaagtcctttagcatcacaaggaccagcttggagatctcaccgttagttctcccctagactgaacagtggcaaggagcaagaaggttccagatcacattcaagcaccactgtggtgactactccagtgttacatacctctggattagaagtggattaagattcaagcaaaatctaccttggctgaaatctttttaaaaatttttgtgttttttgtgcagtgctactttattttttattttgtttttttgtctgttggttggttggttcttttgagacggagtctcgctctgtcgcccaggagtgcagtggtgtgatctcagctcactgcaacctccgcctcctggggtcaagtgattctcctacctcagcctcccgagtagctgggactataggcgtgtgccaccacacccagctaattattttgtatttttagtagagatggggtttcaccatgttagctaggatggtctcgatctcctgacctcttgatccacctgcctcagcctcccaaagtgttgggattacaggcgtgagccaccgcatgccccggcctttgtttttaattgacacttagtaattgtacatatttatggggttcagtgtgatattttgatacatttatgtaatgaccaaattagactagcacgtctatcacctcatacatttatcttttctttgtggtgaaaacgttcaaaatcctctcttccagctattttgaaatctctatttaattatatattattatgtgctaatatatttcatagtacttgaaatatatataagtatatataagtatttcgaaatagccagaagagaggattttatgtgtatataaaatgtgtatgtatataaatttttttcgagatagggtctcattctcttgttcatgctggtgtacagtggcacgatcatggctcgctcactgtagcctccgcctcctgggctcaagtgatcctcctgccctagtctcttaagtaattgggactgcaggcgcgtgccaccacatatggctaatttttaaatttttgtagagactgggtctcaccatgttgcccaggctgatctcaaactcctgggctcaagcgatctgcccgccctagcctcccaaactgctagaattgcaggcatgagccaccacaccctgtctgaaatattaaatattattaaccatagtcattctgtgcagtaaaacaccagaactcatccccctgttgaactgttgttcagtttctcactatgccccctcttccctactctgcgaagcctccagtaggtactattctactctctgcttctatgagattaacatttttagattccacatatgagtgagaacatacagtatttgtctttgtgtacttggcttaatgtcctcccgtttcatccattttgccacaaaagacaggatttcttttttttttaatggccaaatagtattatattatatatatatatatatatatttttttttttttttttttttttttccacattttctttctccctccattcattgatggacatttaggttgattccgtatcttgactactgtgaatagtgctgcaataagcacaggagtgccgatatgcctttgaaatcctaatttcatttcctttggataaatacccagtagtgggattgctggatcatatgatagttctatttttaatcttttaaggaacctttatgctgttttccaagatggctgtactaatttacattccaccagccgtgtacaagagttcccctttctccacattcatgccagcatttattttttgtctttttgataatagtcattctaattggggtgtggtgatatctcagtgtggtattgatttgcattattctgatgattagtgatattgaccattttctcatgtatctgttggctctttgtatgtcttttaagaaatggctattcaggtcttttacctatttttaattggattacttgtgttttctgctattgaattttgtttgagtttcttatatattctggatattaatccctgtcaaatgtatagtttgcagatattttcttccattctgtagattgtctcttcagtctatcgattgcttcctttgctatacagaagctttttagtttgatgtaatcccatttgtctgtttttgcttttgaggtcttatacaaaagacccttcccttgcccagaccaatgtcctgaagtgtttccctatcttttcttctagtatgtatatttgtttggggtctcatatttaagtctttagtccattttgagttgattttttaatatggtgagagataggggtctagtttcattcttgggcatctagatatccagtgttcccaacaccatttatcaaagagactgtccttcaccagtgtatattcttggcatctttgtcaaaaataaattggctgtaaatacgtagatttatttccatgctctgtcttctgttttattggtctttatacctgttcttatgatagtagcatgctattttggttactatagctttgtagtatattttgaggtcaggtagtgtgatgcccccagctttttgctcaaaattgctttggcttttggggtcttttatgatttcatacaaattttaggattatttattctgtttctgtgaagaatatcattggtattttcattgaattgcattgaatctgtagatcactttatgtagtatggacattttaacagtattaattttaatccatgaacataggctatctttccatttgtgtcctcttcaactttttccattaatgttttataattttcattatagagatctttcacctccttggttaaatttattcctaggtaatttttttgaaaatggaattgctttcttgatttcttttttcagatagtttgttagtgatgtataaaattctactgatttttatttgttgattttgtatcctgcaactttactgattttttttattagttataacagttttttggtagagtctatagggttttctatacataagattatgtcttctgcaaacagagacaatttgacttcctcctttccaatttgaataccctttctcttagctaattgctctggctaggacttacagtattatgctgaataaaagtgttgaaagtgggcatcctagcccggtgcggtggctcatgcctgtaatcccagcactttggggggctgagatgggcagatcatgaggtcaagagattgagaccaccctggccaacatggtgaaactctgcctctactaaaaatacaaaaattagctgggtatgctggcacgcgcctgtagtcccagctactcgggaggctgaggcaggagaatcgcttgaacctgggaggcagaggttgcagatcatgccactgcactccagcctggtgacagagcaagactccatctcaaaaaaaaaaaaaaaaaagaaaggaggcatctttgtcttgttccagatcttaagaggaaaagctttcaactttttcatgttcagtatgatattaactatgggtttgtcataacgtggctttgtgttgaggcacaatttcctccatacttaatttgttgagagtttttatcatgaaggtatgttgaatttttttttttttttgagacagagtcttgctctgttgcccaggctggagtgcagtggtgcaatctcggctcactgctacctccgccttctgggttcaagcgattctcatgcctcagccacctgagtggctgggattacaggcatgcaccaccacacccagctattttttgtatttatagtagagatggggtttcaccatgttggccagaccagtcccaaacgcctgacctcaagtgattcacccacctcagcctcccaaagtgctgggattacaggcatgaaccaccacgcccagccgctatgttgaattttatcaaatggtttttctgcatctgttgaaatgatcatatggttcttgtccttgattctgttgatttttgagagatcatgtttattgatttacatatgttgaaccatcctttcatcccttggatgaatcccacttggtcatggtaaatgatgtttttaatatactgttgaattcaatttgctattatttcattcaggatttttgcatccatattcatcaaggatattggcctgtagttttcttttttgttgtgtccttgtctggttttggtatcagggtaatgctggccttacagaatgattttggaagatttccctcttcagttttttgaatagtgtgaaaggaattagtattatttaaatgtttgttagaattcagccatgaagccatcaagtccgggcttttctttgatgggagactttttattactgatttaatctcactctttattggtcagttcaggttttctatgtcttcatggttccgttttgatagttcgtgtgtgtctaagaatttagccatttcctctaggcttttcaatttgttggcatacagttgtttataatagtctcttacaatactttgtttatggtattagttgtaatatctcctttttcatctctgatttgagtcttttttttttcttagtctgctataggtttgttgattttgtttgccttttcaaaaaaatgatccttggttttgttgatctttcgtttctttttttggtcactttatttccattcttctggtctttattattttctttgttctgctaattttgggtttagtttattattttctagttccttgaggtacatcaggttgtttatttgagaactttctttttctttttttttttttttttttttgagacagtttcactctgacccctagactggagtgcagtggcatgattttggctcagtgcaacctccgcctcccgggttcaagtgattcttatgcctcagcttcccaaatacttggaattacaggtgcccaccaccactcctggctaatttatggtagagatggcatttcaccatgttggccaggctggtctcaaactcctcacctcaggtgatcctccagcctctacctcccaaagttcttgggtgtgagccacccacctggcctgattgtgatttttttctttttttaatttgttgagacttgtttttgtggcctaacatatggtccatcatggagaatgttccatgtgctgatgagaaaaatgtgtattctgtggctgttggagggaatgttctgtaaatgtgtgttaggtccatttggcctagagtgcagtttaaatccaatgtttttttgttgattttatgtctggatgatctgtccattgctgaaagtgggatgtagcgttctcctgctattattgtattgcagtctatgtctccctttagatgtaataatacttgctttatatatttgtgtgcaccagtgttgtgtgcatagatatttaaaatcattacatcctcctgctgaactgacccctttgacctttgtttctttttacaatttttgacctaaagtctattttatcaaaatatagctactcctcttctctttttggttttaatttgcatggagtatcatttctcatcccttcactttcagtcttagtgtgtccttacaggtgaagtgagtgtcttgtaggcaacatagagttggattttgttttttgttttttcatccattcagccactgtatcttttcattgaagtatttaatctatttacattcaagggtattattgatagataaggacttacacctgccattttgttaattgttttctgtttgcttttcatattctttattcctttctttctctcttattgtttacctttgtggtttggtgattttctatagtgataagctttgatttatttctctttctcatttgtgtgtctgctgtagttactttttttctttgtggttactctggggcttacattaaacatcttagagtgttttaagctgataataacttaaccttggtctcataaaatatttttggcttttaccctccccccacaacttataattttgttgcttaatttacatctttttatattgtgtggtccttaacaacttgtagctgtagttaccattaaccattttttacttttaaccttcataatggagatttgaaagattatattccacagttacagcaatggagttttctgaatttggtaattaatttacctctgtcagtgagattatattttcatatattttcatgatagtaattatacttttgcttccagtcaaagcagctcccttaagcatttcttgtaaggctagtctagtggtaataaattcttgcagcttttgcttgtctgggaaagactccatttttctttcatttctgaaagatagctttgctagtagttgttatctttcagcactttgaatatattatcccattctctacagtctgttctttcttggcgtgtacaggttttctgagaaatctgttaatagcaacctgccaggttcccttacatgtgacttgatccttttctcttgctgcttttagaattctctatgtctgacttttgatggctttattataatgtaccttggagagaggacctctttgcattgaatgtgttcagtgtgctgtcgagtttcatggatctggctaccaatattaaaattatattactgtgactaatagttgagtgtggtcccagtatagtttgtctcaaataggtaaaagtccacaagattttattaagattattatattcaactatatactcatgtacataaatactaaatgctttattataaaattttgaaattaaaataagcatagttgttacaagctacagtatggcaaaatgcctttttctttttcactcatcttttagcatcattgggttttcttaacttgaatataggattttaattcataaatttttttatttaaggaaaataaatttttaatgtttgcatttgtttttcatttctcttccctacctagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagaggtaagctttctataactacaggctgaaagatgaggcttttttattttaaaaataaattttatgggaccaggtgccataggatttcaggtatgtaatttttatattaggaaaatacaatcacgcctgtaatctcaacactttgggaggccaaggagggaagatcacttgagtctaggagtttgaaaccagcctgggcaacatagtgagaccttatctctacagaaaataaacaaaattagccaggtgtggtgatgcgagcctgtggtcccagccactcgggagactgaagtgggaggatcacttgagctggggaggtcgaggttgcagtgagctgagataccaccactgcactcccacctgggtgacaaagcaagaccctgtctcataaataataataataaataaataattatgtggatatgatatatgaaataatataggcccttttttttattgaattaatataacctttttttttctctgtcacccaggctagagtgcggtggcacaaccttagctgctccacctcctgggttcaagcaattctcctgcctcagccctcccatgtagctgggattacaggcgcccaccaccatgtccagctaatttttgtatttttagtagagagagggtttcaccatgttaacaaggctggtcttgaactcctgacctcaggtcatccacccgcctcagcctcccaaagtgctgggattacaggcgtgagccaccgtgcccagccaaattaatataacctttatttcttacctgagggtatttagtatatgatgacaaaggtgttcttaaggagctttcagccaatacttagaaaccagttcaaaaatcctttaaaacaataatgattgagtgtaaaagttaatataattgggtgctaaaatatatggtatggtacagaaaataagtagtatgaatacctgccatttgtactataattataatgtaactgataatatgcctttaataaaacatttaaacatgtaagcttaattgcattactggagaaagaaaaaggcgttttttaaaaatccatatgaatgtggcatctattcagaattttaaattacaattacatttctaagactgtctctcacagattaggaagctgataacctggtataagtcacatagcaaagtgaatgaggtttttctttcctctctcctgcatctctgaataacttttcttcttctctttttgccaaatatacttcttatcatggggaattttatcttgtggttatatttgttagattggaatgaaaatagtcgaagtctgccatacattatagctttactgctgtattttcctaatataaaaattaaacacctgaaattttataaatgctaacatattccaatatataatacatgtattattatatattatagtggaagagtttattatgatttagtaatgttattcccaatttttgacttcagtagttttagactgcaagagaaagcataatttttttggttccttttttcatcttaaatagaatatctttaaatcaggaaataatagttttaagttaccttagctttttcaataataaggctttcagattcctagtgttactgctttttccccccttttatctagtactatctgcagaattaaatgaaaaacaggcttgatgactgaaatggcattcttagtatttcagaagtgttgagttttaatctacaaagattcagaacaaccatgttaatcctagtgagttaaatcactcatacaagcttgcaaatacagaggagactactaaaaccactctagagtctataactctaaggagttatagagtgattgcagaagactgttttatggggtctgtgtgtgtgtttatgtgcctgtacatgttttcgcatgtggtggcggtgttttcttctttcccttttttccttccctgtctgataaatgagactggtgcatgtttgaaagcagagagtcccaacagaaaagtcagaattctaagcggagaagtctgattacaaaaacaaggttacagaaatgaaaaagaggaggccgggcgtggtggctcacgcttgtaatctcagtgctgtgggaggtcaaggcaggtggatcacttgaggtcaggagtttgagaccagcctggccaacatggtgaaaccccgtctctgctgaaaatacaaaaattaaccaggcactgagagtgagaaacaacttggacatacgaattttaaaatacaaaaattaaagaggcattaacgcctgttgtcccagcttcttgggaggctgaggtgggagaattgcttgaacccaggaggttgcagtgagccgagatcataacactgcactccagactgggcaacagagcaagactcttatctcaaaaaaaaaaaaaatgtaaaagaagagcataggatcagggtgtgaagtaaaggttactctgaacagttttattttttaatcagtcccagtaatttttaatacctatagatagctttgcattaaagatcctcataaaagtcttatcaaaagaatttcaagtttcttttttttctttttttttttcctgagacggagtcttgctctgtcacccaggctgaagtgcagtggcgcagtcttggctcactgcaacctccacctcccgggttcaagcaattctcctgccttagcctcccaagtagctgggattacaggcccccgccactacacccagctaatttttgtatttttagtagaggcagggtttcaccatgttggccaggctggtctcgaactcctgaccttgtgatcctcccgcctcagcctcccaaagtgctgggattacagacatgagccaccacacctggccagaatttcaactttcaaaagaaatagaacacagtactttcttgtattcattttcattgtattcatttggaggatattcatcctccaaagcagtgtttttcaaattgaaggtcaaatcacatagtcgtgaagtttattggattataaacattttttaaagaagaaaatagaataaaatagaaattatcagcatatcacaaataataacatgaatttaacagatgctggcgaggttgtggagaaaaaggaatgcttaaacactgttggtgggagtataaattagttcaactattgtggaagacagtgtggtgattcctcaaagacctaaaaacagaaataccattcaacccagcaatcccattactgggtatacacccaaaagaatataaatcattgtactgtaaagatgtaaacacacgcgtatgttgattgcagcactattcaccatagaaaagacatggaatcaatctaaatgcctatcaatgatagactgcataaagaaaatgtacatatacagcatggaatactatgcatccataataaagaatgagatcatgtcctttgtaggggcttggatggagctggaggccattatccttagcaaaactaatggaggaacagaaaaccaaataccccatgttcttactaacaattgagagctaaatgatgagaacacatggacacatagaggggaacaacactgggggcctgtcggaggatggagggtgggaggagggggacaatcaggaaaaataactaatgggtactaggcttaatacctgggtgatgaaataatctgtacaacaaaacttgttgtacatgtcacggagatgacacaagtttcaagcttatgtaacaagcctgcacatggacgtacccctgaacttgaattttaacctgtttttatatatgtatgtgtgatgtataaattccatatatttacatatacattgtgtacctatgtaagtgtgtgtgtgaggttactctgttgtgatgctatttcttactgtaggttgcagtctgaatttgaaaggcagtattctcaattacagttcaacccagaaacccagatcactgagagtgagaaacaacttggacatacgaaaagtctggagcaggcagagtggctcatgcctgtaatcccaacactcggggaggctgaggcgggtggatcacttgagcctagcagttcaagaccagcctgcgcaacatggcaaaccctgtctctacaaaaaatacaaaaatccgccaaatgtggtgggacctgcctgtagtcttaagggaggctgaggtgggaggattgcttgagcccaagaggttgaggctacagggagctatgatcacgccacatgatcttccctgggcaagggtccacaggaggcattcccattggttaatatcctaaattgcataaatatacgggaaaacctgggcaggtcccatttggcaagtcattacacagacataatttctttaggccccactaaggaagaaaagattttatcacaaatcgagagtagtcttgtcattctctggaattgtgttcttaaattagatacaggcatgccttggtatttgtctctagtccattcctgaattatatagtgcacttttggaaagcaaaaacctctgttccattcttttaaatgagaaaaatagtgtgttgtcagcccaaccagaaagcataaccagttcccccaaatatagtacaaaaccttttaaactcctatgtagcatttaaagcactaattatgtaatcatataacacttaagggactcattattgggcttgtatggtaaatgacaaaatactagatacaaattataattgccttctataccgcaatgaaaataaaaaatgaaataatacgttaaagattatatctaaattggaaccttgttaacgatacccccaggctcctggcaaaagctaataaagggcccatgggaggctaaccccctctctgtttttatacatattttgcctacacttgaacacaaatgttttcactaacaggtacatgcatatttgtgatagtgaattttcaattcagagagtgaattctgagtaagaatttttgcaagtcattatagcagatattcagatggagttcagacagccagggatacctgtatatatgataacaaaaagtgaaaaagacatgagaaagcaccataagatgaacaaagatagcaaaacccagtctgtcctcaagttgcagaatatgtgatgaagataaaacaagtacccaagttagcacattattagtaaattataaattacttcaaattaaatgccgtaagaatagaagggctagagggggtggagcaagataattgaagagtagaactgaaatgagaggacaggagagaagggaaggtttctattttagtggggaacaaatttggagaacagcaaaaaaacggcaagaacaaagttctgcatagcaggagaatattggcaagcgtttgcatggacatgtgttctcagttctcttgggtacatatctaggagtggaattgctaggtcatatggtaactctatgtttaactttttgaggagctgtcaaactgttttctgtggcagctgaaccattttacattcccactaacaatctcttggggagagaaggttccagtacaccaaagaagtgtaacattgattaaaatattctaatacatagttcaattcagatttctcttgtctgaaagattcaccatatagcttttttaataaagttttatggaaatataatttatatagcataaagtttactcatttaaagtatacaattcagtgacttttaatatatttaccaaattgtgtagctggcaccacgatctaattttagaacattttcctgatcccaacttctgtagctgtttaaaaaatatttcaagattaatcaaagattgatactatatttagttgatgtgattctttggtctcctttaatctggaactgttccctgcctttttcttccttgcttgacatttgtatttttgaagcttctaggccagatatcttttagaatgccccatacaatgcatttctttaatcattatttatcatagttaaattcaggttaaacgtcttggccaggaaaaaggtagtctcaatgtaggagacattgaagaggcatttgagatttttaagcaccatcgtgcactaggcccggtaacgaaaaaaaaaaaaaaagattttaaatcaagctacgtgtccaggggtatgctctagaaaaattaccatggcaataatatttaatttgagggcagggaagctggttaggcctttgctgtaatacagaaaagtgaaaagagggaatggaagaaatagtaacctatatgttgccattggccgtttttttgtttttgtgggtgtgcttttatagagaggcaagacttgctatattgcacaagctggacttgaattcctgggcttaagccgtcctcctgagtagctggatggcattattatttatatagaaccagaactaagtatcttgagagtcagagaccttccactgaaacaaaatttctgagaccggacacagtggctcatgcctgtaatcccagcactttgggaggctgaggtgggcggatcacttgagatcaggagttcaagaccagcctggctaacatggtgaaacatcatctcactaaaaatacaaaaaaattagccaggcgtggtggtgcacgtctgtaatcccagctacttgggaggctgaggcagaagaattgcttgaacccggaaggcgggggttgcagtgagccaagatcgtgccactgcactcccgcctgggcaacagaacaagactccatccaccccgcctcccccaccaccccaaaaaaatttctgtattgactatgaaaatgggaggtagaaatgtgtatggtcaaataaaagaataagtgctcccacaacagaatattcatggaaatattaaatagctagcttttataagagccttaaccatcaaacgtgaccaggaaatgggatcagatgcaagtggtacccccttgtcttcccactcctgctcctgctgactagttaacaaggaaggaaagaaaactaacagtcatcaattcacgtgtcaagaaagtaccttgcttattttcaggtcccactaaaagcagttatcaatataaaactgtaccaggaatggttgtcaaggtacatctctgaatcattaaagaatattgaggcttttcttggccgggcgccgtggctcacacctgtaatctcaggactttgggaggccaaggcgggtgaattgcttgaggtcaggagttcaagaccagcctggccaacatggcaaaaccctgtctctactaaaaatacaaaaaattagctgggcatagtggtgcacgcctgcagtctcagttacttgggaggctgaggcacgagaatcacttgagcgtgggaggcagaggttgcagtgaaccaagattgtaccactgcactccaggctgggtgacagagcaagacgctgtctcaaaagaatattgaggcttttcccctcattattccagtgttcaaatagggtgaaaactatgtggatggttttatttgcgcctaggtcctctgtgttagagtactcaagtcctgctctgtgtgcacttcctttcacttgtttttatttcctcatagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaaccttacattgtcattttaacttaatgaatattttttaaagcaaactgtttaatgaatttaactgctcatttgaatgctagctttcctcagatttcaacattccattcagtgtttaatttgtcttacttaaacttgaaattgttgttacaaatttaattgctaggaggcatggatagcatacattattatggatagcataccttatttcagtggttttcaaactatgctcattggatgtccaggtgggtcaagaggttactttcaaccacagcatctctgccttgtctctttatatgccacataagatttctgcataaggcttaagtattttaaagggggcagttatcatttaaaaacagtttggtcgggcgcggtggctcatgcctgtaatcccagcactttgggaggctgaagtgggcagatcacctgaggtcaggagttcaagaccagcctggccaacgtggtgaaacaccatctctactaaaaatgcaaaaattagctgggcatggtggagggcacctgtaatctcagctactcaggaggctgaggtaggagaattgcttgaacccaggagatggaggttgcagtgagctgagatcacgtcactgcactccagccagggcgacagagcgagactccatctcaaaagaaacaaacaaaaaaaacagtttgggccgggtgtggtggctcacgcttgtaatcccagcacttcggaaggccaaggcgggcggatcacgaggtcaagagatggagactgtcctggccaacatggtgaaatcccttctttactaaaaatacaaaaattatctgggcgtggtggtgcatgcctgtagtcccagctccttgggaggctaaggcaggagaatcacttgaacccgggaggcagaggttgcagtgagccgagattgcaccactgcactccagcctggcaacagagcaagacttcgtctcaaaaaaaaaaaaaaaaaaagtttgaaaaccattggtatagatagatattttgaattgatttgcatagtctccttgaatgtgttaaattatgttgaaagtatgaaagcaggatgtaggtggtactacatattaaataagatttatataacatgtgcctgtgtcctgattcagtattactgtgtcctgtaaccttgaaatggagaggaggtaagagggacatttttttatgtctgtctgcattaaacctgtgttgaggcatccaagacccttacatttcaggttgttattggtttaaaacctctttccagtttgcattggtttgtctttgctaaatgcagtatgtttatgttactctgcaagtcacatacaggtagaccttatgacatttccagttgaaactaggcttgctttcggtacacaggtgaagacttgaggaagccagtgccagagaggacgtgcctcacccctcagctggctgaatgcgcttcattggcttacgctttgctttctgtatgctttctgtccttctgggtggtgtcgcatatatttttaaaaccacattcagtgtgatgaacacttgttggtacacttctaaggttagtcatctttccttctctgagcagatccttgagaagggcattgacagtggatgctttaaatagtgttcagtttttaccagtaataatattttttggtggatgtcatgaaaacacatgacatcgtgttgtgcccatgataaaaagtcctgactttttattgaatgaggtgtgctggtcaaagagacagacgtggctgccttctctggtaacagccagaggaaaaagttagcaattctagatgggttctacagctttaaaaaacttgttgtatccttaggtcctcataatattaaatattttctaattttaacagattttaagagtcagatatatactttgacttgaatgatgtagtgttgcttaaggaagaaaaaattataaaaaaaatgtttcttttattttca

SEQ ID NO: 16028 - DNA, 5861 bp, Human
atgtctgtttctgagaggtgcagattaaccaccccacaaataacgtttagaattttagattccttaagcggaagattttacatctttttgcatggatcaaacatagtgccctggttattaagtcattgtcaaaactttaaagtgaacattttattgaaaacatgttgagtccagggttcagacttggtgtattatagtggacttgaggtgaccgttattctcctgggtatgggaactggattatccctgttatctttatgcttaagtttaatttcagggatgttaaatctgaatagctgaaaattatgaatttgatgatcttgaaatgtaattttaataggtatcagaaggggaaggtaaagaacaatgtatatagtattgtcatttatgtaaaagggaatatgtgttgtatttatataacaaagagtatgtacatatatgtacatttacatgcaaacataaatagggtttctttgggaaaggaaactggtttacagtggttatctctagggaagggcgcaaggggtcagtagaggtaattttcagactgcttaattttaacatgaacagttttgtttttgttcttgtttttgtttttgtttgagacagagtctcattatgttggccaggctggtctcgaactcctgcgcttaagcgatcctcccgccttctcctcccaaattgctgggattacacgcgcgagccaccacacgtggccatgaacagtttttaaatctttataagttaaagcaaataggccaggtgggtggctcatgcctgtaaatcccagcactttgggaggtggaggtggggagatcgcttgagctcaggagtttgagcttagcctaagcaacatagccaaaccccgtctctacaaaaattaaccagggcatggtggtgcatacctgtggtcctagctaccggacaggctgagatgggaggattgcttgagcccaggaggtaaaggctctagtgagccaagttccactgcactccagcctaggtaacaaagagatatcttgtctttaaaaaaagaaaaaggtaaataaattattgtaattgattcgaggtggctaatttttttttttttttttttttgagatggagtctctgtcgccaggctggagtgctgtggcgcgatcttggctcactgcatcctacaactacctggttcaagggattctcctgcctcagcctcctgagtagctgggattacaggcacgcgccaccacgcccggctaatttttgtattttaatagagatgtagtttcactatgttggccaggattgtctcaatctcctgaccttgtgatctgcccgcctcggcctcccaaagtgcggtgattacaggcatgagccactgcgcccagcacgagatggctaattttattctcagcagttccccggtagcagcaggcagtttgaattggcgtcagaatctgctgagccccacccctggagaatcaatacactgggtaatattctgacattcagttagctttggaaaatttttattagatcgtagtacatgctaatttacatatggccaggcatggtggctcacgcctgtaatcccagcactttaggaggccgaggctggcagatcacctgaggttaggagtttgagaccagcctggccaatatggtgaaacccggtctctactgaaaatacaaaaattagctgggtatggtggtgggcacctgtaattccagctactgaggagactgaggcaggagaatcgcttgaacctgggaggtggaggttgcagtgagccaagattgtgccactgcactccagcctgggcgacaagagtgaaactctgtctcaaaaaaaaaattttacatatgattgctaattaggaaatttttcatttcagtcgtcaagaacttttaagggcagaggccaggtgagactctgtctcaaaaataaaaggaaaggcagaaggtggaccgcagtgtgataagtagtatttcacaaacagtatttttctgtggcttgtcttacaggtacaccaggggttggaaaaaccacactaggcaaagaacttgcgtcaaaatcaggactgaaatacattaatgtgggtgatttagctcgagaaggtaagggacactttggtgttagatttgttttgttttttttttaaggtctggtaagtggagtgttagtgctgggtattgtcatagggtacaaaaaacagagattgccattaaagaatatatactctgttagggaatccacagaaatattaagtgtctaatgctatgtcctggttattttgaccattttcccttctgccttcaaaatggctggcaattcttgtgaatagttgggaaggctcctataaagagactggatttcggataggtagaatgtgaataaggagaatgtttttaagttgaacaaacaaaggtttggtactgctaaacatatatatgagcacagtgagtatattggtctcactggaaagagactgttttgagctcaggtgtgggacctgactatgctatggtatcttagattagtgtgagatttgcatgcaactgcatatattctaagatgatcattgtttttatttattttaccctgttttcccctaatctttcatcgctcccttatttgtgtcttcatctttttatagtcgacaatgatttgtacatggtaggaactcaataaattaaagcgaccttaagttgcctcattaaaattaagaaaacatatggtttaaattttaaaaatttttttacagtttaacatagatttaaaatttttttaagttcctgacagttgctactaaagtaactatttcagattgatctaatgtacatatttttttcaaatgatctaaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgattgttggtgctttggcagttatgtttttaaaagcaattttctccttgttgtcaccaagaggagtaacagttggcagttgcagcaatttgcagtactgcagtctatttttgaccactagagtgtcaccttaaacgtcttcagatacatagatcatagtatgatctctggtgtgtacgtcactcttgtgatctgttctctcagattgctgaagtataaccatgactcccctttggagagaccagttggtcaggatttttattcatagtgaattcttaacctgctttgattatcttcctcaattgcccaacttcctaggtcccatttttctgtccttttggttatattaaggacccttagtgtctcccagtatgtctccactttttaaaaaaaaatttataagtgtctctttttgcaggttaattttgagcatctttgtttttcatattcctgatactataagccagtatcatgttcatttttgatccagggctgataattaggttatagtgtttatatatatatatattttttttaatttaaaatatttttttgtccaaaagaacgtcaatttatcaaggttatagtttctaaaacctagatttttatttgctatcatacaactactcattttccatttcattttattttatttcctgagacagaatttcattttgttgcccaggctgcagtgcagtggcacaatctcagctcactgcaacctctatgtcccaggttccagctatctttgcacctcagcctcccaagtagctggaattacaggtgtgcaccaccacacctggctaatttttatatttttagtagagatgggcttttgccatgttgtccaggctggtcttgaactcctggcctcaagtgatctgcccacctcggcctcccagagtgctgggattacaggtgtgagctacctcacctggcctttccttttttttttttcttttgagacggagtctccctctgtcgcccagactggagtgcagtggtgtaatctcggctcactgcaagctctgcctcccaggttcacgccattgtcctgcctcagcctcccaagtagctgggactacaggcacctgccaccacgcccagctaattttctgtatttttagtagagacggggtttcaccgtgttaaccaggttggtctcgatctcctgacctcgtgatccacccaccttggcctccctgagtgctgggattacaggcgtgggccaccgcgcccagcccggcctttctgttttatatctatatgaaatgtggttttgttcctcactgttgaacaccaccatttttgacaagtgatttctgagtcacataatagtcaatttcattcatgcattccaatgttactttcactcaatttaacatttctaaactaattagagcattaatagcattgagagcaatggtgacaccagaccaaggacaatccagtataaggcacttgtcttcctcttctttgggtcctctcctaccagtacttaaaccatttcatttggttgagacagagtcttgctctgttgcccaggctggagtgtggtggcctgatcatagctcattgcatccttgaactcctgggctaaagtgatcatcctgcctcagcctcccttgtagctgggactacaggcacacaccatcctgccgggctaacttaaaattatttttgcagagacagggtctggctttgttccccaggctggtttactcctgggctcaaatgatccttctgccttagcctcccaaagtgctgggattgcagacgagagccactgtacctcaagtactcaacaccattttagtcagttgtgtatagtcccacccatcctctttgttattagtgagattatttcatgaaatgggatctaagtcttaaaggaaaagtattttttccccctcctgtaatgccagataaaagatttctggtctgacttgacatggagtttgatggaggtactttgtggggtttttttgtttgtttgtttgagac

SEQ ID NO: 16029 - DNA, 155019 bp, Human
  misc_feature (1)...(155019): n = A,T,C or G
tgccactttgtaaagaagagcccaagacctgatcagaatgagacacaaatgaggtcatttttaacagaactaggggaggggagaaggacaaatagactggggcgattctcagggagggaagggctggatacgagactcttttgggagagcctagaaacgacgcaagcgtcccagacacccgggctagtggagaagagagcagaatgagagcagtcatgaaaaagagtaagggaacacaagagaaattcggtttgcctatttctgtctgggcacagttctgcccttagcaatctaaggcaacttcacaaagctccactcactgcacgggatgtagaacacagtggaggcttccaccctggtttgactggcttttgggaatcaagctggaaagccaaaaggacatgtttcactgtggaggtgccctcagggctggcgaaggccttgggggaggtgtctttgcaactgtgtaggggtggttttctgattagcaaatctgagggcagggagatattgtgatcaggactgtttgattctggggaagcctctttttaccctgcccacatagaagactctgctttggatacagagtcaaggacggatactgatacaatggacctgtaacttgtccatggctgccttttgtacagtttagtccatttgagtaatctctacaagcctgcacctcgagggcaaacttcctgctcttctggggaatttaattgtgaattgtctgtttcggggcccattttgactcctgtattccaggacttatctctttggaggccttgatttggaatttcccattggatggggctacttgggtactgggtagcttcaacctggcttccgtaagaacaaagccagatgatcacggtgggtggtctgctaggagaatggaaatgccattgattaaaattggaaggttaagagagaggcctgagagtttgggataggagatgaagtttcaaaaaatcagtttttaaaaaaacatttcccatctgaaatgccagtgaattgttcagatagattacattgaaaaggctgacatttctgtagcagcaacgaatgaagtcatccgagtggatgaggtgctctaggccatacatggagaagagaacacagttacccaagcctccccgactgtgtgcggccacagactctgctcatttcccagttaggaacgatgcaggggtctgctgggatctccacgtttctacctgtacctctgaggactgggtttctgcccacacgagttgcaggatttgctctactgagaaaaagagttttgctccagaaagcaagtttcccgtttcagacacggacagcgagttttgcttctagaatcattttcagctgcatacagaaaaatgaacttggctgagctgaagagccacacatatgttaaacggaagctcgggtattaggaacgtcgagaaaggcaggccgaaaagttagcccccttctcctcacccctgtcctcacagcggccccttcagtggcctgactttttctgcgtgggacccagaatgtcgcttgaggatgggacccccgcagacctccacgcgctgccacgcaaacggcctcggccgagagcattcgctttccagatgagaatggcatcttcagggacccgctggtagtggggccaggtctccacagggccggtccagtccttcctacccacccgggccctgcggccaggcggggccgggaggggcggatgccggagggcgccgggggaggccgacccgcgcggggctggtccgagggcggaggcaatccgccggcgacgccgcaggtcccgggtggctgacgccgtccgggggcgttcctgggagctgggggccggcgaggctggacccgacgcgcccgggaggagccggccggcggccacgtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggtgagtcctggccgccacccgccggcggaccccggcccgcgctctcgcgccccttcgctcccctattccctgcgcgctcagtccccgtgatcccctcgctctccgcacccctctcgtagcccccgtccccctcgtccgcgcgccccctggttccccgggtccccctggctcccctagtccgtgcgcccctcgctctccgcgcccctcgctctccgcaccccgcctgttctccgcctccccgccgtccgtgcgcccctctggtccgcccccgctctcaccctgccggggtccgggtccgagcctgccccgggcttactccgctctttcctcccggcccgcgagtccccggatccgcggcgacctcgcggggacccccagcggggacggggcagtggcggcgagtctggggccccgagggctttctcctccgcttttgatagtttccttccggcagaaagtttaagttgctcagccaagtcgctgagtgctcttttgcctcctgggggcaattgatttactcacgtaaaacagaaaaataaaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaagaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccccccgtgtcattggcaaagctggtctcatgaaaaccatttcctaaaaaagggcagcgaaagggtcgcattcttgtgcgaactgatctgtcaatatgggggtacaagaactgtagaaagaggaaatgatttcggtgaggactgaattgtgccagcgtctctaggcttcctctaggctcttgtggaacctccggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcccccgacttgctcagccacagccaggatctagtctggtctttctctgttgacctttttgtgtggcaggagtgggttttcctgttccccaggccctctaatatttccagacataaattccaggaatcccatgcttccctcttgaggggccatttcagcctcaggaaaggccttcagagacttagaaggaatgtcgtgttccaaggaatgaagaggcagccttgatgtgccgtgtttgtcaggactggccttgggaaaggtgaaataggacatatttttgcctttttttctgcaactcttttctcttgacttttactgaggtggtccaagccctgccgtgtcacaggaccccttattttcagtttcggtgtttagggacaggtctctatgtcctcctaccaggacactgatcaggtggcaagaaccctgtgtcaagaggcaggaaacctaggctctcgttctttcccaccaaagagctgtgtcgttttagcaaagcaactcagtggcctcatctatgaaatgggcataataacatgttccccctttaggcagaggactacaccagatgatctcttaagatacatgttaccatttcctgctaatctatgagttcagggtgccaattagcaaacctgggagaggaggaagctggaggaaatctctttacttcttttatctccaagaaagatacacactctttgagtggcttcctgcagacagtgccttacctttgccagttctgtgtgtaggaatttgaacttggagttggaagaaccatgccaaagcagagaaagaagaggtttctgggcagacggaggctttgaaacatcaatcgtggccggtcgcgttggctcacacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccgggcgacagagtgagactctatctcaaagaaaagaaaacaaaagaaaagaaacatcagtcatatcacaccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcaggctgtgtttctagctgctcatccaattaggctgattctctgggtgggataacattgagggagatcaaaaccatttgactgtcttcggtttactctcttctctctctctctctctcctcttttttgttttgagacaaggtcacattctgtcatccaggctggagtgcagtggtgccatcatagctcactgcaccctccaactcctgggctcagtggatccttctgcatcagcctaggtttattctcttgattcgagagaccctgtggatcagtcagtgctaagtccaaaagtcctttaaaaaatatatgtatatttttgagatagggtctcactctgtcacccaggctggagtgcaatggtgccatcctggctcactgcagcctcagcctcccaagctcaggtgatcctcccacctcagcctgccaagtagctgggaccacaggtgtgtaccacccagcccagctaatactttttattatttttgtagagatggggtctccctatgttgcccaggctctttcaacattttaacaggaaccttgggctcatttgtgctttgcgtagggaggtctgtcttttctgggtgaagttttgtgtgtggctggcattcagcttcctgttttttagccatgagacacctccctgaagtcttgctatgaccaagaccctgacagccacaccttctttctgcctgttagaatcactttctgtcgggtttcccttataaggtgatagagaacatagacttcataacaaaatatcactctcactgggaaggctgaggggttggtctttttgtgcctggtactgtgctcagtggggacttggggacatgcttcgcatttaaggtataggttgttttaggcatgggcagtaggcgctttcagcacaggctccctgctggtcactctttgctgtagtttcctgctccatccatggggtcggaggtcttacctcctgacgttagagtcatttgcagcaggtgggagtgaaagtgggccgggtgccaggtcttctttacctgaacctctcctgtcttcctggcacattaggaatgtccaagcttatttctattggtgaatgctcccacatgggatggataatggcctgtggaacattctctgaatgctttgtgttcttggaaaaccaaggactgaagagcgttgggtttgtttaggttacctgttataaattcttggctcacatttcatgtgtggactttcttgggtttattccacatggggacagcccagcaagcctttgtgaacgccctttcctggcctgagccgagtcacctgtggaagtcagccgtgcaggagggtgtgcttgatagggggaagcaccctgggcaggaccccatgagtttccttcttaccaggaaagtgtcattcgtcccactttgtgatctgaactggtattatgaaacatgaagcttaaaggcaacaaagtatgttaacaacaacaacaaaaaatacttaacaaaaacaacactgaggcagcagctgcttcaaccccaaaggtggaaaagtttcccagtatgcatttttaacacacatcaccatgtggcaagaagcaggaggaagggagagagtggggaggaggagaaagagaaggaggggacctttgttttgttatctccttggggtatttgtgtgcgtgcacttaaaaactgcgtgcacttaaaaactgcttcctgatggaatcccaaagagatttatatttggactttggttgtcttgacaacaatttagaaattcctaccacttcctcaatagctgagtgatcagttaaaagagccgatggcttccctgcttctggtaaggagcttgttgaagcatcttgtgatctttgttggaatgtatatggtggctcattaaagagcagtcaaatacctgggatttggtgagacatctgggtaatgggtacttcacctatgtccagggccttcgcatggaaggcctcttgtctccccagggacactaggacgcaagagtagaacagatttatactcacagtaaggcagatcatcagaactgtgcaacctcacatgagttgctatgagcactgtatgacagagtatccaataaggtgataagaatttgttagtgttattgtggaaggaagtaatgcataggatagtgggttgggctaggtaatgatcacatttgctttccaagtctgagattctagtaacttactattttttctcccgagactggcatttcttggggaagggggatggtggggagggttgagtggctagccacagcatttatttcttggcacaactgattcctctactaaattgaaccatttgtggaaagtatgttcagcattggtgactctgggtacgttctatgttacacgagaataaatatgatatagtgggctatcttcccagcagtgcctggcatatggtaacactgtgtcttatgcacccatcccaggctgatggaatccatcagggtccctttgttcctcctttgttcagggtcagcattgctgctttcatcctccctcagctttcagagctcagtgcatctctggagtgtgtatcagaatcatttgaggagcattttcaagcttctcatggtcccttcccccatcccttatgtcttaatttgagctgctgtcacaaaaataccataggctggagggcttaaacaatagacatttaattctcacagttctggaggttgggaagtctaagaccaaggcgctggcagatctagtgcctggtgagggctcgatttctggtttgcagacagctgccttcttgctgtaacttcacatgactgagagagtgctcggtctctttctcttcttataaggacgccaaccccattcatgaaggctctaccctcacaacctaagcacctcccaaaggcccacctcctaatatcctcacattggaggttaggcttcaaaatgggaattttgttggagggacacaaatattaattccatagtaccttgtcaatagtgttcaggcatgtggcctctacttttgccctggcccaatgacactgttttagtgagtgtgatatatcctttaggtctgctctaaggccacagccatgagaaaataggaaactttacattttaagatgctaggacagtggtccccaacctttttggcactagggatcagttttgtggaagacgatttttccacagatgggagcaggaggcgggggatggttttaggatgaaactgttccacgtcagatcatcaggcattagttagattctcatgaggagcatgcaacttagatccctcacatgcgcagttcacaacagggtttgcactcctgtgagaatctaatgtcaccattgatttgacaggaggcagagctcagctggtaatgctcactcactgttcacctcctgctgtgcaacctggttcctaacaagccatgggtcagtaccgccccaggggttggggacctctgtgctagaacgcaaaagcttttgagttcactaattggaaaagacctttaaaatttaattaagcctggtagataacgcttatttggtgtttgcatgcctgtgcagattttacactttcatttatcttagtttttatcacttatgacatgtgtttgaaaatggaataggtattcattcattcagccattcaccatttgtggagtgtttcttttatgctgggagctgtgggtggctgcatgtagacaggatggcagtgattgttgccttcccaaagacacgaacacaccagcagtgagctctgtggcattgactggattcttattatggtgcttaccatggcccaccatgcggaacagaagtagtgtgttgtgatgatgagaaatactgactgtcatcccgcttagtagacttgacggcatgggagggacagaaagttcttgctccaggtctgtcttgggtacctgctgtcgcacagtgctgtgctaactctgctagagacagaaagtaggtcaggcagggatctggtccctgcctgggatggagaggcttctggttggttcctgtgccacacgcacaggaacacggcccttgctgatgggtgtgaggcaggaggtgttgcatgtatagtgggatatggtgggagtcaaatacagcgggggctgtgaagtggggagttgggaaggtttcttggagtaggaaggatttgaacagtgcctaaagggacagggaaggaaaggtgggtgtgcactccaggccctggcagggggcttggatctcactgtattttctggcacagtccctcccctcccagcctgcccactcttccattgacaccccctactccctgtctctctagcactgggtcttttatttttaattccctttgcccccttttttttttttttgaaaaatttaaaacttacacagcagttgaaaggactatgaatgtcccctagattcagcaggagtaacattttgtcacttgtcctttgtctctctctctctctttttttttttttttttttgacatggagtctcgctctgtcaaccagcctggggtgcagtggcacaatctcggctcactgcaacctccacctcctgggttcaagcgattctcttgcctcagtctcctgagtagctgaaatcacaagtgtgcaacaccatgcccagctaatttttgtattttttttagtagagatggcgtttcaccacgttggccggctggtctcgaactcctggcctcaagcaatctgcctgccttgacctcccaaagtgttgggattacaggcgtgagccactgtgcccagcctgtctttctgtttataaataatactaaacatttttttttgaaccatttaaaagtaagttgcagacatggtggcactttacccacaaatacttcagtatgtgtcttttaggaaaaagggcattctcctatgtaaccacaatactatgctcccatcccctaaattgaacatgaacacagggtatcaaacatatggtccatgttcagatgtttccagttgcccccaaatgtcctttccagctatttaaagggtccagttagagatcatgtatttcatttggttgtcctgtctctttagtcactgtgcatctaaaacagttccccttcttttttccccatgactctggcatttttgaagaagccaggccagttgtcttgtaggcggtcccaagatctggaagtgtctgattgtttcctcattacttctttcaggttcattgtttgggtgagaatacaacgcaggcgatctcgagtggtcttattttttaacgtgatcatgtataatattaaaatactctttcccacttatctctgtggcatttatttaaaaaaatttcttagcttctgcaagtgtcaggcagtggtgtgtctgacacagaactttgacctcttggagcctacattttagcaggaaggtagggaaaataaatcatatggtctgttaggaggtggtatgtgctttatgggaaaagaaggcaagaggtgggagtgggctggcgggggtgacaattgagtgtgctcagtgtcttcagagcccaggatggaggcgtctgcctcttatttacccggggattgacgctggtcctacagcttcctcctgtggtaagctgctgagctgtggagaggagagtatgtcctgaggagccagagtggtcttttttgttacctaactttgtcagcagaaatgaggaaaagaaaaatggaatttttatttgagacggagtcttgctctgtcacccaggctggaatgcagtggtgtgatcataactcattatagcctcgaactcctgggctcaagtgatcctcctgcctcagcttcctgagtagctgggactacaggcgtgccaccacacttggctaattttctttctttctttctttcttttttttttggtagagatggggtcttgctgtgttgtccaggctagtcttgaattcatgggctcaagcgatcctcccacttcagcctccccaaaaatattgggattacaggtgtgagtcactttgcccagccaaaaagtgggcttcttttttgtttttttgttttttgagacagggtcttactctgtcatccaggctggagtgcaatggtgcgatcacagctcactgcagcctcaacctcccagtctcaagtgatcctcctgcttccgaaaagtcggatttaacatcaggtcaccaaatgggtttttcactgtgggatcttttgatgagtttttttcgaatacatttccttggtttagatgtctcagacctgcttgaattctctagaagtcatgaatgtggcttctgtttgcaccatatttaacccagaagatatcttaggctactttcagttcccccagaggtgcctaggagactcgagttatcagaaaattgaaggggcctgcaggacagcaaacagaacacagggaggtcatttcccttctattttctcttctttgaacaggatgtcacagagagctagatgcctttctatcaatgtatttttttttgaagaaaaggatacctgcattctccaggactactctctgccttcatggaatcactttcctaactaggatctgcaaatataatgtgtcgctctgggagggaaggacagagggagaaagtggagagaagaagagagaaagaggagaagagaagaagaaagacagagagacacgcacgtacacacacagacacacgtacacacagtatgtggagtatcacataaaatttgcccactgctggcaaggagaaagagcaaggtgttcttgtgtgtttgtttgttttttaaataatcagattattggccagggcatttacatttatggcaaggttaattaagaaagttttatttatttactttttatttattttatttactttttttgagaccgggtcttgcccaggctggagtgcagtggtgcaatcacagctcactgcagccttgacctcccgggttcaagcaatgcttctacctcagcctcccgagtagctgggactataggtgcccaccaccacacttggataatttttttggtttcttttgtagagatggggcttgccacgttgcccaggctggtcttgaactcctgggctcaagtgatccacctgcctcagcctcccaaagtgctgggattagaaagtgttttttaaagttcatctcatggcatcaatactacgtagttaatttatacttcattttagcagctaaaatattttctgaatttttttgtttgtttgtttgagatggagttttgcttttgttaccaaggctggagtgcagtggtgtgatctcgactcactgcagcctctgcctcctgggttcaagcagttctcttgcgtcagcctcccaagtagctgggattacaggcatgcgccaccatgcctggctaattttgtatttttagtagagatggggtttcactatgttggtcaggctggtcttgaactcttgacctcaggtgacccacctgcctcggcctcccaaagtgctgggattacaggcatgagccactgcaaccagccttattttctgaactttcataataaacttctaaagagctaattttttaaattatcaagtagtttagtctttttgggctgttatagtaaagcaccatagactgggggctgaaaaacaacagaaatgtatttccttcagttctggaggctgaaagtccaccatcagggtgccaatacgggcaggttctggtgagggctctctaaggggttgcagactgagtcttcccattgggtaagggagctccctggggcctcttccataagggcactaatcccattcatgagagctctagccttctgacctaatcaccttccaaaggctctacctcctagtattatcactttggaggtcagaatttcaacatacaaattttggggatcacaaatattcagaccataacataaagtgatgcatgctaattacaatttgaaggccaggcatggtgactcacgcctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtagtgaaatgatacatgctgttgtagttttagactgtagaggtgaggaatacaggatgatggctttaatcccattttttaataatgacacatcattgtattagctggcaatatcctatttgttctcctctttagtttgtttgtaatcccacagccaaagataagtcatcctgcttgccctccttttctgtaacactcacctcctcatttaacttcttttttttctgtcttttgtttcacgttcggaggacggctttatattttaggaccaatgtcaacctcaccatcctgccctgtatttcttctgttatgtcgctgctttttttctgcccctgcaggatcattttcttccatcattttaatttattttcttattctctccacttcacacgatgagtcatcagcccgacctccttgaaagaggcatccaaggcttcgcttttacaggaaagtgtttctaaccctgcttttcacttgctcccaccctttcagtgggagtgtgccaaactccttcccgccgtgccacagcaggcactcagcaagccgcggggcacagcagggtgctgccagggatgccgtcaagcctggccaggctcaccttttttttttttagatggagtcttgctctgtcacccaggctggagtgcagtggcacaatctcggctcactgcaacttccgcctcctgggttcaagcaattctcctgcctcagcctcccaagtagttggaattacacgcatgcaccaccatgcccggctaatttttctatttttagtagagatggggtttcgccatgttggccaggctggtctcgaactcctgacttcaagtgatccacccgcctcgacctcccaaagtgctaggattacaggcgtgagccaccacacccagcctgaaatctttagttatcaaagttgtattacatgggtgctatgcggtagtttctgtccttgaggtttacagtctaacaatgtccttggcctgctagggcgtacatgggaaaagttaggtaacagtaccagacatcccagtgggatatcgccagatgcttagttgccagatgttcagaaggtgagggctggtggagtttggggtgaccagggagagcgtgtggtgtctgctaatgaaccagaagaagggctgatgtcaggtgaggtgcggagggggcgtgtctgggagccggtgggagtggcttcacttacatgagacacacacacacagggagaaggttccccaagattcggtgtcagagtggttacctgcctggtgcggggggtagatttgggcctataagtaattttctctttttttttttttttgcttctctgtattggtttatttagtgagcatgtattactttgtgtaatttcgttaaaacctgcaaaatgtgttgcaggggacaaggagatgcttgacagggcgagatccatttggttcttactggaaataagtggtacactggtaatgaaattggaaagtgactctgggtccgattataaaggggtcttgcagtttgagtttatagcttcggtgaaatgacaggtctggcatcaacaggatgcagatttggcttagcaggtagtgctgtgctttcacctgtgcaggtcgttctctggggtccgtggtccatcatgggagggcagccacctccttttggggaatggtgacctcttcatggggtgatatttgggctttttcaccattctctgatttcctattcctcaaaatggggtctaggaaagttatgagcctgtctatccgtcttagggttctacaggttttctgtgtgtggcatatctgttttctgtgtgctgttatttgaaaaataaataaaagtatatcctgtatcttccaggtcatcatcctgtcacagaattctgtgtgacaacgttaacgtcattaatactggctaaggagaaaataaccgatgtagagttagtatacaaataattggggtcgaccggggacagtggctcatgcctgtagtaatcccagcacttcgggaggccaaggcaggcagatcacttgaggtcaggagttccagaccagcctggccaacatggtgaaaccctgtctctaccaaaaaatataaaaaattagctgggtgtggtggtgcatgcctgtaatcccagctactcaggaggctgaggcaggagaattgttttaacatgggaggtggaggttgcagtgagctgagattgcgccactgcactccaacctggctgacagagcgagactccatctaaaaaaaaaaaaaaagaaataactggggccatgtgaagaccatgtgattctgcagcacatgcagcaggtgtttactgagtgcctgctgtataccaggcagtttctaggggttgggggaatagcaggtaacaacatggactgtccctgacctcatggagctgatattctagtaggggtgacaggcggtgcacaaataccgagtgtggcagatggtgaggggtgctgtggagaaaaggaaagtgaggaagggccctgggcatgctggttgggaggagtgtggtttcaggtaggggcttgagaaggcatttctgaaaggaggcatctgagtgaagatcaaagagacagtactcagggcagccatgtgtgccaccagacagagaggtctgtgaggctggagcagggtggatgtgcctggtgagtctgaggaacagcaggcgagcagtgtgactggggcaggaaagagaagggagggagaggagggtgtagaagggggttaggtcagggaggtttggggctggatcaggcgcggtcttgcgggctggtgtaggaactttggcatttccttggaatcaagtgagagagcttgctaaggttttggtacagagcaaggacatgatctgacttagcttttatgagattgccctggcagctgtgtgagggctgaccacaggaggatgcagaaggaacatgggagcagtggtgacttccagagtgtagcagcaaggtggtgcacatgatcccatgtaagctgtgttttgaaggtagagctgacaaacgttgctgatggactgtgtatggagcacaagggaattaaaccatgacatggtgcatgatgcgtacctcggaatccagccacagtggagcaacactgttcatcatgtgaaactaatgtcaagtggaaggtcgttggctttatagtttaatttgtatttaatcaatgtatctgtgtctattttgtagtttcagaatagcacagtttatgtgtacccttattatttgtgtatatttatacagtggaatagttaatgactacctcagggtccatgagattgtttttccccttatgaaagtatgtggagtcttaaaggggcctgagaaaccctgctctaaccactgtgattatccagggactgatggaaccgatctgttcccttacgaagtgtcacagtattggcaggactctggacaaggacaaggaaggctgcattcctgtggcaccaccaggtggaagatggaggtatgttctcaggtatggccagtgtctgccaagatgcaattcctcagctctacagttttactactttttctggtatgacacaactaatagacaaccttgcaaatcctagctactcccatgactagatgcagatactattgaaacctcagaagtctgtgttgcaaaataaagcaaagaatgcaataggttttgttcataaaagcattttttttttgagaccaagtctcgttctgccacccaggctggagtgcagtggtgtggtcttggctcactgcaacctctgcctcccgggttcaagcaattcttgtgcctcatcctcccgagtagctgggattacaggcgtgtggcaccatgcccggctaatttttgtgtttttagtggagatggggtttcaccatgttgtccaggctggtctcaaactcctgacctcaggtgatctccctgcctcagcctcccaaagtgctaggattacaggcgtgagccaccgtgcctggcctgtaaaagcatttttatgagcatgtgaataatgaactcagtcatttcaagatcttccaaaacaattcatttgttagggaattgttagtaaatatggcaaataaaaatttttaaaaatacctctatttaaaaagatgagttatatatattatttttcatagattaatcttagcaagacaattttcttagtccattttgtgttttgtaacagaacacctgtgactgggtaatatataaagaaattggctcacgattctggtggctggaaagtccaggacggggcagctgcatctggtgagggcctcagtctgcttccactcatggcagaaagtggaagcgaagtgggtgtgtgcaaagagatcacatggtgagagaggatacaagagagcaaaaccaaataagccagactctttaccaacggattgtttctggaactaatccattcctgctagagtcagaactcacccaccccagtggaacggcattaagtgtattcataatgatccatccctataacccaaacacctcccgtgaggcccacctcccaacgctattacactggtgatcaaatttcaacacaagttttggtggggacaaacagactacatctaaagcatagcaagaacctagtgtgtaatattgtataatcaaaatataagtatttaaaaaacattattcactttgggaggccgaggcgggcggatcacaaggtcaggagatcgagaccatcccggctaaaacggtgaaaccctgtctctactaaaaatacaaaaaattagccgggcgtagtggcaggcgcctgtagtcccagctacttgggaggctgaggcaggagaatggcgtgaacccggtaggcggagcttgcagtgagccgagatcccgccactgcactccagcctgggcgacagagcgagactccgtctcaaaaaaaaaaaaaaaaaaaaaaaaaacattattattgaaatgatacttcacataatgtactgatttacacatgttgctactgttaatgagaattgcatgactggacacttcatttgcatcagcgctttgcttctgacttgttaatcttaactgttgtgtcacaaataaccagatgtgcacattcttatttgtgcttatgaacaaagtagttacactctacttgtgccttctttatatgcccttggcttcttccttattaaaaatatccatgggtgaaaggaaaacagtaattgtagactcacagtcactataataatttgtaattgcttctgctgtgaatctcggcaacatcaggaatgattgagaaggattggtacatagccctggaatgcacgcctttcttttaaggaagcgcttcagaatgcctttgattaagaaggatgtcattatgcagatgagcttgtaattgttctagtgtttgaaaaaggtaatagccccataatcctaagcacgtagacttgtactgagtataactcatgtgccagggactgtgctcagtgtttgctacctattgccgcataacaaactaccctgacctcagtggctccaaataacaacttgttaatatttctcacagttctgtaggttgactgggctcagatgagcagtggttagttatctgaaggctttgttgcttacctgtctggtgagcggaccgggcaggctgggtcggttgggtgctaatcaagcaactctctccaagtggcccctctacctgggtagcttgggcttcctcatagcatggagtctcagggtggccagtcttgtcatatggtggctggttgagttcacagcaagtgttccagagccttgggaggtgggtgctaaaagacttcttctgacctagcctcacagatcccagaatgccatttctaccacattttattgatcaagcattttaccaaggtaaatgctttgcttcagcccagaagcaaagagaggagaattagactccacctcttgatgggaggaatagcaagaatttgtgatcatccttaatctaccctactgaataagtgctttacataaattatgacattaataggcttataagggcaagttctattctcatctttatcttgctaatgaagagactgcagcacagggatttaagtaacatgctcaaggactgactgctaataaaggatgcttcgagcaatagaactagctttgtatgattctaaatcccaatgcacataataacttaactgtgccacaaaccagttatttttgttattgttatatgttacaaattatttgttcaaaactggcatgtagtagggagagcaccactggtctgatagaatggactttttaaaaataaggggtcttgtattaaaaacataatttaataattttattgaataatttgaaccaggtttgaagcatttccgtggaaggaaaacatgcaaattcccacaatgttagggtcctggtcaggttctttggagttacaggtaactgtttgtcatttctgggaatgtatgagatgtgcagaggcaaagtccagtatcagagatggtctcaccttgatggcagtaaaaggctcaaatgcgtttataataataccaacagcagcagcgacaacaatatatttgtttagcactttacagtttacagtgaactgtcctcatgttatttcatttagtcctcaaataactctatgtggttggctttttgtcttcgatctgcaggtgtgaaggacagaggcttagccatgtgaaatgtttttgctcaatgtcataaaggccatgcgggaagtggaccctaagccaggcagtgtgactgctccagggttcccagctccacagtgcaggaggcaaccatttccagttcttttcttcctttactttctcataggatactttttaagcactataaattgggttcaggaaatgtcagtttgtgaaatgtgatcaatccagaaggccaacctgctggactgcaggggactgttagagatcagaggttcccaggtctgctattacagctgttgggtcactgtgcaagcactgctgtcagggtggcacagtggagggcagatgagccctggcagcaggtggacttgggcacgtattcgctgtggcaaatcatgtaatctctggggctcacttttctcattgcaaaatactgacagtttgcgtagataatgcctctaacggggaaccttgcctggcatgtaatattcaagatattaccttagcagcctcttctcccagactgttttacatcctcgtaactttaaggcttaagggagtttaagtagattgtttccacaagaggagctctggctgagctgttttctttatatactttgctacggggtctggcaagtaaaaggtgctgagtaatagctttcaattcactaaatgaatactgtagaacatcattattttcattcattcgactaaatttataacatactctaaattttttattgaagtataacatacaaagtgcactaatcttcagtttaatgcacgatggactttcacaaatggaacagacctatgtaaacacctgggtcaagaaataatgttaccagctgtccagaagcccaccctgttcccccttccaagcattaccttaaaaaaaaagtaactagttgtcttgacttctaacactgtaacatttatttttgcttgtttttaagttgtagcagatgcttactgtaggatctttgttttttttaggtacttatactaagatggcattaatagacgttcttaggaccaaagggctggggcagaatgtgctgccattgggccacaagtgtgcagagacatggatgctggcctggggagatgggctgggtaggctgtggccctttggcttcttccagctgtagccatgtgggcccgtatgccctggtgctatgtagataatagcactttctctgtttgctgggatgtgaataaggttggaaagcagtgtcttcagaggccttgtaaaattgattaaaatgagaagcatattacttttattttgcttcgttttgtttagagacagggtctctctctgtcgtctaggctagagtgcagtggtgtgatcatagcttactgcagcctcaaactcgcaggctcacacaatcctcccacctcagtgtcctgagtagctgggaccacaggtcctccagcacacttggctaatttttaaattttttgtagagacagtgttctcgttatgttgtcgaggctggtctcgaactcctggcctcaagggatccttttgccttggcctcccaaagtgctgggattataggcatgaaccactgtgtccggcctgagaagcatgttaattgtgtataattaagccattttaaagtgctcaagggtgtttgaaaacagttctctcaaatattaaaaatgtcttgtttccatttttaatgaacaaaacctttctgtgaagaaaatctttgctaagatcagtctttcctcttaccccagctttactgaggtatagttgacaagtaaaaattgaatgtccacttttaaggtatgcaatatgatgttttgattgtatacattatgaaatgattaccacagttaagctaattaacacattcattatctcacatagttatcttttttgtggtaagaatactttgagatctactctcttagcaaatagatcagtctttttaaagttgtttttaatgactagacttaatgtatacttgtaaagaataaaaaaggtacacataggtataaaatgaaaagtaaaaaagaccacctttctctactaatgtcttctatttcttgtgtattttttaagctatggtctatgcatatgcaaacattttcttgcctttttcctctaaaggtaaaccttgagtattattccttggccccatgtatagagcaatcccacttattttaaaagtcacatagtgttctcttacaacagtatatcatgatttacttaactggtgccctaatgataaatgttgaggtagttttcattttttggctttacaaacaattctgcaataaaaatctttgtacctgaatcttaatgtacgtgaatgaaatgtatttgtgggattttctagaaatagaacgttgggtcagagaataggagattgatatctaaaaagatattgcaaaattaacctcaaatattgtgccaatttacactccctttaaatgtttgatgacatgattttctacacccttacaacacaaaatataacctaattttttgtttgtttgtttgtttgttttgagacaggggctcattccatcacctaggcaggagtgcagtggtacaatcttggctcactacaacctctgcctcccaggttctagcgattctcatgcctcagcctaccgagtagctgggattacaggtgtttgccaccacacctggctaatttttgtatttttagtagagatggggtttcaccatgttggccaggctggtctcgaactcctggcctcacgtgatgcacccctccttggcttcgctaagtgctgggattacaggcgtgagccaccccacccaaccatgaatataataaaattttttatttttgctaatattatagcttaaaaatgataatctattttaatttgcatttctttataatgacaatggatattttaaaaatttgtttattgactgactatatttttctgttacctgccccttcacatcgtttacccattttcaactgggttgtttttgttactgatttgtgagtaatctttgtatattaagaagctaaactctttgttatttgtattgcatatgtttttcctcagtttgttgtttcatgtttcactgtttactgtcttttaaaaaatcataccgatatttagaaatcttcatttagttaactatatcaatcttttgtgattttgatgttttatgtcttgcttagaaaatccttctctactctaatattataaaagtatttagcgcgatggctcatgtctgtaatcccagcactttggaaggctgaggcgggcggatcacgaggggaggagatcgagaccatcctgtctaacatggtgaaaccccatctgtactaaaaatataaaaaattagccgggcgtggtggtgggcacctgtagtcccagctactcaggagactgaggcaggagaatggcgtaaaccagggagggggagcttgcagtgagccaagatcacgccagtgcactccagcctgggggacagagtgagactccgtctcaaaaaaaaaaaaaagtgtttagctatattttgtcctagtactttcatattttcttttttacattttaaattatttgagcacgtggattttgggataaagaaccagctagggatttagtctcccctcccccacccccctctaaatgcctagctggttgctttaataccatgtattgattaattcataatcattatctactggtctgacatgttatctttgtcataaatgagatttccatgtgtatgtgtgtctgtttttggactctatgttctattaaaattttaattaatttctgaatttgagaaaaatcagagccagtagtgtccgaattatgaatttacccctggttgtttttttactcttctcttgatgtacttctcacacactgcattctgttgcataaaaagaataacatggtgttgaatgacagatctaaagatggacatttgtctatgtggtaaatacgtggtagattctgggtgatttttcatatgcttcatataaaaaatgatcgtacataaaataacttttttggaaggaacataatctgagccattcagatacaacgaaatccagctcctctctatagcatcgctgtgggtgtagctaaaatatgagattttaagtttaaaaacaacttctgcatgttatttggaaatattttttactaatttcttacgcagcccaaaacttaatgggcaaatttaaaatacgcatttagtgtcttagtattttacaaagtccttcgagcctcaccttatcttttttttttttttttgacacagagtcttgctctgttgcccgggctggagtgcagtggcatgatcttggctcactgcagcctctgcctctcgggctcagacaattctcccgtctcagcctcccaaatagctggaattacaggcatgtgccaccatgcccagctaatttttgtattttttttagtagagacagggtctcaccgtgttagccaggctggtcttgtaccccgacctcatgtgttcccccatgttggcctcccaaagtgctgggattataggcatgagccaccacacccggtcctcactgtatttttgaaaacatggttacagaattagttgcatgtggagaagctgaaatgctatatgtaaatcctctttcctgattaccagcattctcctaatgcaaagtgtgtgaagtgacagcagagaagatatcaaagggtttggtgcttgggacattctgtattgtcaatgtgagatgcccagtgagatggaagttctgcacagggtggctgggcggcaggcattcatttccgtaagcctctctctttcctcctatatggtatgtgatgagtttgggggaaagcatctgcatttaagctctgttctggtggagagagggaagaggtctcagtgtttatcgtctcccatgagttgagtgtgcaggatctgtagccaacaactcttgagttttgagagttccatgtgagcctcactacatgctaagtcagaaccacagggtgagtgaatgctctttctctgctccatctggcttctgtcttcttaacagcatatctgctgtttcacatagctgcatatcaagccagttttttgtttttgagatgggggttctcactgtgttgatcaggctggtctcgaactcctggactcaagtgatcgtcccgccttagcttcccgagtagttgggactacagatatgtgcccagctacaagctggctcttttatttttggggcagtttaaccacttggcattgtcaggtcttccctaagcttcccttggtcttttcttccattttgctgtttttttggacattaaataatttattacctctaccaggtgcttggacagaataaagtaaaagagagaatcgttatgttagaaaattaacttgtgcaaggtgacataaaattctctctgctgttgattcatccatgctggctttgccagtggtcatgagggtaaccagtgattcaactgtatgggagggaatctgccctttctgagtggatctcacaaggtgattcctgtgtgatgatgtaaagatgagaacctttctgggaatttgctttttttttttttttttttgaggcagagtctagctctatcaccctggctggagtgcagtggtgtgatcttggctcactgcagcctctgccttccgggttcacgattctcctgcctcagcctcctgagtagctgggattacaggcgtgtggcaccacgcccagctgatttttgtatttttagtacagacagggttttgccatgttggccaggctggtctcgaactcctggcctcaagtgatctgcctgcctcagctcccaaagtgcctggattacaggcatgagccaccatgcctggcctgaatttgctttttatctatgataataagctcctcacccaaacagataggaattgaactcagacaaattttaatgtgcacacatttgcaaaggtaggcttgcatttttcattcactttctcttttatatatttacatgcgcagaggacaaaatgcagaagacacacaggatgagcagcgagaaacgatgcccagcctccgtctccctcagctctgccactcctctccccaggggcaccagtcactagtaatgccctcagagctcttgggttcatccagcatgggctctgctctgcctatgcaggtaccagaccatcttcgtccagggggacgtggagtcacacgcatgcaggcaacaaggagagggccggtcaccggatgaggctgggcccctggggcaggggtttcatcagagccctaggtctgctctgtctccagagaaacctccccagaggcccaagtcctgcacccactgcagcagggcagggctgtagccaggtgagcagagggcagaatcctcccctggaatacattagaccctgtggtgacattagttcatgctcagtgctctgttcacaatctctggtcctcacaacggccctgttagcgggttaggtgtgggcatgcagtgaggtgggtcctggaacttgtacccaggcttgtctgacaccagagcccatgctctccaccacagccgtgtctccaacctctccctagtgcttggtgctactgcaaggacttctttttccttctccccttaactgtcatgataaagtgacagcatctcagacaaatttaaaaattccctgaaggaatcagctggttggcgctgaactttgcagggtgccgtgaacaccctgggctggagtctgaatgcattgctttcctcatgcaacagtattgactgagccactgtaaacacacaagagttttgctgggtgctgagtgtattgtgagttttcatcgtctgtgctaatgctcatcttactgagcataataacctggagcatgacctatattgaattcacttggtggttgctgcaggatgcttaaaggaatgaaacttgagggtaggttaagggaagcaatggtgatgagctgagctttcaccaggtggcacctggctctggatgctgatgtgtttggatcagtggtagaaaacaagcaaatagaatggcgagttagacagtttccactgcgcacagcacttgggtgttttccatgctataaatctttattttttccactttggtttgagtgggatcacttccattggagctaatccagaaattgctaattcagtgggaattgtgagtctataagttaggaataaattgagcttaacatgcaatatattggaaatgatcctagatcctggatccttcctcttcccaaacagtgagctgtgagggagtcactcctcccaccaggttagaaccatccgacgtgtgcagatgtggcatatatggtgtatgttctgagggacaaaatgacgacccctgactgcagtgtggctccagcattgcttgcttccaggctgaccagggacaggtgtcctggaagatggctcttcctgttcccagagctgtcccacccttcagtgtccacaggcattctggaagcccaggttctccttcattctgcttaatagctcggcctagaattctcattcgtattctgtgcctggagacccaatccaaactccaagcctcattccattttcctgggctctggttccctccaggattcggtccacaggtgggtgtggacaagactgctgggaccacggccttggttccctgctctgttgatgaggttcttgggctcagacaccacctgcagcccttctgcagccagcctctccgttgcctgcaaacccttgcccatccttccctcaagactccctcagagacattgtaccgttgttttctagtgatccttgaaatttgatgcagtagctcttagaaagaagagactagaaaaaaaataggaggcatggttactggggagggggggcttggttggtaaaaataagtgaattttgctggcatgggtcaaattcctcccaactgaaaagaggggagtatctattaatacaaatgtaaagaggggagaaaatgtgttctgttacatgggagaggcatgccctgtagtcaggagcctgtgtccagttatgtgagatggaagctggggggcagggtggcggggaggagggagggagggagggagggaggaaaggctaaactaaggtcatgcactcaggtcctcaggtacataagagctagtatctatcgcactctatatactgacactggacgaactccttccctgcactgtcacagccctgtgaggtgttgctcttcctgtcactattgtgcaattgagatggaagcctggagaagttaaatacttgctcagggccccgcagccagtaagtggcaggacctgtgcttacctcctggcctatggactccagcgattgtgttgtgaagccaccacacccgctgcctttcctgaacacggacaggaagtgttacatacctaacgaggagaacatgggcaaaaccttgcgagtttaagttgtgagtgagctaagggtgagccgagaggatgactgtagccaagcctggcagcctggggagcctatctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtgagagacaagttgtgtgtggttttattctctccatatccatttctttttgtttggttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttgttgtcgttgttgttgttgttttgtttttttttgagatggagtctcgctctgtcgcccaggctggagtgcagtggtgcaatctcggctcactgcaacctctgcctcccgggttcaagtgattctcctgcctcagcctctcaagtagctgggattataggcgcctgccaccatgcctgcctaagttttgtatttttagtagagacgtggtttcaccatgttggccaggctggtctcgaactcctgacctcaagtgatccgcctgccctggcctcccaaagtgtagggattataggtgtgagccaccatgcccggccctcagtcttgtttttagcagcatttgcctgtgtctgctcacggatcatagtccacagtttgtcaaagttgacagttgggctgaagctctgtttcctctttaagtggtaatgcctcacaccagctttcccacataacctgggtgacatttgtcaaagttgatcctgtggtggtgcacaccacctgcattaccacagcctccacggtgcttccgcactcggtgatgtggccatggccgtggctcgtgtggccctgaagtttccggctcttcctcagtctggatggcatgtcagacaaaagaggaaggtttctacaaagtctcttaaggtattgagcacctatttctccttttaaaaacgggcaagctgagcacagttgtgcatgcccataatcccagctacttgggaggctgaggtgggaggatcgcttgagcccaggagtttgagatcagcttgggcaaaggggaatttttctttcattatcattttgatgtagaaaatcagtaacatcttctttgccaatatgaaaacatgtttttctttaagcagagtcttgctgtcagccagattggagtgccatggtgagataatagcttaccgcagtcttgaactcctgagtacaagggatcctcctgcctcatcctcctgagtaggtgggactacagacatgcaccaccaagcctggctaatttttaaaatttttgcagcgatggggtctcactaggttgccccggctggtctggaactcctgggctcacacaaccctcctgcctgagcctcctgagtagctgggatcacaggtgcacaccaccatgcctggctaatttttcattaaaaattttttttagagggtctttctaggttgcccagactggtattgaactacttgcctcaagtgatcctctcccctcagcttctcaaagtgatgggattacagatgtgaaccaccatgcctagcctgaaaacatttccttttgattctagcatttagatcctaaacctaaaactgttgccctagaattgcgctgcccacttttgctgctgatcttattccctgtccagacctttgaggaccagagttggttgggcctccctcccagatgatgctcagggtgctggatgctggagtgcagggactttctctggtgactgtggggaagcccctgccctctcccctccctttttttttcatttgttgattggcaaagctgagatttcccagtgtatgtgaatttggtttggttcatttgtaaaccccttgacaactctgtacatcagaataatggcattcctcttgggagtattttgtaattatttgctcagtgtgtaatatcccattaaatatccaaagtcaattcagcaaatgtttattaataataagatttgccgaaagcaagagaagtcttaagtgggttatgcctacagtttctagaaagccttcagattgtggtggtaaaaaaacttggctttgtaaattttgtgtaatttgtattagaagatgctaatttattttaaaagcacagtactcttttgtggtaaatttccaagtttgcccctgtcatttgaaaagcttttggtgtgagtgttttcagatgttattgggtggtaggggcaaggactcgttatttttgttttcaaatatgtattatctctttcaaatagctattaaaatttattatgtatttgcacttataaatgttttatgtaccaatttaaaaaatggatcaatagatttctgtgtctagcagagaatcgattaatgagttttgaatagtgtgccaaggtgactcagctttatgactttccatggatgacagattctgcccctgcgacaaggtcaagcccataaaaattccaatcagataccacaaaaagcacagtttcataggtcagtttaattctatagcagtcttttttgtcagcatagctggcgattccatctgttttaatttaagattcaccccagccatgcctctgtagcaggtgacacgtgcacacacacacacacccccacacccacacactgtttccttatgtaacatacatgatgtaaatatgtaatataaatgtatagttatgtagaatataaatatatttacattgtagtagaggctgagtcggtggtataatagagcatctgcaattcaatatttagagtataaagctgtttttcctttgtgaaaccatttgttttccatacactgcttggtgttgggcggggaaataatgcagttacttatctgctacactaacgagcagatgactgtcctcctctcctgcggctcttctgcagaaatgagtcgccacagtgaattgcttgtgtttattattctggtcatgggttagcaccaggtgtcacagtgaatcaatcttggattggtaaaaggttgtcacgacggcagaaaattgcaggctagagcaaattgtcctatgcccattacagaatctcaagtaatgatggttggttatgcatggaggggctgaaatagtccatagcataaggaaaccaagcaggggtctctaaataggtcagagggttctaacagataccccacccccttctgcttttaaaagctcttgttactgaatggtcataaagagagttttgtctgccccccacgctaaccaacaagacaggcttaccaacaacgtggtcctggcaggcagccagccggccggcatttaaatgatgcttgctgctgtggcaaccccacgggcctttaatgggtgagcgtggatgcagcagctgaaggccaagtgcatcatggaaggcagcggtgcaagcacagccctggttccaatgacttaacgccgcctgggccactgcaagaccggtgtggcagacagaccccctggcgaggagctaactgtggggtgggtggtgggatattgtgaaatgtgtatttggtcttcatccctgtttcctaaaacccttagaatctctggagcgaagagtattttttgcctgctcatgatggactgatagctggcagcccccaggtagctttaggatggggctggtcacaggaaagaccaaggcaagatgggagggttgggacttttagccccaccaccaacctccagggaagggacctccagggaagggaaggggcggaaggttgagttgatcaccagtggccattggtttaatcaggcatgcctacatcatgaagtttccataaaaacccaaaagggtgagtttggagagcttctggatagctgaacatgtggaggctcctggagggcggcgcaggggcacactggggagggcatggaagtcccacaccccttcccacatgccttgccctacaagtctcttcatctgcatcctgtgtaacatcctttataataaactggtgaatgtcagtaagtgtttcccggggttctgtgagccactctagcaaattaatcaaacctgaggaagtggtcatgggaaccctgatttgcagcccatcaatcagaagcacaggacaccttcctccttgtgctaggcctctggagtaggaggaggcagccttgtaggactcagcctcccgctgtgggatctgacattatctccaggtaggtagcttcacaattgagttgaactagagaacactcagagaactagagaacgctggtgtccgctgaagaatcagtggcttgcttggtgtgtggggaaaacctcctgtacatttggtcacagaagcattttgtgttgtgagagtagactaggagaaaaaacattttgtttttctactcaggtggcatgttccaaataaaaacactggaaagaatatgagtttaaagaaatggattgtaatgcatgatatagttgcatactatataaatacatctcgtaaatttggatttcattgccttagaatttctaagaatttggccaggcacggtggcttacgcccgtaatcccagcactttgggaggccaaggcaggcggatcatgaggtcaggagatcgagaccatcctgactaacacggtgaaactccgtctctactaaaaataaaaaattagctgggtgtggtggcgagcacctgtagtcccagctactcaggaggctgaggcaggagaatggcgtgaacctgggaggcagagcttgcagtgggccgagattgtgccactgcactccagtcttggcaacagagggagactctgtctcaaaaaaaagaatttgtaagaattcagactcagggtgcaggatgaatttactgcttaggaagatgtaatgtgctaaaaaaaaaaaaaaagtaaacaaactatctggatgattcttagcctatggagagtaaagcacaggtttttaagtttcttagatacactgtattgatgaggatacagactaagctgctgaaacaggagatcccagattatagtgacttcagctttttcagtcctcctggtggctggttcagggcttgtttggtggcttgtggggtcatcacattgtatactctcctgtcctgtgtgccagcacctggtcacatggccacccctgactgcaaggaagatgggaaaatgtcatcgttagctgggtaaccaggggcccagctaaaactcagcgttctttttctaatagttgaaagggagagtgagtatcacagagccccagcagtttctctcctaagcatcttttattttccaatgaggacactgccaggccagttgtgtcttccttggctagagctttgatctgcaaacttggagctgattctgacctcagaccctggggtgacgagaggagctctatgattctagttagaccagcctaatggatgaatcctgactccctcacttgctgtttgtgtggccttcagttcggctgttgagcctctctgacattccgattcactggtaatgataactgtctcacaaagtcattgtaacaagtattttgagaacatccaggataatgccagtcatatgatgagttttcagtaaaagttcctttgttccttcctctataggatgaatcatagaaatcatctacttacctaacgcttccagtgaaacaagttaatttgctcagagcctgatttaatttgcattattgcatcaggatgacacctctttacagtaaagttatttatacttctccaaatgcaaaatttaaaattattttggctggacgtggtggctctcgcctgtaatcccagcactttgggaggccgaggaaggtggatcacttgaggtcaggagttcgagaccagcctggcaacatggtgaaaccctgtctctactaaaaatgcaaaaattagctgggcgtggtggcgcacacctgtaatcccagctactcaggaggctgaggcaggagaattgcttgaatctgggaggtggaggttgcagtgagccaagattgcaccactgcactccagcctgggcaacagagtaagactctgtctcaaaaaaaaaaattcttttggtgggttaatgttacccagaagcagatcatactgtgctcacacatcttctgtccacatcataccaatgctagaataaagggggtaaacagaaaaacaggttttcttgggaaatgacatatggaagttgctgcacaggggtctctaatggcagaggtgcctccagggggctttgatatgtcagcagtagcagcgcacactgcaatgccttccttgcttgtagtaagtggcctctgggttcttaaaacaagaccctattgtgtaagatgctggacttgggaaaacccctggcaggggctgcattgaggctggtgactcctgttggggcattgtgtgctgcatagtgtaataggcagccactctaggcccagcatggtggctcacgcctgtaatcccagcactttggaaggccgaggtgggcggatcacttgaggtcaggagttcgagaccagcccggccaacatggtgaaactccgtctccactaaaagcacaaaaattagccaggtgtggtggcgggcacctataatcccagctactagggaggctgaggcaggagaattgcttgaacctggtggggcagaggttgcagtgagccgagataacgctactgcactccagcctgggcaacagagtaaaactccgtctcaaaaaaaaaaaaaaaaaaaaaaaaaaaggcagctgctctgggcacccctggattgtggcaaacttcagaattgggtgtcagtgctaagtgaccaagacaataccaccgtggatggatcacaagggctggagttgcagagtcagagctgatggagctttcctgccagccacgcaccatctgtccagtgggaagtcctttctgtgctgggaggaaggggccagcaggaccacttgtcctgcgccagtgccagcctctctcagcctgtgtgcagcacgtacatgtccatggcagccctcggctggatctcagggctgtgggcaggggtggaggccactgctaggctgtcctgctgctccagcagccccctcaggggccgttgacttttcacaggaacccaggcctgccatcgagggtggagatttcatttggaaatgctcgcctcacttcccatgcggttcctctgtctgctttatgagcgggacatacccctcatccactgcctcatccaggtttcctggtgtggcagggtccccagggacccagagggagccaggaaatgtgagtcagtggcttcccaaagtggctgcctggcctgtggtgtcatagggctgctgctgtctgccctttgtcctgtctcacgctgtccccagccctcccagcactggccgttgagaagacagagttgagttgactgtcactgttgtcttggggaagaccacccggcaaagcactggcagggctcgaagtgggaaggcaaggtcagactggattgagagttgcaactgtgattgaaggcggtctttcaaagcaggctcttggtgagggttgggtaagaatcgcgatattgcagcgcagagttggtggaaacagcaagcaagggtttcgaggacttcaaagactcctaggggcaaacttctactgcttcctactgaagagtggatgggccttcagggaagttcctggcaggaacagtcctcccatttgtctgggcggatggtccggaagagcaaagacatgctaatgagacagaggaatagcaagtccccttcaagccgacaggaaggggcctcagttctcagcgccagcctgagtgtgggggctgcttggctcggcctgtttccacgctagggacgttctacgtgttttcttcttcatggctttttgttttctaataaaagatgtttctattcataaatgttgtagatgaggataatgtctatttgttttattttggaggggcagggttggggaaggctgaggaagggggctgtctgattgctggctcatgcccaattacagtttatttcctccctgagtgccctctttgatgtgggaaggaaagggaatgaaatccttctcttttactcatgagcagtgcagacgccttctccggacagtttggcttgacctgtgcagagtgctttttccccagcgaaatggaacaggaaagctcacggcagcaagtggcagaggggtggagccacaacttggctctttttccttcttcttttccttcttcttctttttaaaaaaaatccagtccactaaagcacgaatgtttttcaaagtcgcaaatgaaatacagtaggattttaaaaaaccaaagctgtctttcaacatgttgatgttctcggactgtagcaaacatggtttggacttgtccatttagaaagcagtgtaaacaggctctgaaatgccattgtaccaagggaaatgaggacatgcggcaaagctttaagaattcagcccctagacctgcttttgactgaaatagttttgcttgaaataatttattttccttgaattttttgatttttatttcttcagttctgtctggtcaccttccctgtataggcatgaccagcacctgaggaagaatgattaacacatgtacaaataacttaaatgtactcgaaagctataaaacaatatgtgtgttactgaaaataaacagatagtgtaatacctggattataaacatcttgatcccttgaaaataaagtattgccttaattcaaataataatacctcaatgtttatatagtgcctatctgaaaagtatttaaagttactgttattttctagatttcctggcgggttgattcactggagggctagttggttagggaggtagcacctgagctgccaccctctcacagctcccagatggacatggagttgggcgctgggtgggtttgggaaagctcctgggtccggccctcccggatatgcttcctgccccagggcttcaggggatctgcgttctcaggccacatgcaaaaccagttgttaatcatccctgacacactctgagtcaccaccaccctctgggaagccacagggagaccttggctgaagccaccgcagcaccatgtttcgccatcttgcagccaagtctgtttatttgtctgcctttggcacctccaggacctctgtcttttgattgttggtctcagtttgcagacagatctaactgtggactcccgggtgcggtctgtgcctgttgggaagatgggcagctgactcacttcactgtcatcccctcacccatcttctgtggtcccaggctccacttacctcctctatatgaccctgtaggcgcagtgggtgctttaatcatggggcacagtgggtgcattaatctttcctcattttagtttgcatttttatttagcggtggagttgcctccatgaatttctgttctcatccacacctttagtttttctctttttattttccatgtcatagtaggaggaaatttggaattagcagaaaacattactgaatatttccagtggaaaactatgcattgtgtagagcatacccttccaaggtatctgattgtagcctttgatccatttcatacctccgtaagttgtaggtaattggtagcaatgcaaaataactattgcctgtagacatgcaaaaatgtctgttagcatggctaaaatgaccccctccaagccgtaggaaaagcagagttcgtatttgtaaattcatttcaacattcctttactccatatatacttatgcttctctgacttctccttttaactggttgtaacatcttattaattccctaattaatggtgaagtcaataaaatctttgacatgttcattttgtatctgtatgagagttgattttacctttgattattatttttaacgtaatattttatggtccctattaaaaataacaaaggtaccgtgcttcctggttaaccagtgacaagaatgggccctaacaagaggaacttggatgcaaaaagcagaatgaattaatcctgagggcttaagacattggaagtttttctcttaatattgtaaaaatgtgtagactcataaacaaccaatagtcaaagaagaaattacaatggaaattggaaattaccttgagatgaatgaagacaaaagcacaacattccaaaacttcagagcagtgctcagagggaaacttatagccataaacacctacattaaaaaaagagaaagacttcaaatcaataacccaattttacaacatagggaactagaagaagaagagcaaaataaactcaaagttacaaattgtaggaaatacagagtgaagagaaatgaaatagagaatagaaaaataatagggaaaatcagtgaaaccaaaagttggttctttgaagatcaacaaaatcaacataccttaagctacgttactaagaaaaaaagagaaaagaagtaaatcactaaaattaaaaacaaaatgggacattactactggccttacagaaatgaaaaagattataagagaatactatgatcacttgtaagccaacaggttagataacctagaagaattagacaaattcctagacacacaaaactaccaaactgtctcaagaagaaacagaaagtctgaatagacttaaaacaagtaaggagaatcagtaatcaaaaacctcccaaaagaaaggctcaggaccagatcgctctactggtaaattctaccaaacatttaaagaagcataacatcagttgctcttaatctcttccaaatatagaagaggagggaatacacctaatttattttatgaggccagcattatactgatgaagcctgacaaagatattacaagaacactatagaccaatatcccttacaatatagaagcaaaaatcctgaatgaaatactggcaaactgaacccagaagtatattaaaaggattatacaccatgaccagatggggtttatcccaggagtgcaagggtggtttgacatactaaaacggatcgatgtaatacaccatattaatagaaagagggaaaaacaccacctgatcctttcaattgatgctgaaaaagtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaacaagacaaggatgcccactttcaccgtggctgttcaacataggaagtcttacccagagcaattacgcatgtaaaagaagtaaacggcatctgaatagagaagaaagaagtaaaactatctctgttgcaggtgatatggtcctagatatagaaaatttcaaagaattcacaaaaaacaactactggaactaatacattcagtgaagtcacaggatacaagttaaacatgcaaaaataagttgtgtgtttttacaccagcagtgaacaatttgaaattaccaaaatgattccatttataatagcatttagaagaataacatttaaccaaatacatttaaccaaagaggtgaaaaacatatacaatgaaaactaaagaacatttcacattgctgaaagaaatcaaagaagacataagtaaattgaaataaatccctattcatggattggaagacttcttatgggtaagatggcaatactacccaaagcgatcaacagattcaatgcaatatctatcaaaattccaaatgtgtttcttgcagaaatggaaatgctgactctcaaatacatacagaattgcaagaggccccaaatagccaaaacaatcttgataaagaacaaagttgaaggactcaacacttcctgatttcaaaacttactacaaaattatggtaatcaaaatagtgtggtactgacataaagataagccatacagaccaaggaaatagaattgagatttcagaaataaattcatacatttatggtgactgattttcaataagagtacgaagatcagtcaatagggaaaaaatagtctgttcaaccaatggtgttgggacaaccagatatccacatgtttaagtttaatccctacttacacatttgcataccctttatacaaaaatcaattcaaaatgctcaatgacctaaatataggagctaagtctgtaaaacttctaatggaaaacatagagtgaaatctccatgactttgtttttggcaatggattcttagacatgaaagcaaaagcataagtaacaaaagaaaatgcgtaaattggacctcatcaaaattaaaaacgtgcatcaaaggacagtattaagaaagtgaaaagacagcctacagaatgggagaaaatatttacaaatcaaatatctgttaagggcctggtatccagatataaagtacttttacaattcaacacaaaaagacaaagtactcagttaagcaatgagcaaaggatttgaatagaccttctccagagaagacatacagatggccaagaagcacataaaaagctgctcaacatcattagtcattaggtaaatgcagattaaaaccacagtaaaatatcactttataaccactaggatggctatttaaaaaaatgttggcgaggatgtgcagagattggaacactggtggggttgtaaaatggtccagtctctgtggaaaacagtgctttggtgattcctcaaaaagttaaacatagagttaccatatgacccagcaattctactcctaggtatatgccacaaagaactgaaaagaggtactcaaatacttgtacattcataatagccaaaaggtggaagcaacccaaatgtctatgatgaatggatgagcaaattgtgatataaacatacaatgaaaaattattcagctgtaaaaatgaataaactaccgacacatggtacaatgtggatgaaccttgaaaacattatactaaatgagagaaaccagacacgaaaggtcacatattgtgtgattccattcatagggcttgtgcagagtaagtcagtacatggagattaagtagatatgtgattgccaggggtggagaaggggcaatggggaataactgcttaatgaatatggagtgatttgggggtgaagaaagtgttttggagttagataagggtggcggttgccaccattgtggatgtactaaatgccactgagttgttcactttaaaatggtgaattttatgctatgtgaatttcagcacatacaaaaattgatatggtttatatgtgagtaattagttcctagtaggaagagggtttagatcaacagtattaaatattctccccctgaaaacacatggcacatataacacctacggtcaacggcatccacacaggaaacacagtcccaggaactcccaggattatgcacaatttcgatgagtttcctgaataccacctcatcattaactctgattaattacaagttactggtggcgtatctcgcagaagcaaggtgaggtgattaggtgatggtcattctaacttttgataattttgagggacagcagtgtagggagaaaatactagtgtaaaacattatatttgtctgggtgcagtggctcaagcctgtaatctcagcaccttgggaggccgaagcaggaggatcgcttgagcacaggagttggagaccagcctggacaacacagtgagaccctatctctaccccctacccccaaataataataattagccaggcatggtggcatggaccggtagtcccagctactcaggaggctgaggtgggaggatcgcttgagcccagaaggttgaggctacagtaagccatgattgcaccactgcactccagcctaggtggcagagcaagaccctgtctcaaaaacaaaaaagctacatttatatagattagcctaaagaacgtaaaatttgtatcctaattcctctacttagatcacatctgttgatatttaaaaatataaggggaccagatgcggtggctcatgcctgtaatcccagcactttgggaagtcgaggcgggcggatcacgagctcaggagttcgagaccagcctggccaatatggtaaaaccccatctttaataaaaatacaaaaattagctgggtgtggtggcatgtgcctgtaatcccagctactcgggaggctgaggcaagagaatcacttgaacccgggaggtggaggttgcagtgagccgagattgcaccactgcactccagcctgggcgacagagcgagactctgtctcaaaaaaaaataataataaaaataaatataagaaatgtatagaattacaagattcaaatagtatagaaaggtacagactggaaagtgaaggcttctctacttagtacagttgctgttaatgcattcttgtgatttctgtttgttttcttcaaagaaccattttatggttatgtgcatatgctgacataattaaaaaaatagaggcatcattacagatttgcatatggcttttttcacttgatataccttgaagccttttccacacgtatcagcacctaaggatgtactttattcatttaagtggctgcatcatcacgataataatcagcacttattgaacatttgctgtgtgccagcactgttctaactgctgtggacacattgtcgtcattgttaatcttcaccacagccctctaagggaggtgctaccattgccccattttacggaacagagggaacagagggaacagagggagcggagggaacggaagtgcagggacacccaggaagagatttaagttctgtgtgtctgattccagagcccaggctctcaccaacacaaaattctactcctctacacagttagtttgtgggagagctgggatttattgtaatttatagtttacatagcttctatgttttgctgttttctggtccagttccctaaggtgtgtgtgccctacgtttcacatttcggtctcccaggggctctaccttactgggttttcttgattttgtcttccttaaattagaaaagaaaaggaagaaccaagaagactgaaacagttatgattgaggtttgcagaattgttcccatgaatggctactagctcttgatatattagtccagagcacagaaaatctatacttttaatagcttggactgcacacaacagtaagtctttatagacggttctgtcctgtaggggagaaaagtcctcgttgttcctctgggatgcaacatgagagagcagcacactgaggctttatgggttgccctgccacaagtgaacaggtcccagcatgaaagcagggacaagaaaattgagctcgtgacctccgtccagtgggccctttgattcattctttctttttgtctcactgtgtcatcatatctccctgaactcagctccagattgaaacgtagctgtaaccgcagctaaccaacaggcttcccttgaacaggccgaaaggtacagggtgagtctattttgtgactctgtggaggcgtgggcagcgagatggttgtctaccgggatctgtgttctggcttttgtgaagagggaagaaatgggaaacacgctgatgccagcctttctgcaactggtttgcgggagtgtaaacaactagctggtttggatctaggatcaagatgaagtgtaatagaaaactcgggctgcctttatccttaggtcagcaaaacagcaggatactgctgtctgcgtcccggttgaccctggcgttcttggccgctgccaatacagtttgccatttagatccatttagcagaaaaggacattcgtctagaaggatcccgccttgtaaaaatgcaggcttggcatgcactggggccctgggaagtcattcttaaatatatgaatccttttctgggggagaggtgccggcagttgcatgcaaaactgggcactgctctggcggattggccagtgcattcttacgtgtggtgggcactgtggaaaggcgcctttgtgccagtttggataagacaacagattcatgggtaggaaaccagtgtttgaaattaggtgctgaggttgtagagtcagatcacagcagagcagaagttgaagctatgagttcggagaaggtctgcaatatttttcctgacctctgaagttgtccaaaccactaagtgaagaaacatacttcctttggttcatctgatcaaattatcatctgcaaacttttggccttgttgcctcaatcctactgcaatcttcctgcctgcttgagagagaactgggtgtcgggggagtgggggcaatgtactgttgctccccagggtcaaaacgtgaacagaccaaagggtccagatggaaaccagaatgacttcactcctggaacgaggcatcatctttcctagcacatgtatttttctttcatgcctcttttcttttttcgttttttaattttagtctttttgagacagagtctcgcatggtcacccgggctggagtgcagcggtgtgatcatagctcactgcaaccttgaacttctggctcaaacagtcctcctgcctcagactcccgagtagctgggactatacgcatgcaccaccatgcccgtctaatttatttattttttattttttgtagtgatgaggtcttgctatgttgcccaggctggccttgaattcctgggcctaagtgatcctcctgcctcagccctgcaagttcatttttctttttaaaataaagtcagtcagttataaagctagaatgtaaaaacaaacattttctgatggattagaggatacacacagctttctgtaactgaaatgctgagtgcatgtgcaacagtgcctttaaacaatgaccttggcccgcggtgcagatttgatacactgagcataactggctgaatgagtgctcctggtgctttggctagaggcaggacttggatgttggcaaggcccttacatcgggccacagcaatctttcccagactctgcatgtccacttatttctaggtaggagacatcattcttttgatgtattgctctccaaccgcaatggtagagcagcacatgattaagtcatggttagacatataaacaatacttgtagcagaaacttgagctggtgcacgtaaaaaagtggttcatttaatgatgtaacggcaaagtgaagggacaaaatggaaaggggcgtgcccagggctcatctacaaaatctttgggacaattcctcttgggagtcaagctttagatgcctgctgtccagccatgagagaacatcagagggtcacagcataccccaaggttccgttaacagagcaaaacatcatcccttgcaacccaaaggcaggaacacagctgggccccaggaagacagggattgtactagaatcccttgcagtcctgagagtgctgtcttctggctgcttggcttagctcctctctgcaacccagcttcctctcgccttgctgactctcctgtagggagtaaaagaggctgcctccagcctctactcatacagctttgtttctgtgtgtttcccagcctctgcgtggaaggacatgctgagagccctttctccaccgtgcttgcattgactgattacatgtctgtctgtgacaccagcttggctgttttatttatttatttttttttgagatggagtcttgctctgttgcccaggctggagtgcagtggtgtgatcttggctcactacaacctgtgcctcctgggttcaagtgattctcctgtctaagcctcctgagtagctgggattacaggtgcctgccaccacgcccggctaagttttgtatttttagtagggacgaggtttagccatgttggccaggctggtctcgaacttatgacctcagatgatctgcccgcctcggcctcccaaagtgctgggattacaggcatgagccatcgtgcccggcccagctcggccctttaaatggacaaaactgtgcaacctggaggtctgagggcagctgcagctttcatcagctccagcatcccattgacgtctgtgttgggtgactcagtattgagcagatcctgactgatataacatcattcttctaaagtttctatttctgtatgttttatatattctatgatactttagtatagtagtacaggtacgcaatttataaatgaatacacacatattcgaggatgcacacaaacccttttacaactagggatgtgcaatcaaagaagtttggagacttttactttatggaatgtctacactacgtataggatgtttatccagaatatctgtgggaatatgcagtggttcatacaaggcacagatcatatcttgataaacacatactacacattttctttcttgactccaaaaaaacttaaagagatttatatccatagatcttaagatatgtacagtggaatttcatgtttcaaacatttactgatattctcacattatcatgagaaagaagactgggactgtgctgtgggattcttattaagttgtctatacttatttgcataaaatgatttttaatataaaattaaccaaagttgctcaattataagaaatgaatggctttatttgtgatactgctatgatttgaatgtttgtcccctctaaaactcacgttgaaacttaattcccagtatattgagaggtggggcctgtaggaggtaattgggtcatgagggctctactgtcatgaatgggttaatccatgacaggagtggtattaatgggattaatgggttatcacaggagtggcattaatggctttataaggggagaaagaaagacctgagctaactcatcccctttgccatgtgatgccctgctccaccttgggactctacagagtcctcaccagcaggaaggccctcaccagatgcagctcctcaaccttggactctcagtctctgtagccataagaaatagattacttttctttataaattactcagtttcaggtactataaataacagaaaatggatggagacagataccttggctctgagcttttttcttccttggcttttgaaggcctctcctggtccagtgtggattctgtaaagcttttttgaaggtcttttagcaatgaagaaagtatgtactaggagatgaaggcatgggaattggctctaaccccatttctacaagtagcgcgactgtgaattgtggtggggctcaagttcttaatgtgtaaaatgggaacgatgatacctcccagagtcatcagaagatcaaatacaaccatgaacgtgtttgtgctctacgagctgtaattcctaaaagataggtaggttaagatgaagaaaaggcattgttgagtttctcatgaacttctgatgcaaggcgtgttctagtgtatcatgcgtaaggaatcttttccaagcccgagaaaaactatccggtgccaagtgcatcaccactgggcataagtagtcccacccaagacaggaggggtgcagggctcctgccactctgcgtcatgaagaggaattgaaaacaaaactccatcctgttgaaaccttgaggtctagcactatatcttgtccttgtttgtgcatcttacgtgcttatgcaataaggtactctcagccctcagtatctgtgagttccatgtttgtggacttaacaactttggatttcaaatactgggaaaaaaattgtgtctgtactgaacaagtacagacttttttctcttttttttgagatggagtctcactctgtcacccaggctggaatgcaatggcacgatcttggctcactgcaacctctgcttcctgggttcaagagattctcctgcctcagcctcctgagtagctgggattacaggtgcccgccaccacacccggctaatttttgtatttttagtagagacggggtttcaccatgttggtcaggctgctctcgaacttctgacctcaagtgatccacctgcctaggcctcccaaagtgctgagattacaggcgtgagtcactgcacccagcccagacttttttcttgtaattattccttaaacaatatggcataacaactatttacatagcatttatgttgtataggtattataagtaatctagagatgatttaaagtgtacaggaggatgtgcatgggttatatgcaaatactataacattttatatcaggacttgaacattctcagattttggtatctgcaagaggtcctggaaccaatgcccccaggataccgagggacaactgtatgtactgttgaatctccaatgtctaacacagtgcctggtgtggcctagacatggaatatgtgtttagtgagtggaagaataaaggcattaccatacctgcttgtctctctggcacttgtcacaggattgcaagcccagatggtgtttgtgaagaggcaggagtaggtacagtatggaggtctacagcttgggtttctgaggcacagaccaggttttcccaactgttttcccagcctgttttcccaactgtaaggcgtcacactagtaagtctgtcatagaattagattgaagattaaatgaggtgatgcaaatgaaaagagtctagcatacaggaaagcttaacagaatgttaactatcatcaccatcattactaataacatgattagtggtcttaataattcatagatattcatgatgtggaacttggaatctcattagctccgttttgtcttgatgtctgtgactgccttctcttgacttttcccttagtcaccattttttactgcattttcaacccaactggccacatgtgcctgctttgtagtccaggttcccatcagtgcccttggccttaccctctgtgagcaggagcttcgtactctctagcaaggtttcagattagttttctgtgctggaggagttggaggcatttttggtaagctaaggctgtacttgaggactaatgtcacgctgtcaattttagctcattgctgtgatatccagcatagcagtaaggagctgatctgcagtcacttgccctcctctttgagcttcagctcttcttgggctggggaacagttgaggacactgtccaggaaccagagactgaatttccatggcctcatggcagcagtacatggatttaggttgttaccaggaggtttgtccacatgtgaggctgtctctgttttcattgtcagtcccagccgtcacaccccctctctcctttgaatgaatgaaagatgctagcgtgcctcatctctgacctcaggaggcctggacaatggaagaggaagtgggggcttttgctgccctctgctcagaggctgcaatgtggcgtggattcttctggcagctgtggtttaggctgccttgtgtttcctggtaaaatttcttaaactaagagtaatattttagcatttttctccaaagagcatagattgaagatgagggcttagtaatttcccttgagttggaaattcattgatgacttttatttatattttgtaatgtctgttaaatacttgcagaagtgctggatgattggagaagctttaaaccatgagaaggtcatgtgagcatggtagttgtggggatgcagtagatagggagttagggttttctcaaactctgtactccctcccttgcttccacattcctttcctcatgcagtgcgatcaagtatagaccctgatatagttaaccttcatgagtataagacaattcctaatacatcatgagtcaaaaaccattattatttaactagaacagtgtagagtcaggaaagcaggtaagttgtgggcagactgtaatatccccagcttataaataatgtggaagtgtattgactgcttgctcttctctgtacagtttgcaagtgtgcatatatctcatttgattaaatcacatctgttgtaatctagtgccctgattaagagattacagcagttaactgtattgcacaggaccttggcttggcagtcggcaaagccttgagcattaattcatatttgtgagtggtctgaggatgctgacttttcaaatttattatggttgggatttatgaactgtttcttttgtctgctctatagaagtgagcatggaatgtaagccaagctgtcattgtggagtcttagtgttgatacgatagactctggtactttaaatcaggccactgtcatctatgataatgcttggcacgtagtaggtgctcaataaaaatgcagcaaatgaatgaacagctcctaaatggcctttgtttccagttttgctttcctccagtcctcttaaaattccaccactgtgtggtctcattggctcccattgccctcagaacaaagttcaaactccctaacgaagtaactgatggtgcccttggctccagttgtataagtttaggagtctgttctgattgattggtgcctttctgcactatgggtttagctgacatgctcctaccagagtttacgtcttagcctgcagtacattcattcctctcttgtttctgggttatttctccttggtgggcatgtcagtatgagttggcgttcagtcaggaagcagagctactctgagtgttatgggaaaaggaatttattacagtaatcccacttaataccagtgtgggtggctggggaaggggatgcctgggagtcagagcccgaagatcagagaaacatctcaaaacagcagcacccggcatggtggatggttgtggctctcaaggaagctctgagaagccagaggtgcccagcagggaagccggcctgcagtggggacatggagcaggtgcctgcgggcagccactgctctgcgtagctcctgcctctacaccctacattgggaggaccgctgttgggagaagagtcagacacagaagagaggagtggggacaagtggggctctgctgggaaccttgtcatctctgtgtgctaaagaccttcagagagtaatgcccagtctttacttcctgcagattccttttttggtcaactctagtccagaactctatggagaaggggcttctgggaagtgagtggtgttcctagctttagccacgttgaacctaggatgatccaggacaccgcatgctgggtctgtgtaacagtgtctctgtgggctgtgtggacatgtgtgtgcacatgtatgcatgtgcatgtatgtgtgtgttcatgtgtgtgcttcagatcccctttggggaatgtgcaggaatgtcagaagtagggagatagagccactgggttagggcagagggcgagaggccctctttgaggccacctgtggagggctaagatgactccatcctggatgctaatccatcatgtcggcttctgattaactccagttctggcaatgcctctaagatttctatttcatcttcttccttgtgtaagagcatgtacttaccataaatcttgtccttaggtcaaaacaaccttgatgttatcgtacttaccgtaaatcttgctgtaaagcagttgttccgcacatcccttctgaagcacggacactgtccccctgtggtgcgtaagccctgggcctggggatggtagcacagggatcccccatttcgcctgtgggccacccgagacgcggctcctgttcatacgtcccattaaatgttgctctctgagaaactggatttgttgcctctttcttcgacctctcagttcccttggcttttggcagtcggtttgcaaaatgacctgctcaccacggaaccagctcattccagtcagagtgggatcagcaggatgggggagtggaaagcataacccaggcccctccatccacatgttcatggggaggtgctggcttctttgcctcctggggggaaaagccccaaatgtctgaccacgctgactcactcggacagccttccttctctgtggcctctgcttgtgttctcctcccccctcttcccttctccattcaccagtcctgcctgtctctttgctgggctagtgcatccttttggtttcagatttagtgcccctgcctccatgaagcctttcctgattgtcagatgcgggcaggtgtccctgtgcatccccatcacagcacttgtcacagtcgatgctacttcccagtttacttgtctgtgttcctcactgaaccaggagcctgtgagggtagacacatgggacttacagcaatagccatgtgcttcccttcccaatgtcacacaagtgagacatggtctggtgcatctgattctgagtctcagctgtgtgcgagtgtggcatgacctttcatccatccccctgtctatctccccatgaggacaaaagcaagggtgactacaaaaatgaccaccgctgccgaggcctttgctctgaaagtgcagcacagtggctgggaccgcaagacagtgtaactgacgacgtctgcagaattcaaccagcgtgctctgttgggtgggacaggaagtagggcagtagaagattagacagaattgataatctttgagatcaagcagtgtgcggctttgagatggagaagcagtagtagctttgtccttcccagggtttggacccagggctgccttgggaatagacgttcagacatcaggaaggtggcctgaaacatggcggctcggctatgtagagcggagggcacttagaggacatttatctatacagcgggtctttttgtttttgtttttgttttgagacaaggtcttgctctgtcactaaggcttgagtgtagtgcagcctcaacctcctgggctcaagcaatccttctgtctcagcctcccatgtaccttggacaccaggcacatgccaccatgcctggctaattttttgatttttcataaagacagtgtctcgctatgttgtccaggctgttctcaaactcctggcttcaagtaaacctcccacctcaacctcccgaagtgttgggattataagcgtgagccacagcacctgtcctatctagtagatcttaaaactatttaggtcatagattgctttgcgaatctcatgagggaccctctcaccaaaaaaaaaaattacctgctcacaaaggtttccatatgatttagggggatattggatgcctgaggtctgtgatctgtttctaagcctcatcccagaggtgtggtgatgaggaccaacaaggtatatgcttgccggaggtcaagacagagagacaggaggggtgaaaagggcaaggctatcccgagacctgtttccatacatggtcgggcctctcaacttgaatggaaagtttaattttgcctctctatggtggtagaaatagtgtcagtgacatcaagtttttataaggggaaagcaccacagaggatcttggggtgctgggggctctgacagatgatgcatgagttatcaggattgtgtccacttcagaggggacaacatggtgagaaaagggggcaccagactaaggtggtccccgtgagcacgttctcgggaagtgtgagggtgggtaaatggtccctgtttcttgccttgcgttgaaggctttgctattccacatttccatttttttgaaaaagattattttaattttatttttttaacctgggttaaagatatgcatcttccacattttctctggtgctttagaattcgtttaatgaaatgagcttttctttcttttcttttttttttgtttttgtttttgtttttgagataaggtctcactctgtcacccaggctggagtgtaatggcacaatcacagctcactgcagcctcgacctcccagcctcaagcgatcctcctacccaagcctcccaagtagctgggactacaggtgtgcaccaccatgcccagctaattttttattttttgtagagacaaggtcttgccatgtagtgcaggctggtcttgaacttctgagctcaagcagtcctcccacgtaagcctcccaaagtgctgggattacagacctgaagccaccatgctgggccatcagctgttcttcagaacaattttttttcactctttttaaagaaattcttttttcatttagtcttccctgcatttcaaatagaatgatcttatgagaagggtcagtaggattatttaaagccgagagatgaggcagtgagctccgggaggtgttcatgcttcccttctccctctgtctgtcgggtcccaggactaaggatcctggctgtgggcaatctgcagggtggaagaacaatcctgtttcccctaacatgtctcgtcacagttcccaaggcccccgctaaggacgcgtggaatggggaggtgagatgggaggaactgaaacagccccatcctggtgttaggttccctgttgagtcacagtgtgtggaaaggatatcaaatgaaggagagattttctactgagatgaaaaggcacttaataaaatgacataacgcttcacagggagctgttttaatggctactcaaagcaactctgaaatgtctataatgagatcctaaaagcaagttctgaaatccccaattctcttctttctgatcttggatgctgtgatatcttccctagagatttactcttagatggaatgactgcatttcatggtagctctgtagccatgctaacttcatttgctgatggcagctttatcgctattgtttaaatcactctaaataggttttgtcagttaaagcaatgtaatatctttcctttcttacagcccagagagtagactcctgtaggaatattggaatattcagaatcactactcgcagagcagaacctcataatcctataaaactttgctctcatcaacccctcacactgctgacctaccttaaaccttaatgtcctgatttgcaaaatgaggataaccctacttcattagggttgttgaaagattaaacctgtaacaagcctggagagtcagtgcttactaaatgccctccattatgtctgtattagttgcccattgctgttgtccccaaacctaacagcttaaaacaacatgcactgattatgtcacgggttttgtgggtcaggaattgggcatggcttagtaggtcctcgggctgggggatctcttacaacactacaacaggtgttagctgggcctgcagtcatctcatgatggaaccggggcagggtctgctttcaggctcccttggtggttgtcaccaggatgcagttcctggtggcctgttgtatatgtgccctgaggcctctctcagttccctgccttgcgtcctcttcatgcatggcagcttgcaagagcaagcaggcaaaagggagagagggagtatgaaaaaagagggccgcaagcatctttcatttgtttatttatttatttatttaagacagagtcttgctctgttgcccaggctggagtgcagtggtgtgatcttggctcactgcaacctctgccttcgggttcaaacgattctcgtgcctcagcctcccaagtagctgggattacaggtgcacaccaccatgcctggctaatttttaatatttttagtagagatggggtttcaccatgttggccagggttgtctcaaactcctgagctcaggtgatccacctgcctcggcctcccaaagtgctaggattacacgtatgagccaccatgcccggccaccagtaccttttataacctcccccttggaagtgacatctgccacttttgctgcattccatttcttaggagcaagtcattgggtccagtccatatgggagtgaatactgggaggcggggattattgggagccattttagaagctgcctactgcaattgtcatgattcttcatccttttttgctagacatgcaactcaggaacagtaaagattgtcttgtaaaaaattgcagaatgtagcaataaaaaatccaaagtttggagcgtggtgccttgcttggtaagccaggttattccatatgatctgcgaatgctccctccaggaggtgggtgcctgtatcactcatcagtgacccatcttgcccagtgaggagctcacacatgtgttgcttgtgaagaaaggtggcaaaaagacaggtgcttccttggataggaagtatgatttaagtaagaaactgtggtaattattatttttttttacagttaaggccacattctctatttctgcttagctgcacagagtttgtacatcgggacaaactgctctctggaaatgccaagaagctgtggggctattataagaaaaacggaactgaaggagttatggaacttgctcttcttccccatttaaaagtcgtcttccttctttaactgatctgaagagtaggggaggaggagagagtggtggtgcgggcttccttaagagctgggctagaggagacatggagcctctggcactttggttttttgctcctgataacgtcagtggccctggctttcctagaactcagcaacaggagtttcctttgccaccagcagggtaggggagctgccaccattgaggccagaatgctcagtggctgaaagattgctgaacttgggaatccaccagataggccagctctgcgagaatgagagaaaaataaatttaacaatagcagaaagggacagtgtttttaaatattacaaatattttcttattaggaacagtttctttagggtggatgatgtcccggcaccgagaccatctgttctttttaaaccttcatctcagagtctgaaaagatctggaaagtgtcctggccgtaacatgtgtccttggacgagttgctttaatttcttcctttaaacttacgctaaggcctaatcaaacatgatcagagagatgaggagacagggcaactcaaatgaaaacctttcaacagacaatagaagcagacccacagagaatctaaggaatgagattatcagacatggactttaaaagatgaatgtttaatatgttcaaggaaataaaaatcaagatttaaaaattcatcaaggaatcgaaaactaggaaaggaataaaacgaaacatttataactgaaaactataataattgatattaggaaatgaataaatagggttatcatatatgatacatctgtagaaagaactggaagaaaatctccaaattcagagaaactcagagagatagaaaataaagaaaaaaattatatatatatatatatatatatggtgaaaaagtttaacgtaggcataattggagttccagtaggatagaagagacttaatggagcagaaacaatatctaatattgttagatcagataatagctgatacttttccataggaagtgcttagcttggtgcctagaactttttatattgttagtaaatgtcagcttttctcatcatcaatattattattttgctcatctttgctcctgtggaagatttacactgatggcagttttatgagagtccaaatccactaggccttttgttcaccaaagctcttacagtcctggagcttctgcttctactaaaggcctggagttggggtcacactggttgaaatctgatatgaaattagagtaagttttcctatggaaacaatgttgtcagtgaatgtgggtgtccactgtagagtgctgtagctcagcagcaagcttaggaaataatcattctttatttacagcatcagttcaatggaaaaacgcatattttagtttcacatgcgtagccaacaaatgctcacttggaactcagccatcagcaatccagttgatggagtggggattgcctgtacaattagttcggtcactgtcaccctaacctcctgcctttgattcctttgtaaagtttaagtctcatttgtaagtgtcctcactgcaggaatcaggacataatctttttatcccctgtccttgcatactgctgactgcacgtacggtgaatcagtggatgaattcgtgcatgcatttgtgcgtgcctcctggagagatggtttggctggtgaacagtgcactggatatggggaatgggaaatctgagtcttgactctgcccttactagttacaggcccactgggagaatccatgttttccttatgcgggaattgaggatgaagccatctctcctccccttgacaaagggctgctgtgaggaccaagtgagataagtgtgtgaacatgggtacacgggctcccatttgcaccatcgaatcatcttgtttttgtggcttccatgcccttcctttccgcttattttttcgtattctctggtaggatgttttacatctctcctggccatttttttgtatcttaaatgtggcaccttattctctgtatgtgggcttctgattctttcatggagggaactgtggacatttccaagctatgctcattaatgtccacggggcattaatctaaatgcttgagttcacttatgccatgtattagtttaaatttacttctgtaaggaatattttccctcatgaggtagatagataaaatgaagtctagtgactcagacccagtgcagaacccacctttttctttctttctttctttcttttttttttggagacagagtctcgctccattacccaggctggagtgcaatgccgatcttggctcacggcaacctacgcctcctgggctcaagcaattctcttgcctcagcctcccatgtagctggaattacaggctctcgccaccacgcctgtctgatttttgtatttttagtagagacagggttttgccatgttggccaggctggtcttgaactcctggcctcaaatgatctgacccccttggtctcccaaagtgctgggaattacaggtgcgagccaccacacccggctgcccagagctttttattgatactgtgttttccacaaataattttgtgttatggttttctcactacagtaacaggcctggagttgcattttcttgcattgctagctcagtttttcctagaacagagtgtgaagactgagatttactctgcttgagtgagatctgctctctctaccccaaaaggaatcttatagaatgggtggtaataacaacagcacaggatggacttgagtttgataatgttttctgcttttatggcaccttatttttggtagtggttactgtgtaaaaatcagacctttttctcttcagtgcataattgtccctctggtgaaaagtgcttgaggtacagaggaattatttcataccaccaacatagtatttagggcccagagcaaacaggcccagtaagtctgtaatctgataagccctggaatgggatccaggtgcaaagtacttccgatctctttgacacaaagggaggcctagacacagactcaagtgaggaaggaactggagctctcccgggagttcactggtagtttgaggagtgatgttcgttgttttaacctccagtctttggtccagccaactgatagaatacttcactttggggacccgagactcttgttgggtatataggattggggttttctgttgattgctttgtaacaaacctagtgtagggggccgggtgtagggggtgggggagagtgggtgggaggagtatattctcttccccttaggcaaagcttcaaaaaagtgctttgtgggttaatatggaatttgtgccatatttctgtggggtttctttgaaatcgaaaagggaaggtgcagtgcttcctggattgagcttcctgagcccgtttgtcttctgctctgagttgaccctggttttggggctgtagaaaggggaggagtagccatccagtaaccctggcctggattgctaaggccagggcccgggagctgggctctcactctttccagacagggctgaggcaccctcctgctccaagatgtggaggcgccttcctgcgtgacctcatctctgcatctgcgagctccatctgcccccggagtgggtgagccaggcaagcgtggcactgccctcattactatgcactgccttcgcttgcaggcatctccacacaaggacctgcctggcaggcggggtgggctgaggcgggcgggtggggtgtgtatgctggtgtcccaggtgcctgatgggacctttacttcttttggtcacctttggagtcagaacagtccaaactgttaaccatgcagacttctgcctgtttctctctttatgttatttctttatgcccacaaggtctgctgccctgtacaggcctcctgaattccctaacttaactccttgtcaatgctgaagatgctgaagacgttttagaagcatgtggctgggcgcatggctcacaccggtaatctcagcactttgggaggctgaggtggggatcgcttgaggccaggagtttgagaccagcctgggcaatatagtgagacctcatctctaccaaaataaaaataaaaaattagcctagcatggtggtgtgcacctgtagtcttagctacttgggagggtgagacaggaggatttcttgagcctggaaggagtaggttgcagtgagccgatgttgtgccactgtaatccagcctgggtgacagagtgagatcttgtctcaaaacaaacaaacaaaaccccaaaccaaaacaaacaaaaagaagtatgtaagccttaaagtctaaacattcaactaaatggatgactgaatacaaaaaataaatgcaaaaatccttctcatacagattatctctgattccaagaccagaaggagatgctggaattatcagtgatccccaatgggatgtcatgcacagagtcagttttgtagtgtacattataggcaaatcatattctctctctttctgaacattctgagaagaatgcactcaaggtttgaaagactatcatgtatgccataatttttgtgcttagttttttttcttatttaactacattctgaggaatggaatccctgagttgatgggtcttgttagtgttatttcctgtccataagaatcatgttgatttataatgttatcagcaatgtatatcccttaccagtttactcaaacacctcaccacctgaagatttctgaaagtctgcggagcagtgcttagtgagtttgtagtaaaggagtcagtaggagtatggtggatgtcgtgaagagagaccagagaggacagccttttcttctcagtgcccactttgatcgagtcacaattattccctgcagggctgggtcgaaaagattttaaggcccttttcacgttcaataagataatgtgtcttgaattgattactgatgtctgccatgagagcaggattaagtagtcgcgatctatttgcctgggaggtatcattcttttttaaaattattatttttattattattattacactttaagttctgggacacatgtgcagaacgtgcagatttgttacataggaatacacgtgccatggtggtttgctgcacccatcaatccgtcatctacattaggtatttctcctaatgctatccctcccctagccccctgccccctgacaggccccagtgtgtgatgctcccctccatgtgtccatgtgttctcattgttcaactcccatttatgagtgagaacatacagtgtttggttttctgttcctgtgttagtttgctgagaatgatggtttccagcttcatccgtgtccctgcaaaggacatgaactcatccttttttatggcttcatagtattccatggtgtacatgtgccacattttctttatcaagtctatcattgatgggcaagtctttgctattgtgaacagtgctgcaataaacatacgtgtgcatgtgtctttatagtagaatgatttataatcctttgtgtatataaccagtcatgggattgctggatcaaatggtatttctggctctagatccttgaggaattgccacactgtcttccacaatgtttgaacttacactcccaccaacagtgtaaaagcattcctatttctccacatcctcttcagcatctgttgtttcctgactttttaatgatcaccattctaactggtgtgagatggcatttcattgtggttttgatttgcatttctctaatgaccagtgacaatgaacttttttccatatgttttttggccacaaaaatgtctttttttgagaagtgtctgttcatatcctttgcccactttttgatggggtttttttttcttgtacgtttgtttaagttctttgtagattctggatattagccctttgtcagatggatagattgcaaaatttttctcccattctgtaagttgcctgttcactctgatgatagtttcttttgctgtgcagaagctctttagtttaattagctctcatttgtcaactttggcttttgttgccatcgcttttggtattttagtcatgaagtctttgcccatgcctatgtcctgaatggtattgcctaggtttcttctagggttttggggttttaggtcttaggtttaaatctttaatccatcttgagttaacttttgtataaggtgtaaggaaggggtccagtttcagttttctggatatggctagccagttttcccaacaccatttattaaatagggaatcctttccccattgcttgtttttcaaaggtttttcaaagatcagatgtttgtagatgtatggcattatttctggggcctctgttctgttccattggtctatatatctgttttcataccagtaccatgctgttttggttactgtagacttgtagtatagtttgaagtcaggtagcgtgatgcctccagctttgttccttttgcttaggattgtcttggctatacgggctctttttttgttccatatgaaattcaaagtaattttttctaattctgtgaagaaagtcattggtagcttgatggggatagcattgaatctataaattactttgggcagtatgaccattttcacgatattgattcttcctatccatgagcatggaatgttcttccatttgtatgtgtcctctcttatttcgttgagtggtggtttgtagttctctttgaagaggtccttcacatcccttgtaagttgtatttctaggcattttattctctttgcagcaattgtgaatgggagttcattcatgatttggctctctattattggtgtataaaaatgcttgtgatttttgcacattgattttgtatcctgagactttgctgaagttgcttatcagcttaaggagatttttgagctgagacaatggggttttctaaatatgcaatcatgtcatctgcaaacagagacaatttgacttcttcttttcctatttgaataccctttttttctttctcttgcctggttgccctggctagaatttccaatactatgctgaataggagtggtgagagagggcatccttgtgccggttttcaaagggaatgcttccagcttttgcccattcagtgtgatactggctgtgggtttgtcataagtagctcttattattttgagatacattccatcaatacctagtttattgagagtttttagcatgaagtcgtgttgaattttatcaaaggccttttctgcatctattgagataatcatgtcatgtagtttttgtgattggttttgtttatgtgatggattacgattattgatttgcatatgttgaaccagccttgcgtcccggggataaagccaacttgattgtggtggataagctttttgacatgctgctggattcagtttgccagtattttattgaggatttttgcgttggtgttcatcagggatatgggcctgaaattttctttttttgttgtgtctctgccaggttttggtatcaggatgatgctggcctcataaaatgagttagggaggagtccctcttttctattgtttggaatagtttcaaaaggaatgttagcagctcctccttgtagtgggaggtatcattcttaatctggagggataggaagcttgaaggccgttgcaggagtccaggaatgaatcaagtgttagtgcttggttttcacagattggtggtgcctagcgttttgtgtggcagcagccaaaactttgtggttcctgatttcataattatagatttacatgtgattaataagtgtgacaattcaaacagcaggggttgtcatttcagaataagtggttgttctcagagaggaatctcatatgagggatccatttcccaggaagtagatggaaccaattgctgggcatgagtacgtctctgatatcgactatacaaatgattatacaatgaaacactatctggcccacaggtagggttttactgtactttatttcaggttctggagtcagaatcgggtttattctaatgtctccccggcagtcaataatttgagcccctttcattactgttaaggctgcagcggctatcttcagagcctgtcaggctatgagtaacttgagctatgcaacgtgaaaccagaaagcactagtaaagtacttgtgagttctagaaatttgactttttttttttttttttttgagaaatttaggccagtgtggtgactcaagcctataaccccagcactttgggaggctgaggccggaggatcatttgagcctgggagtttgcgttagcctgccccacatagcaagaccttgtctctgcaaaaaaacccctaacatttaaaaatagcagggtgtggcggtgcacacctgtagtctcggctactggagaggctgaagcgagaggatcacttgagctcaggagttcgaggctgcagtgagctatgattgcaccactgcattccagcctgggtgacagagcaagaccctctctcttaaaaaaataaaggaaaaatgtacacttagcagggaagttgatttaacctagtgagagccttaagaggttttgactaggactcaaaagagtttggttctgactctaccaaccagctatgtgaccttgaggaagtcacactgtttcctctttaccaaaacgaggggactggacaagacggcctgtggtattctcagaatcttacgaaatggaataatatatacatagatgggtttccgtcagtgtggccctaaagacaggcctctctgatcctgtctctctcttccaaggctccttcttcacccagtaggcttcattctcttttctgagtcctacctctgtgtcttcacatgcgacagccactattaccctggcactttccttgtgtgtgtgtcacagccctagcgagtttcctgcggggaagggcattcccagcgcggagtgactccttagcctggctcctggcctgtcctcagcaaaccgcgggtagggtgtgcccctggtggccagccgaggaacagcagtcgcccctggaggtcgggaactgcatccacttgagcggtcccaagccacgggtcagagaggattcgatggtggtgttctttgcagaaatgtttccctttctgagacaaactaaaactttgtctatcctttcgtcctgttatttctttcctatcaagtgtgtaagaatgtacatttgacagtgcattctaaaagaggtgagagttaaaatgtttcaaaataaagagacagtgactttgttgtttgaaaaatcagtgcttatatctaaatttgagcagacttgctgctgtaactcttcagacaagttggcgttgacgcttgagccctttgtagaggatgatgagtaaagctgaacattgagcattgtcaagtgacttcttcccttttccgccttcaagggcgttttggggctggccttgcaggattgatttgttggctgctttgagacttgtgtccattgttttgagcacatcccttgggagagtaaatgatagattccaaaggggtgcttttcagaccagcgcccccaccgagaagatgcaccctcagccctgtgccccaggggcacgtgagggaactgagcaagcacctgcagcctaaggaggaaggccccggggcacacagaaaccaggcgaggtttgtcactgggtgatagggtaagcctgggtatcaaggaatgaaaaaaaggagcaaatcgaggagttgtctcctgagctcagaggggccacaggtggggcagccccatcaccactgtgtgctggtcctcctgccgtgtgcctggccctgcttaagaactcctggaggccagggagggtggaatggtatctccccgccaatggggtctagcctgctgttggcatgggaaagggagggtttggggaatgcctgttgggcgagtgaagaatgagtgaatgaacgattgaatggaatagccctgagaaggagaattcctaaactgtgatggagaaaggtagaaatgagcgtggtcggtgttggggagaggtccccaccctgcctccttggcagtttgtaggaatcagctggcctcatgaaagtgtgctgcctgctgtaaggggcaatttcctaatcttcaagggcagggcagggcaggctgtcacagttcctcagtgtccagtttcttgggggctacgtgggctacagtctggcaaggatttgctcctccacagggggtcttaagaacaactgagatgaaaagagttgtggtttgggggactgcgagggaacatgagccagaatccatacttgaggtgcagctcagaaatagcagcggcatcaattggcatctcaggagctgatgttttgattctgccgtcacctctttgaactctgtgcatcgatttgcacgatgcagataaacagcagctttggtgctgtgtttgttagggctcagggtcagtgcaggctgctctccttgggaggcgagaccttctggagaggggttttctgatgagtattaaaagccaagtcccctgttgccccaggtttgctggaattgtcccccaaacacagggctgagaaggagtaaaaataattcagattgccaactggtatttcaaatcccacttcatatttcagtgtctgaagaaaaccacatttctctgaatttcaacatttcatccttgatcttttggctttcaaatttatacctttaatgtaagagaactgaatcagctattttttcattctctcgataaatcacttgttcccgttttgtgtatagttttcagaacgcctccacgatccttccagtaggaacatgttggcaacggcgatcggtgttgataaagccttgggtcctgtgtcctctgcccttcctgcctgtctcagaacagcagccattaacaattgagggcagatgcttttttctactttcttctacttttggggcaacttcctgactttattttctaactcctccatgaaattttaatttctgccatcatatttttaatatatatattttttgagacagaatctcactctgtcacccaggctgagtgcagtggcacaatcatagctcactgcacccttgaattcccgggctcaagccatcttcctgcctcagcctcccaagtagctgggactacaggcccatgtcgccacacccggctaatttttacatttttttgtagagtcaggggtcttgctatgttgcccaggctggccttgaactcctggcctcaagtgttcatcctgctttggcctcccaaagtgctaggattactggtgtgagccactacacctagccatattttaaatttctaagaggttggttgtattctcaacgatcttttaaaataacatcctgctgttttgtgtgtgtgtgtgtgtggaggggagcatataaatgtcaggtatttcttagtgagtgattatattgaaaaagttaaaaatgtaagttgaaagctctgtttgtattggggcttgtcaactgctgcacacatggcctttggttaggggatcccaaatatcgggaactctagagctttttttctcctacctaaaggggagccttcactgcttctgtgtgggcttatccagcttagggtgaacagcacctggcccctcccttacctgtgcctgatgtccccaagcccagctccgtccgatgcaggcttcctggagagtaaagctctgaccctggttatgtggcctggggctccaagggtatgttgttgtgtggcctttcaactgatctgttttcagccctccattgcttgatgtttcctgaggttctgcggcatgaattgacttgcttctttattggcttctctccctgccagcagtttggtttcagcttcttcattctcagggaccgcttgtcctcctggattttgttgatatcacttgtctggtgttgtctcttctcctatctctttgactttgtgaatttgtgtcttttatttcttaaaccactttacaagggctttggaagggagtggatataaatgcgtgcattgaatttccagtgtgtaattggaccctcgtcataatcagctttaaagaattatttaagagagaaagaactgagacaagaccattatataattaagcaaaatttggaagttattacccaaccatcagattctacagagaaaatgctagaaacatagaaactagaattaataggtcttaaagggtgatgcctagagaaacagattacgtgtcttttgaatgcaaggttttgaacagaatgaattctgtttctgcccaaacaatgtggtatgttcacgtacttcttctctagagccctcccaagatttcagaatttctgaaaatacatccatagtgaacatgttcatttttggttaaatattgtatacatgtcagacatgtttctgaaactgatttttaccatacttcttttctttctgtgaaagcaatacaattttattatagaaaatattggtgagaaatagaagaaaatatccccccactccctctcccagtctcatcaaccagaaatagccagtcgtgtcctctggtaatctgtgaggtcagttaacctcacaacctgtgagttgccgcccttcatcttcacggttgtatcctcattctttcctaggacactggggttgggaaatcaagcatcgtgtgtcgatttgtccaggatcactttgaccacaacatcagccctactattgggtaagttcctgtatgtcgttctccttcgcgttgcttcctttcacggcatcagaatggccactctgtctgtgcctgagccttcaggcagggccacagttttcatcccagccagtgagaatcaatcccagctgtagaccgacagaaattcagggacttctgagtatgtgtccaggcttactgtccctgtcggtcatttttttttttcctagtcaaccttcctcatgctacctcctaaggtcatttccttgatctctgagagcattattctgcaaatcttggcgttatttccagttggaagacgatatgcagagcaaacccctgatagttctgctttaagttgcctgctaataaaccctgaaaatgccatccacccgtacctcagcactgtctgcaaagtctgtggagcagattgactttccttttctggaattatctttttttttacttcttgagactgagtgttgctctgtcacgttgcccaggctggagtgcagtggggtgatcttggctcactgcaacctccacctccagggtggattctcctgcctcagcctcctgagtagctgggattacaggtgtgcaccaccatgcctggctatttttttgtatttttagtagagatggggtttcaccatgttggtcaggctggtcttgaacttctgactgaaagcagtccacctgcctcagcttcccaaagtgttgagattacaggcatgggtcactgcgcccagccccttttctggaattatctaatgccagcatttccactgtcatgtgtggggaggggtggaagtgcattgttaaattctcctgagcttgggatgcaaaattgttttcctgttcatctcccctttccagtgggctccttggccgcgtgtgctttggctctgctgttcgggaagtgcctgctttttcattcttagaacgtggcctctgcttatttttcaccctgaagatatcaagtctttgtaggcaatgtatgtctttgtctgtatgttttgggaaacctgtaggattgttgagaatgggagagtgtatcagaagtggagaaaaatcatggcagggaataaatagatgctcaagagtacttggctgataggccagtagttggaactgtgtagctgagaaaacccacattctgtagattaaaaatgacttaaagaaacatactcatgaaaatatcaagaattaggaaaggtctgagattttaccctaattgcagcctgcaacttgttaacaagttagcagttgtgacttgttagcctgactcagtttcagggatgctggcagaagacagaagacccccgagtcacagacagaggcaatagcaatagccagagtattcacaaaatagggtgacattagagtcagacacctcacatgcagggggctgtgttacgggagcggaaccccaagctgagggaacgcaagtcttctacatggggcagtgagcacatctgtcctcagctacagagagagactctcccctccaaggatgcttgctgtgcaggttgagcatccctaatccaaaaacctgaaatccagaatgctcccaaatctgaaacttttgagtgccaacatgacgctcaaaggtaatactcaaaatgctcattgggatatttcagattttggaatttcagctttgggatgctcaactgggtaagtataatgcaattattgcaaaattaaaaaaaatatatatccaccggaagcggtggttcacgcctgtaattctagctctttgggaggcctaggtgggcagatcacatgaggtcaggagttcaagaccagcctggccaacacggtgaaaccccgtctctactaaaaatacaaaaattaaccagatgtggtggcacgcgcctatagtcccagctacttggaaggctgaggcaagagaaggtggtggttgcagtgagctgagattgtatcactgtactccagcctgggcaacagagcgagacttcatctcaaataagtaaatagataaataaataaatccaaaattcaaaatacttctggtaccaaacattttggataagggatactcaacatgtacaagcatccttgaaaacacaatccggaaaaaagtgtttacttgcaagatgtgcacgttgtgagagaccataaagaattgtctcccaacataggcgcgcttgtatgataggtatactttttatggaagaaattggtttcactctgctctgaatgtacttttttctctctctctcttatttttcactttgtgtgtgtgtgtatgtgttttaataataaaaagcagaactgataagagtgattaactgtgaagtatggttccagaagatggaggagagatttgtgccttctactttctaaacttttgtttaaaaatttttttaaaataaaatctttttgtaatgaccttttttttttttttttttgagacggcgtcttgctctgtcgcccatgctagagtgcaatggtgtgatcttggctcactgcaacctccgcctcccgggttcaagcgattctcctgcctcagcctcctgagtagctgggattacaggtgcccgccaccatgcccagctaatttttatacttttaatagagatggggtttcaccatgttggccaggatggtctcaatctcttgaccttgtgatctgcccacctcagcctcccaaagtgctgggattacaggcgtgagccactgcacccggcctgtaatgaccttttttaaagtaaaaagacagtgcatactcataccacaaattatgggcagtacataaaaatgacaagcgtaagtgttaagcataggtataggcatcgtaaatagggtagttacgtaattttggtcacaatctcttggtcaaagaaagttgctgtgccagcccagattaaagggggagacacaggctgccttgtggtgggaggagccgtgtgtgcatggagggagggtcggggatggattgctgctaccattttggagacaaacacagttgacagtgttttgtctagtaaatgcatttcggtggtttggagttttaaaaaacttatgtattacaattgacccttgaacaactcggggattaagggtgctgagccccgagtggttgaaaaaccacctataactttttgtttttttgagacggtacttggctcaaaagtcttgctctgtcacctaggctggagtgcagtggcaaggtctcagctcactgcaacctccgcctcctgagttcaagcgattctcctgcctcagcctcccaagtagctgggattacaggtgcacgccaccatgcccagctaatttttgtatttttagtaggaacggggtttcaccatgttggccaggctggtcttgaactcctgacctcaggtgatccaccccccttggcctcccaaagtgctgggattataggcgtgagccactgtgcccagccacacatataacttttgactccctcagaatttacctgctaatacctgaccattgacctgaagccttatggagaacatagtcaattcacaaatattttgtaagtgatgtgtattatatactgtattcttacaataaagtaagctagataaaagaaaatattactaagaaaatcataaggaagcgaaaatatatttactattcattaagtggaaatggaccatcataaaggtcttcatcctcattgtcttcacattgagtaggctgaggaggagcaggaagaggaggggttggttttgctgtcttgagcgtgggagaggcagaagggatcgaattagaagtgggcccatgacattcaaacccatgttcaagggtcaacggtctatggaaactctctgcactttcttctcagtttttcctgtaaactaaaagtgctctaaaaaactgttattagtttaaaaattatgtcttagtttttaaaattatgaaaaaatttatactatgtagaaatatataaaataaaaagtgaagtcagaggattttgctagctcttcaatcccgtattcttcaatttacataaccaatatttagagtccaaagtgcatgttaaacatatttcttataagtactttctgtggacatgcaggtatacaagctaaaaatgaaaacgtatcacactttacctaacaagccacaacatacattcccagtccacttaggtcctccttattctttttcactgctggttgccagcctctgggaaactgagtcaggctgccaagtgatgactgttaacttgttattaagttgcaggctgcaattagggtataatacaagtatgccccgtgcaatatttgggacatgtgtatactaaaaatttattagttctttatctgaaattcaaattgaactggcatcctgtatttgtgtttgctgaaggtcacaacccttacctcacccctcctttgggcttaagccaagctggttgggtttccgagtcttgcaaccaaagggacctcaatagaagcaggcagttgtgcaatagggcttacacaggtgactcaactttaattgtgacacagacaagattaaagtctaattgttttgattataaaagttcatgttcgactgggcgtggtggctcctgcctataatcccagcactgtgggaggctgaggcaggtggaacatttgagcccaggagtttgagactagcctgggcaacagggcgaaacttggtctctacaaaaaaatacaaaaattaactgggtgtagtggcatgtgcctggagtcctagctacttgggaggctgaggtaggaggatcacctgagacctggaggttgaggctgcagtgagccatgattgtgccactctactccagccagggcaacagagtgaaatactgttccaaaaaaaaaaaaaaaagttcatgttcactctaaaaaaaacccaaagaacacagaattcatgaaactaggaatcttagtgtacatacagtttttttttactctgtgttttctacttaatatattttgaacattttttacagtgtcacataatcttcaaaaacatgttgaaagtattttttctgattataaaagtattatatactcatcataaacaactgaaaatgaaaaaaacatgaggaaaaatattttaaaaacccataatctacctcttagaggtaattactgtaaacattttgttattttcttccagcccttttcttgtataagtgtgtgtatgcgttatttattcaacatcattttgtgaatttcatgccattaaatagtctttaaaaacaatttttaatggttgtatttttcacttcaggcatttaggttgtttaaacacttttgtacttttataaataatgttatgaggctagacacggtggctcacgcctgtaatcccagcactttgggaggccaaggcaaatggatcacctgaagtcgggagttcaagaccagcctggccaacatggtgaaaccccatctctactaaaaatgcaaaattagccaggcatggtggtgcacgcctgtaatcccagctaccttgggaggctgaggtaggagaatcgcttgaacccgggaggcaaaggttgcagtgagacgagattgtgccactgcactctagcctgggtgacagacagagtgagactcttgtctcaaaaaacaaaacaaaacaaaacaaaacaaaacaaaacataaataaataatgttatgatgtacctcgttgggcatagatacccatgtatactgctgattatttctttaggttaaactcttagcaatggaataatttagtccaagaataaaaatctatttaaggctctcaatggatattaccaaattgtttttcggaaaggttatctctgtaccagctttaggtattttttttttgtacaatttttaactttataaaattgtaaaagtttgtatgattttgaattctattcttttcctctaacttcaaatgttcgcattttctcatagcttaatgtttctttgttaaaacaattttacatgatggcagcatggtattgtgtgctgttcttttttctttttttttatttgagacagagtcttctctgttgcccatgctggagcacagtgacgcgatcttggctcactgcaacctttacctcccaggttcaagcaattctcatgcctcagcctcccaagtagctgggattacaggcactcgcctccacgcctggctgatgtatttttagtagagacagggtttcaccatgttggccaggctggtctcgagctccttacctcagctgatctgcccgccttggcctcccaaaggagtttataggcgtgagccaccgcgcccagccctgttcgctttctacctcgtcccttgcttttcctctggagtcaatgttaggctcagcccctccacccttatgtattgtcttcttgatataatttaacttcttgatttaaaaattgatgaaaattttccctctggaattttgagaaaatgttttcaaacaccagttgcagaaaaataaagctagtgggaacactttctaagtgacacatgcagttttcctggaaggtggcataaatggaacacttttaaaacgtttgagtgctttcccaaaagctggtaggttcggtgggctgaggaactggcttatattaatatatttgttttgttcagccttcacagtgctgtaaagactttaagccaatagagaatcaggagactggcacgtaataaacttgcattcctggtttctcttgaaaaatcagtgggtttggagccctggtgcccattcccatgtggtgggagccagccggtgccactccgcatgggtggccaggcctcccggcttcatgccattcccgctaggtattgttactattatgttcatcagtataaacgttcacacctagcctgcttcactcatttatatgtcctgcctggtccctagacatttcagttcctggccctggcactgccttcttggcggtaaccctgctggccacccccaggcccagggcggttaggggacttgcctaggtgcacacagcccgtgagcagcccactcatggctcacaccagtgagtccactctcaaagcccacccttgttcttcccactggaatcacacgaccattggtacaatgccatgggctgtaaaatgccattgcttcagcattaaaagagttaattcttatggcctctctgactcacactgaaaaaccttggctctgctattcaagcagattgcattaacatcttgagtgtgtgtgtatgtgtgtgtctccctttttatttcaacttttgtaaggaaattgtgtaacttctctgccagattttggtttccacagataatgaagtcagtttatcagggccagtgcgcctcctccaccagtttggagggtaatctacacagaagaaaagatgcctgaggttcttatttgtttatttgtttgagacaggatcttgctctgtcacccaggctggagtgcagtggcgcaatcatggctcactgcagcctccacctcccaggctcaagtgatcctcccaccttagcctcctgaatagctgggaccacaggtgtgagccaccacacctggctgtttttaaatttttgtttttaattaaatctttttatttttgtggagatgaggtctcactgtgttgttgcctaggctggatgaggttcttaagatcaaaagctagcaaagacttaaaaaccaacaacaaatctcagtcaacaaaaaaaagcaatgattgtcgtggtcctcatttcaaatactgagagtctttctcctagtggcgagagatcaggaacacagagggatatgtgtgtgtgtgaggtgtgccttcctactattactaaagttgctcctcacagctcactgtgaaccaaggggaatttcgcaggtatccatttccctatatgtccctacaaacaccttctattcaatgcagagtaggtattggccccatttcacagaacaggaaaccaaagggctttacgggctggttcattgagtctggcagtgagggcctctgcttcctcttcctggttaggccactgcactcttctttcaccaggaaccaggcagtcttctgggattttggttccccccccttacctgcactgtggaggggttggactggatattttatattttttccaagattttaaaggcatgaactttgttttctaaccctgaggagaactttttaagggtagtagggttgctgtattatttatcgcagcacctagaatatactgaagaataaatgaaaatctgactaacatcaaaagtgaaaacaaaaacaaaattttgatagagttgtctaataaaatttttaaatgagtttatggaaaaaatctagaacaaagttaaagggcaaatgttaaactggaaaaatattatttaaaatgtactactacaaaagtttagtggaaaatagtcaaaaaatgaataagaaaaggatgaataccacagttgaaaggtgggccaaggtcatgaacttgagaaaaattcctttacaaagaaaaatgcaagcgaacaataaatgttaaaatgatgtttaagcttgtgataagcataatgaatataagaataagatattttctacctaacacattgaaagagatttgaaagattaataatggtgaggaaaaggccatctcatacaccattatggacatgtaggttggtaccaactaagtttggcacatgtagcaaaagtggagtgtatctatttttgttttatttgcttatttatgtatttttatacatttatatatttttagagacagagcattgctgtgtcacccaagctggagtgcagtggcacaatcatggctcactgtacccttgacctcctgggctcaagggatcctcctgcatcagcttcctgagtagctgggactacatgcaaaagccactgtgcctggctgatttttttttttttcttttgtagagccaggggtcttgctatgttgccaaggctggtcttgaactcctggcctcaagtgatcctgccaccttggcctcccaaagtgctgggattacaggtgtcagccaccatgctcggctctactttttaaaaattaagtctaaggatatagttgtacagggacacaaagatgtaattataaggatattcactgaatcattgtcgtaatagtgaacaatagataaccaaaatgtccatcgttagggtattgaataattccataacatgatgtatgatcttcagtcattttagatgatattgatgtatattcatagaaatggaaagattttaggtgatttttttttttttttgagacagagtcttgctctgtcacccaggctggagtatagtggtgtgatctcagctcacagcaacctctgactcctaggctcaagtgattctcctgcctcagtccccgacgtagctgggattacaggcacacaccaccacacctggctaatttttgtatttatagtagagacgtggttttgccatgttggccaggctggtttcgaactcctgacctcaagtgatccgcccccatcaacctcccaaagtgctgggattacaggtgtgagccactgcgcccagccaattttagatgatattgatctatattcatagaaaaggaaagatttccaggatatataaagttgaggaaaagcaaaatttagatagagtatgatcaattttcagagcaaaagttatgttaaaatagagcgtcctgcaaactcggaagcagatcacaaggggtggtcacactgcagtgtgattgacataaagaccgatgttacttgggaagaagcctggaagaggaggaagaggaaagaaaaagagtcgagaacagctcttactcagggatgctggactttcagggatgtggctataaaattctttgaggatgagtgggaatgcttggaccctgcacagcatcctctatacagggacctgatgttggagagctacaggaacctggtctccatggcaggaaattctcttcctaacctgagtattatcttcttggtggagcaagggaaagaccactggacagtggagagtcaagtgaaaatagcaagaaagccaaaagagtgagaacgtatcaaaggtgtgatcagactggtgctgcagctcaaacagaaacacatgcaaagatcttatcatggtggacagctttcatctggtagggtgtcatgatatatatgtcatatttgcatatatataggttttcacttacagttcctggctcctaactcccaaacccttgttataatcttggggcactttaggcctcagaaaacagaatcactatctgaccttctcctgtcctccttttacctgcccaaggcaggactctaatctgatcgcaggtcattccagagagagtcctgccccatcttctagaggaaggatgctactcagagaggccaagaagaacctgaacacacaggccttgctgggttttgatcatgcactttttgtccaatcacatttttacaagattgttaagaatgcctgtgtaggtcgggcacagtggctcacgcctgtaatcccatcactttgggaggccgaggtgggtggatcatctgaagtcaggggtttgaggccagcctgaccaacgtggtgaaaccccttctctactaaaattacaaaaattagccaggtgtggtggtgcatccctgtaatcccagctactcaggaggctgaggcaggagaatcgcttgaacccagttgcagtgagctgagatcatgcgactgcactctagcgtgggcgacagagtcagactctgaaagaaagaaagagagaaagagaaagagagtaacagagaagagaaagaaaagagaatgcctatgtaatgaagcctctgtcaaaaaaaggaaaggaaagaaagaaagaaagaaggaaagaaaagaaaaggaaagaaagaaaagagaatgcctatgtaatgaagcctccataaaaacttaaaagaaaagtgttcagggcacttctggagagctgagtttcctggaaagtggcgcccagggagggcatggcagctctgtgcccctgtctgcttaccttgccctaagcgtctcttcatctgtatgctttgcagtatcctttatgagaaactggtcactataagtaagtgtttccttggtttctgtaagccgctgtagcaaattaatcaaactcaaagaggggttggtgggaaccccaacctgaagcctgtcgatcagaagttctagaggcccggacttgggactggtgtctgtggaggagcactcttgggtactgagccctcaacctgtgggatctgacagtatctccagggagagagtgtcagaattgaattggaggacacctagctggtatctgctgctggtggtgggagaaccccccacagatttggtcatagaggttctcttctgtgttgatggttgtggtgtgagaacagaggaaaaacatggttctagagagttatctcctacacatctggcttctggcaactctgcttccttctctcggagggatatctttcctgtatatgcaatcaaggaattatctgccaaagagaaaagtaatacaggagaaatattccacacagtgtcattggaaagacgtgaagccatgacgttgaagacttgcttcagggaaatccagaaaaatagaaactactttgagtctcagtggagaagtgatgaaagcagttacaagagtgcctcaaaaaaaatctcactgttagaagagaccaacatgatagaagggatgcaggcaacaagcctattaaaaatcagcttggattaagctttcagtcatatctgcctgaactacagctatttcaagctaaagggaaaatttatgaatgtcgtcaagttgaaaagtctgtcagcaatggttcctcagtttcaccaccccaaagaattccttctaagcccaaatccatatttctaacaagtatgggacttacttaatctattcttccttacacaagaacagaaagcacacattagggaaaaaccttacaaatgaaatgagtgtggcaaaacctttaatcatgactcactctatgctgtatattagataatccatcccagagagaaatgacataaatgtgatttatgtagcagggttattagtcaaaaataaaaccttgcacatcattggagagagtttatactggagagaaactctacaaatgtaatgaatgtgacaaggttttcggtcacaattcacaacttgcaagacattggagaattcacactggagaagacccttacaagtgtaatgagtgtggcaaagccttcagtgtgcagtcagcacttaccatcaggtggtccatactggagagaagccttccaaatgaaatgagtgtggcaaggtcttcatgcacaattcacttctcccacaacatccaataattcgttcttgggagaatccttacaaatgcaatgattatggcaaacccttcatcgtgagttcaagcattaattgacatcagagagtccatactaaagaaaaatcatagaaccgtaatgtatgtaggagaggctttatccacatttcacactcacaagacatcgaaataagcatttttgatgaaaccacagaaatgtaatgtgcctgctgaggctgtcgcccaaagatcgaaactgtagaccatcagaggagtcagatgaggaatgactcagtctttagttctccaagattaactttcgacatttcatactgcagaacaattacaagtcaaaatatgttaaaactcatgacatgatatctatcaaaggtaccaggatgttgggcagtggccagttaacttcaggttatgaaatattttattcaattatttgaagattcttgaaaaggctactttactatttatgactttcaacttgaactttgaaataaaagggacgaaaatccagaatatacaagcaactcaaacaactcaacagcaaagaaaacccaaataaaatgatttaaattgggcaaggaatctgagtagacatctctaaaaagaagacatacagatggccaacaagtttgtggaaaaatgctcaacatcactatcatcagggaaatgcaaattaaaaaccacaggaagatatcatctctctccagttagaatggctatcatcaaaaatacaaaaaataacaagtgctggcaagggtgaagagaaaagggaattcttgtattctgttggtaaattaagcactgtgtacattagtacagacattatggaagacagtatggaggtttctcaacaaagctaaaaatagaactgccatacaatccagcagttctactactgggtatttatgcaaaggagagtgaatcactatatcaaagggatacctgcactcacagatttattgctgcactatccacaacagccaagctatgaaatcaacccaagtgtccatcatccatcaacaaatgaatggaggctggcgtggtggctcacacctgtaatcccagcactttgggaggccaaggagggtggatcacctgaggtcaggagtttgagaccagcctggccaacatggtgaaaccccatctctactaaagtaaattacaaaaattagctgggcatggtggcacatgcctgtaatcccagctacttgggaggctggggcaggagaatcgcatgaacctgggatatagaggttgcagtgagctgagactgtgccactgcactccagcctggttggcagagtaagaccccatctcaaaaaaacaaaacaaagcaaaaatgaattaatggataaagaaaatgtggtatatatacacactggaatactattcagccataaaaaagaatgaaatcctgtcattcatggcaacatggatgaacctggaggacatttcgttaagtgaaataatccagacacagaaggataaatactacatgttctcactcatatgcaagagctgaaaaaaaagagctcatagaagtagagtagaattgtagttattagaagctgggaagggttgggggagggaaggatagggagagcttggttaacagttacaaagttatagctagacgggaggaaaatattctagtgttctgtagcactgtaggatgaataaggctaacaataatttagtgtatattttcgaaaagcttgaagagaggattttgggtgttcacaacaccaagaaatgataaatgttcaaggtgatgaatatgccaattaccctgatttgatcattacacattgcatacatgtatgtacatatcactctgtatcccataagatgcataattattgtgtaccggctaaaaataaaaggaaacaaagaactgaatgaataatcccattttaaaagtcatataaaaataattgggaaggacatataccaatttattagcagtgactatggctgggtggtgaaatatgattggtttttattttctttctggttttttgaattttttttatgaaatacatatgttgcttttaaaatgggaaaagtaataaagacattaacatttttggaatatattaggtctccccggtagtctggatatacattttaaacacttttaaagaaataaaggaatagatgtggttttgatactactggatttgtcacttagaatacttagaattttcatttattgcaattgtaggttggtaattagaactctctaactattattagcctttggtttttgtggggatagtgtgggaattgcagtagacttttctacttgggacttcggtagttggcctcttattcttagaagatttagaggctgaggaaatattactatgatgaatgctagttgaccaggctggactatatgaaagtaaggtgaagaacccctgactctttaccccgaaaaccccagggtccatctcctaataagaacataatgaggacaccatgatcatacctacaaaattaatttgaatcagtgataatatcttgcatatagtgtgaatttaaaattttaaagttgttcttaaaatatctttttgtgggggtagggggtacagggtctcgctctgtcacctagactgcagtgcactggggcaatcttggcgcttcactaccagcctcagactcctgggttcaagctgtccttctgcctcagtcttctgagctgccagaactacaggctgtgccataatgctcagctgatttaaaaaaaaaaatttttttttttgtaaagaaggagtcttgctctgttgcccaagctggtctcgaaaccctggcctcaagccatcctcctgcttcagcttcccaaagggctaggattacagaaaaaagagccaccacacctgaccaaatatattttaaagctgttttccccctaatctgggatccagccaaggttcatatattgcattttgttgttttatctctttcctctcaatctagattctagaataatctccctgtatttttctggtttgcttctcatgacattgacttatttgaagcattcaggccagcttgtcttacagaatgtttcacattctacatttgcctcattgttttcttacaattaaattcagactaaacatttgtggccagaatgctatataggtgatgtatctacttcttattccatcacttcaggaggctctcataccaggttgtcccactactggggatgcttgctattttttaatgaatagaaaactttctgtcataaaagtcaaggctattgaacattcctggtatttttatactgttcatgagcacaaagaaaatgctttttaaaaggaaatatgcaaaaaagaaaatagtaagtgtttaatgatctactgaggctttaaaatcctttctttttggacttagaagggaggaaaaaaaatccttccttttttatagagaaaacataagtatgtgttaagctgccaatcttcgtccttgcatttatgcaagcaggttgggacttagatgtagtattctattagttgctactagtgttggtttcatattagcatagtaaatatgtaagacaactttttctttatgccattgtaagaccaaaaacattacatgccaacataccagctgctattttcactcttaattattgtaataagtttttaaaatccaaggttgtattctttcctgagatctgggggtattttaataattgaagctaactggttttagaaacacagtccttttttttttttttttttttttttttgagacggagtcttgctctgtcactcaggctagagtgcagtggtgcgattttggctcactgcagcctctgcctcccgggttcaagtgattctcctgccgcagcctcccaagtagctgggactacaggcacccgccaccatgcccggctaatttttgttttatttttattttattttattatcatatacatattttttgagatgaagtctcatactgtcacctgggctggagtaccatggtgccatcttggctcactgcaacctctgcctcctggtttcaagcaattctcctgccttagcctcccaagtagctgggaccgcaggtgcctgccaccacgccgccaccaggcctggctaattttttgtatttttagtagagacagggtttcaccatattggccaggctggtcttgaactcctgaccttgtaatctgctcaccttggcctcccaaagtgccgggattacggcatgaaccaccgcgcctggccagaaacagtcttttgaatgcctcctttgttttgttttgttttgtttcaaaacccccagttgaactaacagaaaatgagaaatattttattttgggtgtcatgagtcttctagcccttttctcgtcttagtggttcccaaggaccagggctttttggggtcctgctgaggtgtagcatttaacttgtttgatttgtgaatctttgtgaagaaacaatgcagtaatgtggagatgctgactctcttttttcagggcatcttttatgaccaaaactgtgccttgtggaaatgaacttcacaagttcctcatctgggacactgctggtcaggaacgggtgagtatatgctgttttttggtgaaaacaagatccagtgaaaataagatcagtttctgaaggtttgtttgcattagacaagactcttggttgcaggtgacagaaacctagcttgaaatgatgtaagcaaaaagaaaatgtactcattagctatgtgaaaagtctaagtgggtacctagggtgaggcggggctgagttcaggtccccaaatgtgttgtgagaggagcccatctctcttatttctgtttctttccatttagtgcagttgtggttgcactctcgatttggttcatttttaggcagactcaccctccctccttacctcaagggtggtaaccatggccccaaaagcatctctacacctaccttcagcctttttagcaactactgggtgagcatgcacctcttctgcaagtgggaacatacatcttagtgcctctgagttctcactggcctgccttaggccccatgcccactcctgaacttcaggtggtaccttgttcttgggggtttggtgcccctactggtgggatctggcagtacactgacccctagaggcaagggccggtgtcagccccacctgaaccatgttggttcaggaagtcaggtaggcttagcgccccaaggaaaatctgaggtctcttactggaaaagtgggtaaatggatgctgggttatcaaaacagtggatgacttctcttttactcctaattctctttatttgctgaaaatacttatggagaagactatatattttagaaggtcatgcctttagattcaaaaaagggaaatgacgaatactagcacagtgtctattgctggatacttgcataataactagagcgtatattataaaagttgctgtgtcttgctgtgtctcccaggctggagtgcagtggcacaattatggctcactgcacccttgacctcctgggctcaagagaccctcctgcctcagcttcctgagtagctgggactacaggcacaagccactgcacctggctgattttttttttttcttttgtagagcctggggtctcgctatgttgcccaagctggtcttgaactcctggcctcaagtaatcctcccaccttggcctcccgaagtgctgggattgcaggtgtcagtcataatataaaagttgaggccggacgcggtggctcacgcctgtaatcccaacactttgggaggccgaggcgggcggatcatgaggtcaggaaattgagaccatcctggctaacacagtgaaaccctgtctctactaaaaatacaaaaaattagccaggtgtggtggtgggcatctgtagtcccagctactcgggaggctgaggcaggagaatggcgtgaacccaggaggcggaggttgcagtgagccgagatcatgccactgcactgcagcctgggcgacagagtgagactccagctcaaaaaaaaaaaaagttgaaacggatagccagatagccaagcagagataaccaataccttgtcttagccaagagctgttagcttgattgaaattatcagagttgatgactatggagtaaaattggtagaattttcccttgtctgatccaaactcaaatgtcaccttctctacctccttgtttaaaatgtcaccacctcattttcttgccctactccactcacttcctgcttcatttttctccacagttattatcatcttccaatatattatttaattcactttattttgagacagggtcttgctctgtcacccaggctggagtgcagtggtgcaatcacagctcacctcagcctcccgagtagcagggaccacaggtgctcaccaccactctggggtaatttttaaattttttttgtagagacgaggtcttgctatgttgcccaggctggtcttgaactcctgggctcaagcagtcctcctgccttggccttccaaagtgctggaattacaggtgtgagctaccatgtggggccttaattcaattattgatctgtttattgtctttctaaaaggaagaatccaggattcaggataatctataattttcattatcatctcctaactaatcaagtggtaatttatataattttcattttacctaaattcccttttaaaacaaaagttcccatatttgtagattaaaacattttaaaaacactgctgaaagaaatcatagacatagacacaaacaaatggaaacacatcctatgctcatggatgggtagaatcaatattgtgaaaatgaccatactgccaaaagcaatctacaaattcaatgcaattcccatcaaaataacaccatcatttcattcaggctgggcaccgtggctcatgcctgcaatcccagcactttgggaggctgagatgagtggatcatgaggtcaggagttcgagaccagcctggccaatatggtaaaaccttgtctctactaaaaatacaaaaattagtcaggcgtggtggcacatacctgtagtcccaactacttgggaggctgaggcagaagaatcacttgaacccgggaggcggaggttgcagtgagctgagatcatgctactgcactccagcctgggtgacagagagagagtctgtctcaaaaaaacaaaaaacaaaaaaacaaaaaacaaaaaaagcaactaccatcattcttcacagaactagaaaaaaacaatcctaaaattcatatggaaccaaaaaagagcctccatagccaaagcaagactaagcaaaaagaacaaatctggaggcatcacattacccgacctcaaactatactataagggcatagtcatcaaaacagcatggtactggtataaaaataggcatgtagaccaatggaacagaataaagaacccacaaataagccaaatacttacagtcaactgatctttgacaaaacaaacaaaaacataaagtgggaaatggacatcctattcaacaaatggtgctgggataattggcaatccacatgtaggagaatgaaactggattctcatctctcaccctatacaaaaatcaatgcaagatggatcaaagacttaaatctaagacctgaagccataaaattctagaagataacattggagaagcccttcaagacattgacttaggcaaaggaatcatgaccaaaaacccaaaagcaaatgcaacaaagaaaaagataaatagacttaattaaactaaaaagcttctgcacagcaaaagaaacaatctgcagagtaaacagacaatccacagagtgggagaaaatcttcacaatccatacatctgacaaaggactaatatccagatctacatggaactcaacaaaatcagcaagaacaaaacaaacaatcccatcaaaatgtggtataaggacatgaatagacacttctcagaagaatttatacaaatggccaatgatcatgaaaaaatgctcaacatcactaattatcagggaaatgaaaatcaaaaccacaatatgatacggccttactcttgcaagaacgactataatcaaaaaatcaaaatataatagatgttggcgtggatgtggtgaaaagggaacagttttacactcttgatgggattgtaaactagtataaccactgtggaaaacagtatggagattccttaaagaactaaaagtagatctaccatttgattcagcaaccccactcctgcgtatcaacccagaggaagtcattacacagaaaagatacttgcacacgcatgtttattgcagcacaatttgcagttgtaaaaatatggaaccagcccaaatgcccatgaatcaatgagtggataaagaaaatgtggtatatatatacaccatacaatactactgaatactactcagccataaaaaggaactaaataatgacattccagcaaactggatgcaattggagaccattattctaaatgaagtaacatactaaacatcgtatgttatcattcataagtgggagctaagctatgaggacacagtggcataagaatgatacaatggacttcggtgacttgcaggaaagggtgggagtgggggtgagcaataaaaactacacactgggtacagtgtacactgcttgggtgatgggtgcaccaaaatctcagaaatgaccactagagaatttactcttgtaagcaaacaccacccattccccaaaaacctactgaaatttaaaaaataataataaaataaagctaaaagaagcatgctaaaatatagctaaaatatgcacctaatcttaatctaaaattgtagatgtggaattgctagttcagagtctctgatacatactgtaaaatccacctgttatttggacccagtgtttcactgttatgtactttcacttttacccaaattaagtattatattaaaatgagaaagaaaaaataatcctttaaaaatatatatttgctttctaatgactttaaacttctttcgtattttttagctatttcatttctgatcttaataattgaatgattatagctttacccacttttttcttgagtaatttgtaagaatctcttaacattaaattatacataatgtctccatttgttatttatattttaatttctattttaggtttctaatggtcaaacttgttttttagggttaaatcaataatcctgtcttttatgaattctgctttagaatacatgctttaaaagaccttcagaatgctaaagtaaatattaattaaagttatattaaatatttaaataaaacacattttcttaaaaatacattttaaacagttttaagaaataaattaggatgaatattctggcctacaaatgctaacctcattagaaagtcttctatttttctgctaaattgagaacacagacttctgtgcacgggaagcagctgcctggggcacctctttaactccatcagctgtgcctgcctagtcctcaaatgaggtgacccattcaaggaaaaatgtctacttagagacctcacttcttgatatacgtgtgtgttacttgtagttgatctgctggttttttgtttgtattgttatgtaaacttaaacagagagagtttcttgattctctttttacctctggctatgaaatagttgcttttgcagctgcctttaatgaacacaataagtcaattttgcgaatcgctggcttaatgtcagcgatgcttctgcttctcctgctggcggacgttccctgatgacttgctgtgttccatgtactgttctgagtgcctgtgtgtactgatgcattcagccctcctcgcaaaagcactttgaggttgaaactgtcgttattcccatttgcaggtgaggtcactgagacagagacattaagtaacttgcacaatgtcgcagagctaataaggtgtaaagctgaaaattgaatccagcagtctgggtcctgagctttgtagttttattttgattgaaaaatcacacaaaaaaccatacggttgaaagtaaaactatccaaactcccactacccagatatttccactatggatattagatgatcgttcttcagatatctctacgtgattgataattttatatcaatgggattgtgattctttataacctgctgttttcatttgatattacagtgtcacaaaggaaagatttctgtgtgatcaaaacagaatgtttaacacttacctctaacaggctattcaaggaatagtcttttgatgaaacttgaaatctgcgaaaatgactattgtagtttgtagtttgttccacttaccatcgcaaagaaaaataccagtgggaagttttcagatgaccatatttctaattattgtgattgcttttcctaaaatttgacttttagaggttgtagacatctgactccattgatacatccataattttaaagaaatcactagcattatacatgcaaggcatgactccacagtagggatattctttctttatacttcgaggaagacggatttagtttgggataacgatttcaaagtgaacatttttagagtctagatttgtggagagtgtgtgactgatatccatgtggctatgtggtcacctgatctccccagccctcgacggcctgatttcattatccttgggctgtccttgtctggtgtcccctggtggagtcttgcatctctccagtaatggcaatttttcaattgttttggcagcttgttgctggctttaattgtgcttgtaatgatgttgcctaatgtttgagctaaaaataaattccctgctgttgcttgtgcctattgctatttgttctgtctcattaattattggagtcccgtgaattttattacccctctttatcatcatagaaatgttattgttcttttagttttcataattttaaacaaacaatcactttgggtttatgatttgacaatataaagacagatttctttttttctttcttattttattttattttatctttttaagacaaggtcacactctgtcagccaggctggagtgcagtgatgcaatcatagctcactgcaacctcaaactcccaggcctggtcaatcctcctgctccagcctcctgagtagctgagactaccagtgtatgccaccatgcgcagctaatttaaaaaaaaaaaaaaaaattgggccagacacagttgctcacgcctgtaatcccagcactttgggaggccgaggcgggcagatcacgaggtcaggagtacgagaccagcctggccaacatggtgaaaccccgtttctactaaaaatagaaaaagtagctgggcgtggtggcacttgtagtcccagttacttgggaggctgaagtgagagaatcgcttgaacccagaaggcgaatgttgcagtgagctgagattgcaccactgtaccccaatctgggtgaaagagcaagactccacctcaaaaaaaaaatttgttagagatgaggtcttgctatgttgtgcaggctgggcttgaactcctggcctcaagcaatccatttcacttggcttcccaaagtgttgggattataggcgtgagccaccaagcctggccaaagacatggatttctgtgtccttaaaggaagaaagctccgctcagtgctttgcttgtgttcatgattcaatatttatttatttgtggaatgattgcaccaagttctgcctaacatacacagcattctggttaatgtcctacttactgcccagtaataattctatcttatatttgtggtacaaatttgtactcttggaaaattattttttcttctcctgagcacaggaatctcaaaggatcctcctcctctttatataagagagtattcattctatttatttttatttatttattttagagacagggtctcactctgtcacccaggctggagtgccatggcatgatcatagctcattgtagtctcaaattcctgggctcaagcgattctcccgcctcagcctccagagtagctgggactacaggtgcgccaccgtgcccagcctattcattcttgatactgtctgaatgttgcttttgcttttttaatccaactgtgtgtcatgggcatcctatctcattcattcagtggtgatatggtaattcatagggtgcatctattaacaaaaatgttttttgaaaaatttaaccatttcccagttgaatcccatttgttggaagcttgacattagtaagatttgtgcatggtgtgttgtaccaccaaggactatgaagaggggaagagtgccattgggctccctctgttgtaccatcagtgtggcctttgggaagtttttatcctgtcctcttggaatgggttattgtgctggtttctgcttcacaccaagctgtgaacagtacagagtagcaggtcagcaggcacctttgcaaggatgtacacaggagccatgcctagagcggtccatagccgacagaaggtaatttacctgcccagctccctgcgggagcctagagtcaacacatagagtggcttttagcgagaggagctgaaaagcaacattgtcataaataaggcatgcgttcatgaagaggtgaagagctggggataatactttcatctgccagcggcccctcctgggttctcttgctctatataccatggaggaccaacttcttccaacctgaaactttcttcagccatctcccttccatttttttccaccgtgctatacttttacacagttcatgacgttccaacacaaatttcccattaaaaaacctgaagctgtagagctaatgtttgactttccatggctctgaagatatatttattccttcctcttggctcagacggcccctccccatgttggaaaatggtttctaaaaagagcccagtgaagcggcagtggtggaattctctgtactttttccttggcagggagttctttccctgacccccttcttacctgttctagacccactcaagcttctgtctctgagctttctgtcctcattctctgttggccttggaagcagatgagccaactttcatcttttctggataacccactctggagctttagcagttagaaatcacattcactgaaaattgcttttgtccacatttgtttctgtgttgactatcagtatgtggagtatgaccagcccccctttttttttatttaaaaacagctttactgagatccgattcacgtaccatacaatttatccatctaaagtacgcaccttggtgggttctgatgtgttccgaattgttcaaccatcagcacaatccattttagagcatttttatcagtccagaaagaaacgcttatgaattagcagtcactcccagttccccctctacatcccccagccctgggatactttctgtctctagatttgcctaatctggacatttcacacaaatggaatcatacaacctgtggttctttgtgactggatcctttcacttaggataagattatcaaggttcaccttgtggtgtgggtcataaaagtatttcctttttatggcagaataatattccattgtctggatagaccacattttgtttagccactcatcagttgatggatatccactttcccccaactttttggctattatgaatagctgtgaacattcatgtacaattctttgtgtagattttttttttttttttgagatggagtcttctctgtcgcctaggctggagtacagtggcatgatcttggctcactgcatcctctgcctcctgctttcaagcgattctcctgcctcaacctccccagtagctgggattacagccagctgccaccatgcccggctgattttttgtatttttagtagagacagggttttaccatgttggccagatgtctcaaactcctgacctcaggtgatccaccggcctcggcctcccaaagtgttgggattacaggtgtaagccaccgtgcccggccagatgcatgtttttaaaaatctcttaggtatgtatctagaagtgaaattgttgggtcatatggtaactctatgactagcatttagaggaactgccaaactgttttccaaagtggaaaactagcagtgtgtaaggctttagtttctccatatactcaccaacacttgtctttgcctaacctaaggtcgtaaaggtttactcctgcattttcttctgagagttttatagtcttagctctcacttttatccctgtgatgcatttggagttaatttctgtccatgttgtaaagacaggatccagcttcattccttgcaggcagctgtccagttgtcccaacacagtttattgaaaagactattctttgcccgattgtcttggcatctttactgaaaatcacctgaccataaatttgaggctctgattctggactctgagttctattcctttgatatacattttttctccttatgccaataccacattgtcttgattactgtagctttgtagtaagctttcaaattggaaaatgtgagttctccaacttcgttctttttcaagattgttttagctattctgtgtatgttgcatttccaaatgaattttaggatcagcttgtaaatatttatcaaaagaatccaactgggattttggtcaggattatgttgactttgtagatgactttggggttacctgctccttaaacctgtaaattatcaatgataagcaagttgccagctgtctttcaactctttggaatttacatgtaggttagaaatgctgacctcagagaaaaaattttgaataaagagttaggtcaggcacagtgaatcatacctttaatcccagtactttgggaggccaaggtggaaggatagcttgagcccaggagttcaagataagcctgggcaacatagtgagaccctgtctctacaaaaaataagaaactacctgggtgtggtggtgcatgcctataagagggatccacactgacatcctccaggagcccacggtttaatgcatgcagtcaggagatctggccaccccaggctgttcagccataccgcttgttcacctccttcagattaattttgcaagtgactgccagtctgcatggtttgaaagattaggtgtttggagatcatgtgcccagagggctgggatgcactggcacaaagctgtgcggaatcgctgggtctgaatgggtccttgagaaagcaaaggaactggaggcagcagatagctgaggtcaaattcaggctttacagacatccaaagaaactcttttgctgtctttcctgctttcttcagggccccaacatctatggtcaaaaaagtggttcactattcataggccattagtaaagtcagaggaaattttgacctttggaagttcttgaagaatggagcctcttacaagctcagaatgagcagctcctttctttctcctgcaggcattggaaatacagtcccagctggcaacaccagccagcagcacagcccggaatcctgctcctgacctgcaccatccccaccagcccacgatagaacgtttttgtaggcattcctcctcatgggagaggatagagtacatgcgagtttttgctctcctcccaccctttcacaagagcactgtgctttcttttcttctctttttcctttcttttttttttttttaggcagggtcttgctgtgtcacccaggctggaatgcagtggtgcaatcatagctcactgcagccttgacctcctggactcaagcaatcctcctgccttaacctcccgagtagctgggactataggcaccagccactatgcctggctaatattttttgtttgttttttgttcagagacaaggtctcactatactgtccaggctgggatgactgtgctttctaccaatgcaaactgagatcccggcaagggaaatattcccttcctccatgcccctagtaactctcttgaaagagaaaactgagtgatgattgtgtggggaggaggcaggcctggagcttgaagatagggtttatgctgttgaagtgagataaacagctgtggtgagggccatgcctgctgagctcctttaaggagaagccccaggaatccttcattaagcactttacagctgaagagtttcattgatatttgaaaattggtgctggaaactacaaaagcaaagtgtgagcagaggtattggagaggggcatgaggggaccctgacggcagctgtgcaggtggagcagggactgcctcggtccacagacgtggcccccagaactgtcgtgccatttgcgggggttgtgtcctgtaagaaaataggaatctaggtgcagaacagccctcctgggtgtcagaatgccagcgacaggagagaaggaggaaggacatgttcatatacgaagatacctttcgggagttcttagggaaacactgtaaacagctctgccctgagcccgggaggtggccatgctggcagtgagggatgtggcctgggccgtgggaacacagaggcggccagaggggaaagcctcagagctgcgtggacaggcttcttctgcttacacacgggcttctgccctgctcttgcccctcgggggttcttttgtcactggagaccctgctgttgccctttgctctccagtgcgtgtccccttcttccatatgccccctccttggtggggacaggctgctctgggaggtacagtgactgcgctagatgaacaccttcccaggtcaggcaatgacattttgctgatgtgtgttttagtctgggatgccctgagtagcttctaattatgaggcactgtctgtgcctcttgggtggaggccaagtttccattctgccaactctcagaggacgtggggccaaaacacagagccgctgagacaggagtttcagggggtctggaggtggatttgccgagaatctaagaagcacttcaactagttttgtttcctctcctcccttccactccctttcccttctgtcctcttcttttcttttatggagctaatttcctacgtctggctaaaatacagtagaaaagccctataaagcctatgagtgtcactcttgaataggaaattagcaaatagactttgtttggtaacagaagaacctgttcctgaggcgctgacagcctgtcctaacagaggcagctgggctgcagtgagcacggacctgcggtaggaagacctctgcatccagagtggcccggtggaaggtgccagactccccctcactccaaaaaaagaggaggctttttgagggcagggaccttgttaccttcttcactttctctttttgtttccagttgttgctgtaacagattgccacacgctcagtggcttaaaacaacacagatagactcccttagagctatgaaggtcagaagtcagaaatgggtctcaggcctgtggtcccagatacttggaggctgaaatgggaggatcacttgagcccaggagttcaagaccagcctgggcaacataatgagactcccatctctacaaaaagtttttaaaaaattagccaggtgtggtgacatgcagctgtagtcccagctactcaggagaccgagacaggaggaccacttgagcccaggaggttgaggctgcagtgagccgagattgcaccactgcactccagcctgggcaacagaatgagaccttgtctcaaaacaaaaacaaaaacataaaaagattaaaaaaaaaaaaaagaaataggtatcactggaataagattaaaatatctgcagaccttaatccttcctggaggtacaagggcagaatcttgtttccttgcctttttcagagaccactcgcattccttggcttgtagccccttcctttgtcttcagagccagcagagtagcattttaaatctctctcccactcccctgcctctctctttcactgttgaggagccttgtgaggacactgggcccacccaaggaatgcaagataatgtcctcatatgaaggtcagctgatgagccctattccacctcccatgtaacctaacatagtcacaggtgatggggattaggacatggacctctttgggggacactattctgcccaccacactccagtttctctgctgctcagaacagtgcctgccacatactgagcgttcaaacagtgagatactgtttgttgaatgaatgaatacatttgatgtaaacctgtgtcttaattatatcaactgaagcaacgtttcatttcagagaagcaacacaggaatggaaaatgcatggaatttggagtcaagacctgtgttcaaagtcttttccaccatttaagagctgtgtgtcgactgggcgcagtggctcacgcctgtaatcccagcactttgggaggccgaggcgggcggatcacgaggtcaggagatcgggaccatcctggctaacatggcgaaaccccgtctctactaaaaaaatacaaaaaaagtagccaggtgtggtggcaggcatctgtagtcccagctactcgggaggctgaggcaggagaatggcgtgaacccgggaggcggagcttgcagtgagccgagatggcgccagtgcactccagcctgggcaacacagagagactccgtctcaaaaaaaaaaaagaagagctgtgtgtctttgggcaattcacttaaccatgctgagcctcagttttctcatctgaataacaggaacaactctgtcttctctccctggtttcacagggttattgacttttattacatgcattcagtcattaaatatttgtcgagtccttgctatggtccagatagggattcagggaagggttctcagggagggtggcagttgattaaaggtgtgacagaagtgagggaggggccttgaggatgctggtggaggagggtccaggctgctagaaggcgtcagggaaggtgcggaggctcggtgggcctgcctctgtgtttagggagcagcgagaaggccggggctggagacaagcaggggaggggcccaagaagggaccagggcgggcccaagaagggaccaggtcccacccaagatgccacagaatggagcttggcttttatactaagtttgaaggattctgaacagggaagtgaaacaattggatttatataggaagaaatcaatcactctgatgttcagttaacataagatgatgtcaagtatttgcttcaaaagactccagggggtaggaatggagcgggaggtgagacgaggtagaaaggaagccagtggtccatgtgttagtggtgatcttgaagtcaggggatgagaagatggaagtccattattctagtctctcttcttgtggatatgcttgaaaatttccacagtgaaagttaaaaataaatacattctgtggtcagtgtaaataaatatcataatccagcacttcaaaacaggatctctctggtggctgtgtggccagtttggagctcactggatatctgaaggctcttgtggaaactttggacgtccagtcaaggcaagacgaactttgctcggacaggagggaggtgcggctgcgtgagagctggggctgggtctgaaggccgtgctggctagcctgggttggcacacagcaaagtgcagagtctagggctctaggcacatgggggtaaatgacaccgtatgtttttgagtgcatctggtgtgatggggcatgttcggaggcctcctcagggctgtgcagcgaagatactgtcccacacagtgggctcttgtcttgaacatggtacgcttactgtgaccttgaggctaaggatgggagagaccaaaccagcctgggcagagcggagagagggcaagatgagactaactttctgtgatcgtcatggccatcctggctttccccgcaaatgcatatcacggtggctgtgtatgatgcgaatagacatacctaggagtggggtggggcatagttctggagttttaggaaattccacttgtttgccaacatgcaggtacatgagctgacgttcactgcccttggacgatttcatgggtgggaaaaaatgcatttctacagcatcttaaatcattgatttattttttatacattattctagggattggaatattccagttcattacattgtcttttaaaaaaacactaatccagcggggtgcagtggctcatgcctttaattccagcactttgggaggccaaggcaaaaagatcacttgagcctcggagtttcaaaccagcctgggcaacatagcgtgaacttgtctctataaaaacttaaaaaaaaaattaaccggatatggtggcacacacctgtagtcccaggtacctgggaggctgagatgagaggattacttgagcccaggaggttgaggctgcagtgagccgtggtggcaccactgtactccatcctggacgacagagcgagaccctgtcccagtcaatcaataaaagtaatccatgccttcctcccaacatcgtttttgtggaaagatgtttggatttgtgttgtgtcattttctgctaaatgaggcttgcagcacatttgtcagaaaggagtcaggtgctcatcaggtctcttctaaaacccagcttcctcctggtactgttgcttcaacccttggatccctgaatgctgagaaagctttttggctctaacaacacattcaaagaaaaatgaaagaaagggaaaaaaagaaaaagacaccccctgtcattgcagaagtaatgtattatgatataatagaaaggttttttgaataattcagaaacagcaaagcaagtggtggtttgtctgtactgccgttattcagagagaacatcttaacagttcgatgtattgtctcccagtcccgtttcattcaactctgcatacactcgggttttaggacatctgagtaggcatattaactaggcctctgcttttctgtggagagagagggtctatgtaaaagtcggaagcattcttctgaatggcacagaaagaacattcagtaatgtgtttttccattcaacttttgccagctgagaatgttgagaatttcaggaattttcttctaccccttctctctttgtttgaatcccagtggaccttgggctctttttggcatctgcccttgacgctcccttatggtggccttgcacctgacctgccacagagcagcataggcgcccaggccgagcctgagcgactcaacagggacagagcgtcctctggaaatcataatacaaagcccatcactccgagttcctggacctgatgccagagcattctggcttggataattctcatctgggaggcagagcccagctggagctgtgcttgttgggaaacttcatgtattttccaccactgctcattcccaacttgcaggattttgctgctgtagaatttacgatgccacaaacctgcatttaaggaatgttgcctgaggcagagtaggtgttctaaaggattaggagatttcctggaataagactttccactgtgctgctgaggggtgtgtgtgtgtgtgtgtgcgcgcacgcgtgggtgtgcgagcacataaggcagtacaggatgggaaaacaagtgtagtgcacactacacggaaggcgagagcctccatcctgagcctgtttttaccttggccgtgagctctggagggttgtcacagagctggaaaaacctcagctttgtgtctgaccccacccactgcaccagtttcacaaaataagaaaagtaggatagagccaagccaagcctcaggactctctttgagtccagttctcttcacttccccaaaggtgattcttgatcacgcgaggtccctagatgttaataaatactacttgaaaaaaagattttaaaaatgaatgggaattctgaactaaaaccaaaataaataggtttctttactgtagaaaattttcagagcctttaatgcactaattatgctttgtaaacctccagggaagcatgtggtgtttctcaaacttatttggccaggaaaccttttttcctggccacctccacgtggcctggtgttctgcagaagaccctcaggaaaataccacactaggctgtcttgcctcatgtgccatttaatattttacaaacacctaagtctaattgctgctggatattccatcatatggctaagccaaaatttatgtgtccattctttaattgttagacattgagattgcttacagtttttcagcatcattgataattctcaaaggaattctggttactttgtaaccatctctgattattcccttaagaggtggaattgtcaaatcaaagtatctgaacatttgcaagattcttgaaacacattgtccagctgctttccagaaaggtcatgctcgtttattttctaccagctgcgggcagggttaatgtccatctgcgaaagctgagcagccggagaagctccaagagcctgaagaaggccgttcccgtctcccctgccacagggacctccagcaattagaaaacaaataatcacacacactaaggacataaacagctatttcttttgaggagacacactgggttttcacagttccctgtgccgtttctaaataattgaatgacatctgaaaaatttctcaacattttaatttggtcttctagatgttttgctgggtagtcagggaagaagggattttgaattggcatctgttgtgctaattttcaaataacctttcaaggtaagatgtaaaaataaagctttatcagcctcttgtgactgtgaactttatttccagaagaatctttttatgtgagcattccatcagtcttatttctgaccccacaggaattgaattatgtcatgttgaggactgaggctgattgtggtgcttttgctttctatttgtaagggggaaaagcataaacattgtagactagaagtgatttatctttttgtcctccaccaagatcaccctttggtcaatgcattattgggttttggaactgagacgtgaacttctaactcattaaaaccctcaagtccccagcaataaagtcatttaagtggcttcaccaacagagatttatttcaaagcgattccatttggaggaaggaaagaatgagtaatgcattatataccaagatcgcttcaataattcatgagacctccatgccagtgaccgttttagattcagttcatggtgttttagcctaaagtgaactctctctgtcttagaagacacccgcagtttgctcctctttgagcttgagtccatgaatatctttacttttgggaaataaagtttgtattgactgctactttgtgcgtttacatgaaccactcttatatggaggctattttgaaaaaaatgggcattttgtataattggggtaaaaggatacttaatctgcggtccttaccctttgaaaagtaggaatgtttaaaaaaaattattgctttttccttcctttgggcaggaattctgattttgttttttaagtgtaaggagtagattgccaaatggtgggttaaaaatagatttatggatgcctaataattatgccaaacacagtgttgggccgtcagtgagtacggaaaggcatgcatggcaaatgtcgctgtccccaagtgcgttctggaatgggggcagtgggtggcgccggcccttcagcatcttcggccaccgcacagttcagctgtgaactccttggttcaccctgagcttcgtccaaccttctcccttttctgaaacccgcagaggctccagagtcctttctcttcaggatggagacctgcatggagggactggaggcagggagggtggcccacttcctttccacactattgtgagtgcctcaccagcattcctcagtgcagtaacagggaaacctggggactcagatttccaaataccatcatttcagtttggcaagtattgatccaatgatgagtatcgtgggaaagaaaataataagttagggttttgtcgcttgccagaaaagcttcaggatccacttctccttcctccctgctctctccccactgcccaataaaaacagctgctttgttcaaaacttaaaaaccatattatttaaaactcattgtaaaaatttatgctatacagatgcttgtaaggaaaatgtaaaaatcgctggaaatcccacctgttaagatttagaggaacctcgtgttattcctgctcacagagacatactcccacatacattttaccctacattatattatcatataatgataaattaaccacataataaatgataaattatatgctatatgtgctgttttgagactatttctcatctaacagtatgtcaaagatctcttttcctataaataaaaatcatcattttaatggctatagaatatcattacatacatatatgtattaatctgtgcacaaaataacatagactgggtggcttaaacaacacacgttgatttcttaccatttgggagctgggaagtccaagatcaaggtgctggcagattcagtgcctgtgagggccccctttctggtatgcagatactcgccttcttgctgtatctcacataggggcagggcagggagagaagggagatctggtctccttctctccttataagggactaatcccatctgtgacctcatctaaccctaattacctcctaagggccccacctcctaataccaccacgttgggagttagggtttcaatacatggattttaggggagacacaaacattcagttcataacattataccatgagtcaattcccatttactcccataaacagcgcagggatgtgtcttcctgcgtgtgatggtcactccagtatatattcctctaagtggaattgctgggtcaaatgggacacacatttcaacttttgattatattaccaacagttgctttgaaagaagatattcagcacattccatgtagagtatgtgtgcctcccttcccaaacccacaccaacactgaacagcacaaatctttttacaatttaataatttataagtgtctccttatttttattggtgttcttccgattctaattgaacatgttttaaaatatttgttggcaatgtatatgtcttctgtgatttacctttatatatatctttgtccatttttctattaagccatctttttcttattgactttcaaaacccctccaggatactattttttttttttttttttttttttgagataaagtctcactctgtcttccaggcaggagtgcagttttgcaatcttagctcactgcaacctctgcctcccgggttctagcatttctcctgcctcagcctcccaagtagctgggattacaggcatctgccaccatgcccagctaatttttgtatttttagttgagacgggtttcaccatattggccaggctgttctcaaactcctgacctcgggtgatcctgcctgcctcagcctcccaagtgttgggattacaggcgtgagccactgcactcggcccctccaggatactttttaatttaaaaaaatatgcagattaagactggacccttctccaaaatatacataaaatgtatgcattctgagactaatgacctctcctgtctggggatgaacgatgctagtgaccagcagcacttgctttgttaacattttggaatggagctcctctgctgtcttgtcatttgtggaccttaggtaggtgtgaagccccgcgttggagaggtggcagcccctccagacccgaggcagctgctgccaaggttgcccttgctgactggtcctcattaatggctcagcaagggtcctgtgatctttgccagtgttccctttccctctccttgccatacatctttcctttactgccgcataattctaatgagattaccctgggtcagtcagttatattagagaaatgatgagcagcagggaaaagaaaattcacaagatggtaacatttaaaataaaatttgtttttggcctttacccaacagtagatttcatggtcaataaaccacaagcatacatatgtgttgatgaggaggaagatttattatttcatatgaactctggggccgggtgcggtagctcacacctgtaataccagcactttgggaggctgaggcaggtggaccacctgaggtcaggagtttgagaccagcctggccagcatggtgaaactctgtctctaataaaaatgcaaaaatgatccagatgtggtggtgcatgcctgtaatcctggctactcaggaagccaaggcatgagaatcgcttgaacctaggaggtggaggttgcagtgagccaagattatgccattgcactctagcctgggtgaaaagagtgaaactccatctcaaaaaaataaaataaaataaataaataatatgaaccatggaaaaattatatagggaaggaatttagggatcctgtaaggatgatgtaggataaaacgtttatgtttaatttgggattgaataaagtctgttcactttggcctaaaactgttcattgttcttaaacagtttcattcattggctcccatgtactatcgaggctcagctgcagctgttatcgtgtatgatattaccaagcaggtaagaatgtctccttcagaatttagatgtcatttatggtggttctctcacttagagagactggagcagagacgtcactgcttgcatcttgccagtagcgtgccactatatattgagtttatttcatgtatatgtaacaaagcatcccatatttatctgctaaattaaacaataatgaccattcattcttaaaattgactgtagaggcaaagtcatgcctgctagtactattctgcagaatgtcagcttttaaagaaaaggaaaatcatttttaatttctgcatgctttataattacagaatacttatttttgttactgtttcaatcatactacatacttaaaatgccaagcataacattcgtgtgtatgtaagtaaatctttgtgtgtgtatatataagtatatttttagttatcacgttgaaggtcttagacttccatcaacaaataaccgcagtagtttgatgacattttttcccactcctgcaaactgaattatttacttttttttctctggagtgttgactcagcacataagactgttagtttaatgacccatcactgttactttccacgagttcctgaccacttctacctaaatgtggtgtgttgcccttggcctgttttctagaggacaattgtgagtgaagggccaacaggaagacaggactctaaatatatatgtttcttccttggtgtaagcatgagcatttacttagtcctgttattcttattcatgtggagtccaggctatcattttaaattaatgttatttataggagaaaaatcactgatatgattttcttaactagatcaagttttaattttagaaaacttgatatggtctatttaagtatatttcagctaacattaacttttgtgcctagacagaggtagtatgttaatctgcatgagtctcctaaaaatatttttctccattaaattgtactgggcttgtatttctgcttagttgaaatattatattgaggggtctttctaatgatttgtgtacactgttggtttaggattcattttataccttgaagaaatgggtcaaggagctgaaagaacatggtccagaaaacattgtaatggccatcgctggaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccctgagtgtacaaaggtatcatgcctttgttatgtctgccctcagtgtagtaacttaattaatggcctttcacttttggtagtcaatgtggcattgattcaaccagagaagaaataagggaaaatgatagggaaatacagatctgatgtaccatacaatgataaatgttcaaattataactcctgtacataacacagttacatccctgactctacatatctttgggctagatggttttgttatttctgttgttactttttccattattattttcattatgactactagcacaattttactaacactttcctatggtaatgaccattagaattcttaatatttttcatagcatacctgtttgttttggttctagattttatcttaaggatatagtcaagtacataatctcactatttagttctaaaatcagaatacgacacattgtatgtgagtaccttgactttccccagtggtattgggttattgaacttcttatatcttgaaggaggttgtgaggatccagtacacatgaattagagatttgatgatagctttacctagcctggtaagctagctgttttgctaaataaatacattatttaaaaaaggaaatagcgaatttgtggtatctccattcccttggttaatttaattctcaggaattctagtcgttgattttcataaagacaactacatcatgcttctggttttgctaatcaaagtgtgattaaaccaaagaggaataaataatggatggaagtggatcttgcaaaagctcttaacatagcatttaacgaactgttctgtttctttaggatttcaaaagtttgcatcaacttgcatctggttggtttataataacagccataaacaccacttttctgggatttggacaaatcttcaaacttcccagacttagttatctcccttcgttactgtaatcctcaaacagcttactcatctagtgttcccagcagaatcaccttaacctttgtcatgggaagggtgaggtgggtgggtagagacgacctttgctgagagaaggtgctatctctaaatccccctaattatgggactaatgtgcgcctttaagtggaaccgagtcttatgtattgtgggaatgctggtggactagaatttaagcagaaaacgatttaaacttgaatggtatcacttaggattcttggttatgtggaaccaaagcacaactgaaattcaggagaaaggggaatttattggaagatactggtaatccacatggtaaaaacagaactgccctcagctctggcatttgacatgttccagagttagtctctggagagatactggcctggcattctcttcgtttccagtctaaaatgccagggaggaattccccaggttaagaacaggcgtgtgtggccaagaggggattggtagtacgagatgatatttcccaacattactattagaatgggaaggcaggtggtcttgaagagggacagttcctagaaaagtgtagcctggccagataaaacgtatctgtgacatatagatgtggctaccagcacccaaagatgtgctgtgtttcggggtggaatttgccttttatgcacaggtacagcattcttcttgatgggtgttctgatttgtgctcagctgattcttatatgtgcaattttcatagtgccccagctaacataatctattcatctcacttccaaccgtgaatttactcacagcctctctatccccagtgggagaaaatgcagggccatccagctgctacctctagtggtagtgtcatggggccactgtcccatgcatccagcctccctggtagtatcttttctcctcttgtttggcctcagtgaggtcggaatgtggctcctcaagatcctgcagttgcgttttaaagtgtggcatgtatatcttttgttatacacagttattttagatggtacttgttattgaatcaagcaacaagaagctgactgcctttaaaactctgattaggtcagtgagaaagactagttggacactaattcatttttaatttttaaacatttaatatgttgtattgaggtaaattacaaaacatcacggtcacctgttttaagtgtatacagttcaacgactgttagtatatttttagagttgtacagtcatctcatatctaattttagaacatttctatcactctgtgaagaacgtcatgcccatttatactcgctctcaatttccacctccttccagccctggtaatcactaatgtacctttttttcctctaaatttgctttttctggacgttttgcatacatggaatcgtacaatatgtggtcttttgtgaccatcttctttcagttaagcaaatgtcagtgatgcattcatttttatggctgaataatatttcattgtatggatataccacatttttatttattcattcacacattaacatttgaattatttctacttttttgctattatgaaaaatgttcctatgaacaatcatgtacaaattttgtgtggatgtatgttttcatctctctaggatatgtacttaggagtggaatttctgtgtcacatgataactctttgtaataattttgggaactcacagactgttttccaaagtaactgcaagatatccacatcctcaccaacatttattgcctgtctttttgattataggcatcctagtgggtgtgagattgtgtcactgtggttttcctaatgactaatgatgttaataaatgtcttttcatatgtttattggccatgtgtgtatcttctttggagaaatgtctcttcaaatcccttgcctaatttttagttggattgtctttttattatcgagttgtaagagttctttatgtattctgaataaaagtctcttatcaaacatataattcgcaaatatttcctctcatcctgtggattatcttttcacaatttttactgtgtgcaaaagtttatgtccagcttatcatgtttttcttttatctcttgttcacaagtgattggctaattgaacatcacaaatatttattaatgttttcttagtgcttacatttaggtctgtcatccattttgagttactttttgtatgtaatgtaagatacgggtccaaattcatcttttgccatgtggatatctaattacccctgcaccagttgttgaagagatggtttctttcccattgaatcttttgggggcacttttgcccaaaagcagtcaaccataaatgtggtcttatttttgtgctcttaactttattagttgatctacacgtctgtcctgacaccagtgttatactattttgattgctgtagctttgtagtaagtttgaaatttaaaactgtgagtccttcaacgttgttctctttttcaagattgtttgactattctggacccttaacattttcatatgaattttaggatctatttcttaatttctgaaaaacaaaaggcaactttgattttaacagaaattgtgttgaatctttaggcccattcaggtattattcccatcttaacaattttaagtcttccgatccatcagtgtgaaatgtcttttcattttaataggtcttctttaatttcttttagcaatgttttatagctttcagtttacaagtcttgcttttgttttatttattcttctgtatttgatttttttgatggtattgtgaatgggattgttttcttatttatggcattgcttgttgttagtgtgtagaaatgcaattgactttagtatgtttatcttgtatcctataactttcctgaactcatttattaattttagttgttttttagtaaattatctggagttttctatatacaagattatattatctgggaataaagactattttacttcttcctttccaatatgggtgccttttagttctttttcttgactaatttctctggctagaatctctaaaacagcctggaataaaagtaatgagagtgcacattcttgtttcttcctgatcttaaggataaaatgctccagtaagtatcacactaactggttttacatatatgttttttattctgttgaagaaattcccttctgctcctagtttgttgaaggctttttgtcatgactgaatgttggattttttcaaaaaactttttacatatgtaattatatgttaattgattttgggatgttaaactagtcttgcattgctgggataaatcacacttggtcatgatgcataatcctttttatacattgctgggtttagtttgctagtgttttgttaaggatttttatgtctatattcataaagggttttagtctgtagtttccatttcttagaatatctttgtctggccttggtatcagggcaataacagtcttgcagaatgagttgataagttttcccacctcctctgttttctagaagagtttgtgaaggattgatgtcatttctctttgtttttctacatcaacttgatctccatgatgtcagttctttaagtgttatctaatttgctgtgtagttcatagtattatctcataatctttttttcttaatcccatgaccaattaaataatacttctaatttgtataaggtcagtagtgatgtctcattttccattcctaattttagaaatttgaaacttctctctttttttctcattcagtctagtcgatagtttgtcagttttgttgaccttttcaaagaaccagtgtttttggtttatttcttttcattgtttttctctttcatttatttatcctctaattgttatttccttcctcctgtttactttggatttactttgttcctctttttctggttcgctaaggagaaaggttagcatatttattcgagatctctttaaatgtaggcatttatagttataaattttcctgtaagcactgctctagctgcatctcataggttttgatatgttgtttttaactaatctcaaaatattttctaattcgtgttctaacccattgtttatttaatagcatatgcaattcccaaattttgacttttgatcatttctaatttaattccattgtaatctgaaacatactttgtatgattttaattattttacatttattgaggcttgttttatggcttagtatatggtctgtcctggggaatgttctaagtgagcccgatgacactaagtttttaagacctatttttacacttgctattctcccttagagagaaagtctaaggttgagggccctctgcagacaagtgtgtctaactagagtttaattatattttgtctttatcatatttattttttaggattacattctttttatgatagttgacactagtgttgcatttatgacagtgatatcatatttcttttaaaatgttaaaaaagttgatttatgcacatgacatgattatctacacagaaaagcccaaagaatctaccaaaaaagttctaaaaatactaagtgggttcagcaaagttgtgggatacaaaagcaacgtggaaaaatcaatcagatttctatatattaatactaacaataaatatgcagaaactgaaatttaaaacacgatattctttacaattgctccaaagaaaatgaaatacttaggcatatatttaacaaaacatatataggagctgtatgctgaaaagtacaaaatgttgatgaaagaagtcatgtaagagttgaataaatggagagacatattatgtttatgaattgaaagtctcaacatagtaaagatgttcattctcttcaaattgagttataggtttaaatgaaatttttgtcaaatcttagcaaggttttttgtaaacataaataagcctattctaaaatttatatggaaaatcacagacactgaatagctaaaacgatattgacaaagaagaatataatggaaagaatcactctgttctatatgaaggcttaccatatagctacagtaatcgagacagtatggtattggcagtgagacggatgcatagatcaatggaacagaatagagaacccagaaataaatctacacaaatatgctcaattgattttttgacaaagatgcaaaggtagttcaacagaagaagcaattcaaccaatgaccttttcaacaaatagagtaatcggacatcaataggcaaaacaaaaacaaacctcaaccttatataaaattagtctaaaatgaatcacaggctttaatgtaaaatgttaacccataaaacttttagaaaaacttctaaaagaaaataaatttaaagatctggggttaggcaaagagttcttagacttatcattaaaagcacgattcatataaggaaatactgataaattagacacccttaaaatttaaaaacttaaaaatatttgctctgtgaaatattgaggtgtgaagaggatgaaagacaagctacagactaggaggaaatatttgcaaactatatatctataagggactagtatgtagactatataaagaactcacaaaatttacatgaaaaaatttgaaaatggcaaaagacataaacagacatttcacctgagagaataggaagatggtgaggaaggatataaggcgacgttcaatatcatcatcaaacctatcagaatggctaaaataaaaatcagcgacaacacctaatgctggtgaggatatggaaaaactgagtcatccatacgttgccggtgtgaatgcaaaatggcacagccactctggaaaacagtttggcagtttcttataaaactaaacgtgcagttaccatatggcctggcaatcacattcacgggcatttatcctggagaaatgaaaacttatgttcacacaaaacctgcacatgaatattcatagacacgttatttgtaatagtcctaaactgggatcagcccagatgtccttcagttacgaatggctaaacaaactgtggtgcatccataccatggactactactcagcactaaaaggaggcaaactgctgatacacacagctcgaaatgcatcttcaggggaattgtgccgagtgaatgaagccagtcccaaaggtttcacattgcatggttccatttatataacattttagaaatagaggatagattactgattgccagggcctatcataaggggaagtaggggtgggggacggggaggaaagtgggcatgggtttgaaagagcaacataagggaccctgtggtgtcggcactgcttggtatcttctctgtggtggtggacacaggaacctacacaggtggtaaaattgtatacagcttaactcacatacataagtgcatacaagtaaaactggagaaatctgaataagatagaatgcatcaatgacaatgtcctctttgtgatattataccatagtttttcaagatgtgaccatttagggaaactgggcgaagtgtatgagaaatcgcttggtactgtttcttacaactgcatgtaaacgaatctacggttatctcagtaaaaaatctgattaacaaaaagttgatttagataaaaataataaatattggaacagtcaggtgagggtatgtgtgatacatatgcattatatatattatatacacatggcaaaaattacaaagggggatgtatttgacaaaaattttgtaaacacactgggccaaatgattaaattaaccatctccagcacacctaaggtacaaaagataaacagggtaactgtattaaaaattcccatttaggaaagagggaaggggaagcctgctgcctgggtctctgcccagaatgtctgtctcctgtgagacaggaatagtcggtaagtgatagggcctgggaacctagtgggcaccggcttgttgacacgtttctatggtgggggaatcggttcttggtcagcaatctggctgctccagattctgcctgctgatataacttttctggggagttagccaaacctctaaaccccagaccttattcagagcttgaccttcttttactctaatcccaaagtactttgctctcctgtaattcccagaaaactgtatttgatttttaactgagggttgtagcaggacagtatgtagatatgtgtgtgtagatatgtgtggatgtagatgtgtttgtatgtgtgtgtgtatgtgtgtgtgtagatgtatgtgtgtatgagtgtgtgtgtagatgtgtatgtagatgtgtgtgtatgtgtgtgtagatgtgtatgtgtgtgtagatgtatgtgtgtataaatgtgtgtgtagatgtgtgtataggtgtgtgtgtgtagatgtgtatgtgtgtgtgtagatgtatgtgtatatgagtgtgtgtagatgtgtgtgtatgagtgtgtgtgtagatgtgtgtgtgtaggtgtgtgtgtgttggtggaactgatctcatccaacacactttggttgtgtaagcttgtcaattcttggaaggagctctgcctggcctattttgagaatttgctggatggaaatggaattcgccctccaaccttggctcagcccacttaaggcatttgagtgcagaagtacttggcagagatgcctgttcagtgtgtttcatcttcttgcatgttccagaagatggtataaaggtccgccccactcccagagtggaaggcattcagaggcatccggtcaggtacactcaggatttttagcttggatttttttctaggttcctgatcttggtgagagattttcctatcttgaacaaccctaaacaaaatctcccctgctcaaattattgtgaaactgaagtaatgtatggtccctctgaatttgaggcatgaaagcaaagtggaatgtgagaagactgtcctggacttgcacagagtaggtgctcaggggtgtaaccccccgtccttcctgccgctcttctccctccccatgaatgttctggtcacagctcccaggggtggagagtgtgcagttcctggtggggcaggccattctgttctctccaccatctgctgatgctggagttaggcttgcacagttggggacatttaagggattgtcagagttgcaagaaaataagaacctcaaatggattgaatccacaggatctggggtaccagctgacttgcctggtcaagatggcaggagaacctagtctgtgtgcgagctggggctggcagcaagtttctgaacaagtagcacatggcatggggctaattcaaggtctgtgctattctaggacagcagattggcctagggtctaaatagaaaagaaagctttgtctcagaaagtctggagagccctacaggacgctgcatgtccttttcctgggtctggtgggaaaaacagggcagttgagtcttgcaaagaaaaaaagagaaataggttgtaaccttgcctcagtggttttaaaagtttcatgaattcaagaaaccatagtgcacttgttaaaaattccagttctaggaaccaggtccagagattttgattcaataggaagaggcaggcgagggtatgtgcattttaaaaagtgatccttttacaagtggtccaagggtcattctcggaaaagcattgctttcgtcagtaggagtttatggtagagaagaatgaggaagtcccagaatctatcctggcatctgtacaggtctctaactgcaggctgcactgtctgggcttctctcttgcccttcaggcttcctggagaatgaaaacaatgactcatcatctttcaggattcaaaagtgtcacccattatcctaagcaaattaatccaggaacagaaaatcaaatactgcatgttcttacttataaggggaagtaagcattgggcactcacggacataaagatggaaacagacactgggagcttcagaggcaggaaggagtgggggacagttgcaaaacttcctcttgtgctcagtacgtgggtgacagaatcaattgtaccccaaacctctgtgtcaccccgcatacccatgtaacaaacctgcacacgtacccctctgaatctaaaataaaagttgaaattattggctggtcagggtggctcacacctgtaatcccaacatgttgggaggctgaggtgggcagcttacctgaggttgggagttcaagaccagcctggccaacatgatgaaaccccctctctactaaaaatacaaaaattagccaggtgtggtggcacacgcctgtaatcccagctacttgggaggctgacacatgagaattgcttgaacccaggaggcagaggttgcagtgagctgagatcgcaccactgcattccagcctgggtgacagagcgagacattgtctcaaaatacaaacaaacaaacaaacaaaaaagttgaaattatttaaaaaaacacacacacaaaacacaaaagtgacaccattggcccttcatctttaatctcttccaaagcatttccagggcctctctgccccctttcacaccccacattcataatcaccaggagaagagatgtgattgggttcaaattaatatgaggctaccctatttagcttggatctttttctaggttcctgatcttggtgaaagattttcctattttgaacaaccctaaacaaattcttcctctgctcaaattattgtgaaactgaagtaatgtatgatccctcttctggatggttcgactcccttatatccagcctgtgcttggttgcctttggcttgggtaaggggttaagggtacctggctttgggacctctgtgagaggacctgcaggtatttcaggaaccatttgctttagggccatgtggccaggatcctccgcgaaggagggaaggtcagaggaagaagagcatatcctatcccaccctggcccttaagcaagaatcactccctcacacttcctctgacaagcatgggcagccttgacctatagctgccataataagtcattccttgggagaaattactccaaccccatacattccgcatagcaggttctagttctacatttcttctgcttgatcttgttttcctgattttgaattcttggctctacacaaatcccctttgactcttcccaatttgaaactctttcaggctttcctggtcatttttggacattggccttcatttcatggcttctaatggaactgcttttcaagctcaggggtctcctgttggcatttccttgaaattccacctctcactggtgtatttagggccacgaatgaatcagaaggatgagggagggatcaggaagtgccgatgggagaagacccctcagacctagtttattttatcttacaagtggtagcagtgggaagttacccaacaacagtgacgatgggggctgggttgggaagtgggagaactttcttctcagaggtggtgggtaatgaccttgagatggctctgctgtcactggctgcctctgcctaagattcctcctaccctccccatgaatacaacccaggagatgctcaggggctgttctcatgcactctcgcctcttctgagggatggaatcatggtctcttaacatcttacggaagcactctggtgcctcttacagaaacattgggagggatgggtgggactgctgccagggagtccagaattccttcctggagtagaggtcatacaccaagacaaagggcatctagtgttagaagtgaaaatagggtagggtaggaggaaggaaattagtcctatcagctctcagtcatttgattagcaaatacgttttgacggtccttttgtggcagcaaagtgctgtgagaatagaaaagagactgtcttttcctttgagctattaatgtttacttctatttgggcagccaagaaagggggtggggaagtatctgatgagcaatgtaagactgtatttaatgaagttccagttggtctgatgcagtccagaaaggacagaggggttcaggaaagggagaggtcagaatcatctgttgtgactaggaaaggcatgggacgacatgcgtcccaggtgaggtatgtgccacaggcagttacggatgtgttggaggaggaaattccaggaaggggcaagatctggaacgaaggcctggaggtgggagcgagcttggcacgtgttggcagggaggggccgtcaagaatatctaccctgcacctgccctggggaatagtgggaaagatggcgggatggtgtgggtctcagaagcatgcagagtgggtgggctcgatgtgctggccaggatggtgcccgcctcggcttccccattgccaggcagtcagaacactgttttcttctgagcctgttgtggccccaggctcctccttaatgcaatgcctcgggtagtcactaccagttaaagagatcaaacctattggccatcctccaaggaggctgtgggagccgttctagtgtcttgagtaagtgcgtgattcatgcaatttcctgtgcaatctatagctggaaaccagggtgagcctgtgcttccatagtgtacacggtcaagttagaaacaccaccagccatctcctcacttgttttacatttttggataaagttgtggtttttaacagattaaaaatatatttggagataaatactttttactaagaataataaatttacattgctttcatctcttccatgtgactctaaaactcattccagtcttgatagtgagccacagttgagtaggggagtttcttagaaattatacaaaccaaataacagaatttgaaatgctggaccttaaaaatccaatttattccaaatactaaaagcactaaagccagtgaacatcaaaaggcctgaaaaatcatggcaagtgttaaatgcacgatgcgttttccttatgtgagataatgaggaagaatagagtctgtgctgttaaaatgtgtgtgctctgagatgtgcctgtccgtgttctgcgactgatgtggtgcgggtggcccctcccatttacctgctgctgtcacaggaggagggagggagctgaagactgagctgcccagagagcccatcaaaggcatctggaatctttcttaatttaaaacattcttaaagaagaatatataaaacaagcatatcgtaaggaatactgtggtaataaaatgaacagccgtgtaagtgtgccacagagaacccttccccaatcgtatcctcttctctccacccagaagtaaccaccctgctgactttggtgataaccacttgttttcgttatgctttacacctacatttgcattttccaagcagtagatttgcccgtttttgaactttgtaagcggaatgagactgtatgtgtcacgtgatgacgtgtcgttcactcagcatgtttgtcagattcacctgatgggggttagctgtggtttctacatattcattgctgtctactgttccgttttatgagtggaacacagtttatctattcattctattggtggatatttgagttatttctggcgtggtgttactatgaacattgctgcttgaacgttcttgcacatgtgtaagcatttctctggactggggtaggtaagagttgaattgctgagtttcagggggtgcacaccctcagtcttactaggtaatgccaacgtctttcacggtggcatggaatatgccaatcgtgtgtgagacttcctgaggctctgcctccttgccaggcttcagaattgtgatccttcagggcatatagtgctatctgacagtcatttcaatgtgcattttcctaattacctataaagttgtcatctttttatatatttattggccatttaagtttcttcttctgtgaagtgcctgttcaaatctttgccatttttttctattggattgtttaccgtaatcttgtttatttttaggatttaaaaaaatatatacttgatgctattcttttgttatctctatgtgttgaaactatcatcttcgaatttaggtcttatattttcattttctttatgttgtcttttgcttttaaaaaatattattattaatattattattattattattattttagagatagggtcttacgtagttgcccagctggagtgcatagctcactgcagccttgaactcctgggctcaagcaatcctcctgcctcagcctctcaagtagctaggactatagatgtgcaccaccatacccagctaatttttttaaaaaaatttatgtgtttgtagagatgggggtgttgctatattgccaaggctggtctcaaacttctggcctcaagggatcctcccaccttgacctcctaaagccctgggattataggaatgaaacaccgcacccagttctttttttcattttttaagagacagggtcttgccatgttgcccaggctggagtgcagtggctattcgcaggcctaatcccaccactgatcagcactgaagtttccaccttctctatttcctacctgggccagttcacccctccttaggcaacctgattgtccgtcaccccttggaggtcactatattgccatgcaacttagtgcagacacctgattgacatagtgcactacaacccagaactctggggctaagtgattctcctgcctcagcctcctgagtagctaggactgcgggtgcatgccaccatgccaggctgtgttgttttttcatcatcagaagtccttaatttttgtgtaacatgatttatcaatttttttctttatggtttattttggggggaagagcctaattttaagaaatcttattttaaaaatatttccatacctccaagatcaggaagttattcccctaatattaacttactcccccaatattaactatctttcataagctttacagttttggttttcctatctgtcttcaaatcacttgaaatggattttgatatgtatgctgcttaatttttcccatgtagacacccagttgtctcagcattattggatgtgaagtccactgttttcctactgacctgcagtattagctgtcatacgttgcgtgtcatgtgcacagtgtttcttgggccgtctcttctgttccatcggctgacttagccatccctaaatcaacactgcactaacttaattacgatacctttatcgtgagtcttgataaacagtctggacttatgctctgggatctttaatcaatacttgtgggccccagaaaagatttcatgagcacatagaagtgtgggtgtggacatgttatggtctggtggagactgggcttatgttgtactttgggttatgatgcagaactatgttatctatttcgttgctcaaacggttccaactttggccactggggtttctttctgttggctcccctgtccctttgacatatgcctatcattttggtttttgagcactttcttactttctggcacaagaagctgtttcagatttatcttggatatttttggctccggccctatagtcggcctgactccttttccctaattaggactccacaggaaacacagtcccttcttcaaggagctcggcctagcagtagacagcttctttgtaggcaggaccaggcttctctgcagcagaagggaacttgaaatcagggtaatgagcctcagcagggacgggccaccacgctgccctgagaggatcgtgtgtgggcacggcgctgtggcatggccctgctttgaccctctagctatgctgtagggccaggtggagcctggagtggcctgagctggggactgccgtgaactctttccactccccaaggcattgcataagtaatgtcactttctacttgcacagcaaaatcagggacacagttttctcgaacacggggtgcctcccctccctgcagcccatgctggtctaccctgggtggtgggcccttgtttgtgttagagacagaacgctctgcaggattctgagtggccagttgtggctcacagtccactggcaagtggaggcagagctgtggagcccttggtagccacggagggcctgccacccgtcatgaaatgcctactcagctgttactggccccctgtggacggcagtgctagtgatggacagaatcctgggactagtgccagtgactctgtggatacgccgagcgatctgggcgtgcactgctgtggtggcctttatggtcaggaggcgacatgcagtgagaagaagggaagaactggcccaaagggattcagcccagggtgaggtccacggaaaggccagggccaagatgcagccagcaccccaggccggtggtggcctcacatcacccatgccagaggtcagtcctcgattgctccaaaccctctgctcaagggttcagaaggaaatgagcaggtcttcccatcagggcccagatgagcttctgaaaacaagtgtgacaaaacaacctcctgaacatcctggaatgaccgatgcaaagtacaccccacacggttcacagcacgaagatcatcaggggcaaaccgtggacgatctgaatgacagcacagaccgtcagcaacctgcagagctgcctggccaagaaattacgagacggaagcaacgcttgcaggcgaaggaggagaagaaggaaaggccagagcaggcaggggcaggagtggaacgggccgcgaatgtcggagtgaagtgcagaccttcctggcccacacccctccgagcatgtgctcgagggcagtagggaccacgtggaggacaaggacttggcaatggtggggaacagggaatcaggacatggcagtccctcagcatcccggccagaagtccctctgaagagtgaatgatgatggtgacttaggtgtgtcttttgaatatcctgagggggagattggaaaagcagacttgcaatcctgggaagaaatccaaaggtgtaaagaactcacagcggaagtccaaagtcttcctgcaggcctccctgcggggcacgagggcacagctggagagggagcttccaaaactgcagctgagggttcccgctgcctacactgcaccgagaactcccgtgatggggtctcacgggagtccacggaggagaacgcctactgcctggacctcgaccagagacttcgaaaggtgcacgaaaacgtgaaccgccgtgtcagacttgcaaccactacaagaagatgacccaagacctggcccaggaatcgaaaaaagacacttccaattttcagagggagatcttcttccgtgagaaaatggcccaggaaggccggatggctgctgtatccactgagacagcgctccagccgctccgggaagaaaatgaccacagcaggcagaagccagctgattttgaggccaagttccagcttctccggggtggtgctttggctcctggggttctgcccgcagcccacaggggcccggaagtgtcagggggaccatgggacgacagggcccccagaagggaggcaggtcacaatgtgagggtttgggtccagagtacctgctggtttgattctgttttccctgtaaccaggtcctgaacgcccagagcctcagcagaacatcagccagtggtgctccctttaagttacttttgctcgatctcttgttagtttagttcattggttgatgctgaagttgcttatattgatgtttgatagatggcattaggattgtaaggtactatttttcagataaagattgtttaattctggcacatacacgatttccacatctctggaccctccataagtacgcaggataagtatttcattttcgtttagaaaaagggcctctcttacctcaacatcattgtgttcgttatggataggaagacataagccatatctgatctatgagctgttattagaaaatagtacagtaaattggctggaataaaccttggttttaaaacagtgccaaaagtgtcataaagttctttgtctctgacccagaattcttgggtcttctgtcagcatccattgactgtatcagatgattttattgacttataagtagggtaaagtcaatcccttcatgctttttatgagacagatgggatactgatagagatatgaccgtctggaatagagccaattaatgagatttaagggaagtccttgagattcagtggtagacacattgaacaaattatatagtcttttgtccaacaaatagttctccactatgcagccctttttttttcttttttgagatgtagtttcactcttgttgcccaggctagagtacaacggtgtaatcttggctccctgcaacctgcgcctcccaagttcaagcaaaactcttgcctcagcctccctagtagctgggactacaggcgcccgccaccacgcctagctaatttttgtatttttagtagagatggggttttgctatgttggccaggctggtcttgaactcctgacctcaggtgatccaccctcctcggcctcccaaagtgctgggattacaggcttgagccactgtgcccagcccagtatgcagccttttaataagggacaaacctgaacagcaggtggtaggctcaaaaacacctttcctataggcatgtggatctcctcactaattcagctgtcagtcctattgtgacaattagcaataaatttcttctggggttgaaggggaaggttctaccaacttcagacaatatttacagagacataaggaaagaagtcataaagaaatattcaaagttcaaaaaaagaatgaacataagttcttattgatgcctctaactctaatccagaaccacaagccctattctaaccttctttggcggtgggggaaggatgctaaaagccatcagctactgagtgattaaacagagtggtttaatcttctgttcctggggattttcttcgaagacagagtaatctcttttgccttcacttcacatactgcccagaagtttcagcatttcataatgtaacttatattaatattaagaactacaactatctcagtgattactttcaaatggcacaatttttacttatagttgatctgtctcctgtttacttaggaagtgggttgtaaacaagttaattattatcactgccaaccctaactgagtgcctactgtgtgcatgtgtgtagtttatgtcaatcctcccatcccatgaagttaatatcctcttcgtatcttatcaacaaggaaaccgagacacaggtgggtcaaggggtcgatcctaggtcctgtagctaagacggtgtagggtccagcttctgacctaagtggtctatcccagagcctgtgttcttgaccgtcatggtatcttgcatccactaagaagtacaaacaggacccacagtacaaacaggaactcccaaactgccccgagagaaaacggcagctggtatgatccgctcagaggatttggagccgacaactctttccagtggttctttctctggcctcttcaggactaggctgaatttctgtcagcagaaggggattaagaggcaaaggaatggccaagtcccctagagaacctgttttctgcccagtccctgttggattccaaattctgatatgttttccatgagaaacaacccatttaaatctgtggcgagaacctgacactgctcgtttgaacctgacaccaggaatttagccccaggtgaatagcagttaaggacatgtgttattaagtaggtgaggccccttgggagcagaaattctttgctggtacacggttgtcaagtgctttagctgtaagtgcttagatcattgcaatgtgttattgtctcagatatttgctgtgaagggagtagctattctttgtttttttcaaagaagtttattttcgtttttttccttctcacaggtaaaaatccaagtgtctgtaagaactagcgttttaaacagagattttgctgctttaattattgttaaaatggttgcctcatctgtgtgttacatagacatcttgggtatttagagaaaatatgagctagggggagcataacaaactctgattattcatttcagtgggtgcttgccggaacggggcctgctgtgagaacgcgtcagagcacacacagccctgcagccctcctctgcttgattttgatgagatgttgtgaatgatttcccttgcttttggctgcaataccttaaacatgtgggatggttttgacagaaaataattccaccacacagttaacagccgtctcccgctcaccgctgctgtgctgctcgtggccggcttaattggtcttttatgcttgaccttggaagggggctgtggctcggggagagagtaaaaatataatgcaaaaaacatgtaaggagacgttaaatgttacattccaggagtctggcagaatataatatacttagttttttctgttacagtattttagaactataatatgcatgctagaacatgtatgaaccaccagagaatttgttttaggaagcgctaatgagtccactcttctttttatttttatttttatttaactgtaaaatggtgcctgagcagtgtatattttattgtgccctagctatagtcatcttgatacagatttccaaactactggcttcatagtgtcagattatgaattggatagagtgaaaaaatatcagacttgactttttatagtcccccctacaagaatcattctccatctttagcaggcttgagaactgctgggaagcttgctacagtgtagatttctggggcttgcccagtagacattccgattctgtaggtctggggagatttagtatatgaagaatggagtggaacacatggggagagtcagtgtgtgaggaatggggtgagacacaaggggagactcagtgtgaggaacagggtgaagcacatgggtagagtcagtgtgtgaggaacggggtgaaacatggggagattcagtgtgtgaggaacggggggaaacacacggggagagtcagtgtgtgaggaacggggtgaaacacaaggggagagtcagtgtgtgaggaacggggtgaacacatggggagagtcagcatgaggaatggggtgaaatagatgggaagagtcagtgtgtgaggcatggggtgaaacacagggagagagtcagcatgtgaggaaccgagtgaaacacatgaagagagtcagcataaggaatggggtgaaatagatgggaagagtcagtgtgtgaggaacggggtgaaacacaaaggggagagtctgtgtgtgtggaatggggtgaaacatggggagattcagtgtgtgaagaacggggtgagacacatgaagagagtcagtgtgaggaatggggtgagacacctggggagagtcagtgtgaggaatggggtgagacacacggggagattcagtatgtgaggaacgggggaaaacatgagaagtgtcagtttgaggaacggtgtgaaatacatagggagatttagtgtatataaagatatttgaaatctgtgcaaaaaagaggtaattcagtaaatagtggtggaataaataagagaaggaaaaataagagaagataaattcaaaatggaacaaggatttaaatgtaaaacaatgaaatcatgagacttacagaagacaaataatttttaaaataatcttaaaaatggaatgaattatttaatcgtgatacaaaactcagaagccatggttgaaaatgatgaataagcctgactatatggaaacttctgagtggcataaatgccataaacaggaatcaaatacaaacagcaggttgaaaaaaattcggaaaatgtattacaaggggctaggttccataatatgcaaagaacaattacaaataaataagagggaaaaaccctcaaataatccaaaaccaccctgggcagagaacatgtacacgaatgtcatggaacaagaaacactcatggcttctaaaaagttattcaccatccttgaataaaagtttctcagaattaatgtcagatttttttcattgagaaaggacttcaaagtacgatgcagttctactcttggggtgacttatgaacattaatatacttgtcaagttggctgatctggcctgtgctcccctcatgcttctatggaatgttgataattggaccgggagctctcctgggcataaaatgaaggggttgagttggataacactacaaagggcctttacttgtttcttctactcgcatcatttcctcagtctttttggcattctgtaagaaagtagtgccatgctgtcatcctcactgagacggctttgcaaagattcatttaagaaacattgatataacacttatggtgtgcccggcattattctgagcactttataatatcaacctccttttcccttacgtaaacactgaacattgctgtaaaatgtccacccagcctggtggaatgcatggacgacatagacctgagggaggtgagcactgaagggtatttactggtggagacgatcgctttctttctgtgagcagtgcacttgggctgcctgcctgtatttaccctctcatgtgaggtgctcatctgggccacctgggaacgactctgagccaaaacccatagtcaagacgcctgagtgtactcaggcagactggtgtggaggtggagctcatctctctccaaaggaaccttcccagtaaacctccgtagggaaaagcattcttctacccttagcctgtggatttgattcccttccctcacaggcagggcttcaggattccttctggtgtacctgtcttctattcccccagccatcagtgaaggaggaccacaaagaatttaaccagctctgaaattagaccgaggcagctgccatgttgccaggttacttccacaaacaacaaaacaagcacccctattgggtagcacaggcctgttggaaatgctggagcccgcaagaatgttgtttcctgatcccctcccctgctgagaagcctctgagtgccagggaccagctcagggctcacctcgctggaatacaggctggttaacatcagagcctgggactcagaggaggctccctttcatgtttttaccctcaaagcctccctcccagcccacttggaaggctgggtgagcctcttgtcccggatcttttccagttgactctcagcactcaccacacttcccactaagtccatagattcctccactacccactcctcctttctgctgaaggcaacttggggtgatttttgtcatctagtcattcagcagatgcttactgattgcctcctgagagccaggtaatgtgaggatccctggacatgaaaacaaaagccacggttctggtccgaagacatccacagcctgtttgaacagagagacagcttcacaaggagatggtatgacgataggagtatgacaggaagaggggaagagcatctagcctggtggaggggttgccagactgagctctctaggaggccgtgtgagatgttgccacctgaacagggagaagtgggtgcaagaacccaaagttccatcaccagcagctgatttaaaatggctgtggcttcgggggcaaacaggggaagagtaaggcatgaagccccgtcctgctaaggcgttggtttgattctccagcaatcagaagatgttggagaatcctattcacaggaatacttggtagattcgcagtttgaagagtccccaccatgggcacatggattgcaggaggctagaggaccaggaaaggcaattgcgggtgtccctgtgagaagcgaagagggggtgactgcagcagaggcagcggattggcagtgaggctggaaggagggtaaagcaggctttatcacagagcattgaggtttgcaagaagagtggcagatttgtaggtgagaggtggttggtcgggctttgacaagttgcatttgtgaagtccatttgccctgagcagcagctagctagctcaagggggagatgtgtccagacgtggaagagaaagggtggagtctgtggcccccgagcctgtaaccacacagcatgaacggcaggtccctaagatgctctgcaggacagtgtccaccgtgggaggcagtcacctatccttcatcctgactcagtgctttcattcccatcacctgagcctgattggtctcttttgtggtcccgcagccgttcctgcggtctccagctttcccacttctcccgccctccccatcccgcagcggctcaggagggactccagctgggttctgaattccaccctccatcctcaccactcagcctgactggagctggccaccgctgctgctttgggatgggggtgtgcttcagacagtcagagaagaaaccctgagtaatgctgacattgatgggccacgcagactatgatcagctccgggaatgtctgtgaaggagcagccaggggacagggctggcctggggggatctgcatccacacttcctgcagtcgtagtaattctcagtgatttctgcatatagattggtctagaaagtctaaaaatagtctttaccgtcaaaactaactctctgcatgtttataccttggcttgggtgaactcgtttcagtttacctgtttcaacgcctagcacaatgcccagcatatagtaaaccctatacacttgttgaaaaaaaataaacaaaagtcacgggatgccgtaccctcccataatcgtaatgacgggaggcctgtggtggcagcctttctgcatcatgggtctgtgcagtggcctctcctgaagtgcagctggagttctcaaatgttcccagttttacatgtttgcaagacattctgggaagtgaattctcaccttcgcaaaactctcctcacagattgtagtcacaccatttgttccgacagcaatttatctgacactaactggatgtcctactattcagttcaattcagacactgactacctggagttagtgtagaccctgcaagttaagagtgcaatactgcgagactgcctcccatttcagactagagctgcaagtttccggtatccccaagttatctgcatttctgcccaacagactacaaatttggggtctcctatgacctctcctcaaattcagtaattcactagaatggactcacagaactcaggaaagcactgtactgtcaaaggaaggaattatgattactgtcaaaggaaggaattacaacaaatttatttttaaatattctttagagacagtatctcactctgttacccaagcgagagtgcagtggtacaatcatagctcactgcagccccaaactcaccaggctcaagcgatcttcccatctcagtagctcctgagtagctgagtccacaagcacacaccatcacacctggctaatttttcctattttttgtagagatagggccttgctatgctgctgatgctggtcatgaactcctgatctggagcgatgctcctgccttgacctcccaaagtgctgggattacaggcgtgagccactgtgcatggcccaaatttagtttaaagatctcaattgggccaggcgcagtggctcacacctgtaatcccagcactttgggagactgaggcgggtggatcacgaggtcaggagatcaagaccatcctggctaacatggtgaaaccccgtctctactaaaaatacaaaaagttagccgagcatggtggcaggcgcctgtagtcccagctattccggaggctgaggcaggagaatggcgtgaacccgggaggcagagcttgcagtgagccgagatggcgccactgcactccagcctgggcgatagagtgagactctgtctcaaaaaaaaaaaaaaaaaaaaatctcaattggctttattcatgattctagaactggcaacaaatcattccataaaatagaataagtgttcccatgggctgagcagaggggattggctttatagacagagaagggctgaagaaagcaggaacaaggaacagtagcctgctagtcgtttcaaagatacttttcttgggggacaggcagagggagggacggggaaacagaacgatggaatatcagatgagttaacatgtcatgtaaggattaaagccaagggaactgcattccatggctactgaagatttcagctggcctatttgggaaattggctgttacctcttgtgacttctcagaaggtcagataactacttagtttgggtttggtgaaggggaacttaagcatgggtgactacttttattttcagtctggtctcatggggcctaatgcaggagcttaggcccgaaacaaaggcctcctataatattaatttgacatacagttctgttgttatggacacaactcaggagtagctaaatggaagagatagtgagggcgaggggtgggagtgggacaaggagcttccagcctctcaggggtagcactcccagcacaccagtgtgctcagcagcccggaccctctcaagccttgtgttcaatagttcgtattgaggcttcattacttagatgactaatgaagattgattaaatctccagccccagaggctggcgttggggctgaaagattcaaccctctaaccatgtggttgattcctccagcaaccaggctcatcctgaagaggccacaggatggtctagggccacacgctatcaaactcagtcatggctgaaggggctcttcaagaataccagaagacactcctatcacccaggaaactctgagggtttggggagaactgtgccgggaaccagggcaaagaccgaatctgtatttttttattatgccacagtaatgggagcatattttggcagactcaagagtgattggtcgttctaatcttagttcacattggagggactttcactggccctccagattcttcctgtaagcacctgttctttaggaggatggagtaggctcctgccccgccccaccccaactgcagtgcatgtgacagtttgaaacactttgagccccacatgtgtctgtcaagatggaaataacagcctctggcatgtggtgctggtgggtgcttgtgccattgcagccctgtaggagtgaggtggacagagtcacgggtttgggttaagccctgtctcacctctcattaggcatgtcacttcggcaggccgatgatttaatgagactcacctctagccatggaaggagtctgagggtgtgcttttcttatcttcccatctccatatttatgttgtagactgtgaaggaattagcctcttggccatggtcatcctaaggatggagatgttgggctgtggtacatgataactgttcttttgtaagcctagtgaacctgtgccgctccttcttgtcctgcagttggactgattagaggggctgaggaagtgcttcacctgtgaatgtgatttcctctcacctgcgggcccagaggcatccttgcttgccaggtgctcctcaccccacccccagtagggtagcaggtgacatctcctcctgcaccccattgtgggcagagatgagccccaccctttatctgtgctttgataaagacttcaggaagaggctgggcgcagtggtgcaagcctgtaatcccagcactttgggaggctgaggcaggcggattacttgaggccaagagttcaagaccagactgggcaacgtggcgaaaccccgtctttaccaaaaaatacaaaaattagccaggtgtggtggtgcgcacctgtaatcccacctactcaggaggctgaggcacaagaattgcttgaacccgggaggcggaggttgcagtgagccgagatcatgccactgcactccagcctgggcgacagagcaagacactgtcaaaaaaaaaaaaaaaaaaaaacttcaggaggaagtaaaaaacaaggtatcatgccaaactgcacagagaaaagcacttttctgtaatctttcaaatataaaattctgttgccagaaaaactccagcataatccctgtgacaggcctgggtcttgtctgttacaaacaagagagtgaatgtcggggtgtacttttccctgcagtttggaagcacaggtgcccactgacttggctccagggacatatttcttttggctgagaggctggggccatcgcctttaacatggtagaccctagtcaggcgcttttccagctaggactgaagggtcttccccgcatatggtttgagtcccataggaatttgaatgccaaagtagaatttccttggtaactttaaacctcttgaagccatttacaggctctggggcaggtggaggaaggggcggggaggtgggcgctctcccatcactctctgtccctgttttgattttgtgtcttccttctcttttccaatagcaatccttctggtcgaggattgtgatactcttgcctgcagcattagaggagcttccagattcttctcctcacctccatccattctatgcaccattttttcctagactgtggagctgaccctgtcacttcctgtccttcagtggcctctgggtatagacagacatggtgtgcctccctctctcagctccaacctctctgacattctctccattcgggcccgtgtcattcatttgcaaatccgccataacacccccagcagtgctgggtgcagaatcaacttttaataatctccgggaatgtgtgcactctcctgtctctgggcctctgctcaggctgtcccatcccagagtctgacctgcatttgcctagccttcatggccacacttaaggtgaccacctctgggcatcttcctggggtctattgaacagaacacatcacttcctgcccctctgctcctgaagcactttatgtcgcagtgttgtggattagagtgcccctggatgagccctgtttgtctgtgttctaaagcacaggtgccagaaggcagaacctgtgttttctctggcccctgggagagggactggcatgcagcagctgctggagaataggaactgcatcttttttatctttggatccaccacagcattttcacattgaaaagaggtcagtagatttttttagggtggtatggccgtagaccccatccaagtactagccaggcctgaccctgcctagcttccaagatcagatgaaatcaggtgcgttcaggtgagttttgttttgttttgttttgttttgtttgagacggagtcttgctctgtcacccaggctggagtgcagtggtgtaatctcggctcactgcaagctctgcttcctgggttcacgccattctcctgcctcagcctcccgaggagatttttttaattgttcatttaaatagagttcatgccctaaaacctttgcgagaacatccttttacagatgaaagtccagatatgccatcctgtattgtagccatggtcggtataaccatgctcgtttccaaactgtcacagcacattgcatattttctctgatttgtgaaagataatatgtaaaaagtttcacaaaagcatgtgtgcacaaacatactaacagaggtttggtgttttttaatattgagtcatgtaatggggaaaaaagttgaaatcagctgtagctctgaaagctgaaatgtgtactgccatattcgtcatggttttccctgctgttctggaattcttctgtgggagcaggaacactattttatatatgcatatcttctcttcatgaatgccagagactgggttttaaactttaaaaagtctcactcatactaggtgtccattcttgctgagtgattgaattattattctacaagaagataaaggagctgttgccgcacaagctgtctggtcttttgggtgatttgtattttacaaacaaacattcatttcctgtctacatttgacctcttttccagggaggttcccctgaaggatgctaaggaatacgctgaatccataggtgccatcgtggttgagacaagtgcaaaaaatgctattaatatcgaagagctctttcaaggaatcagtaagtacctgaaattgggttttcagcccaacttgcatttttatgcttctgggagtcaaaggataacattttagaactctgaagtgaacttttcctctgtgtgaatttatcggatgccatggatacaaaatctacagctatgcagttgttaatacccacttctattatcctctcgattctagatttccatgattctgtactggaacctgttcactctgagttctgtaaattaaaatgaagtaatcctgttgcaaaaataaaatttattttaattgaaaattatgcattctgtagcattttatgttaggaggagagagaaaatagacaaggtatagaactcaaggtcacccattagatgggatgactctaggtaaactgagggaaccttccagtaactttttttgcctgatcatctcctacaaaaagtaatgtctccatcctgtttgacctgaaattgggaattggatacagggttggcgtgtacaggtaccccatgtgtctggtgagctaattagggagggtgacagcctccttcctggtcccagtgctgggtcccgttatgctcactgtatgccggctccccgggaataaccttatcaaccagagctggttcccagctaatggctctgccaacacatctatctgcagctgtgaggcttccagctcaacagatttaaccttcataagttctctggttgtgtcattctgttccggattctgccagagaagtccctgctgacagccatctgggaaaactgctctgagacaccctcaggaaagttcgaccggagcattatcagggacgttgggagaagtacaggtgtttgatgaaatactggccctgaagttcctggaatagccaccgtaggaggagttgaaccccaaaacagtaattgtcctcaaatatcttagctccagacaactccagaagggaaactgatggtttgatctctttcctgcctgagatcgtttttggcagagctctcaaagtcagagaagccgtggcttcccagaacagttttgatttctgtttaactggtttgagtgcattactttagactccaagaacccacaggagggaatcttttgtttatgttggcttgatggagaattcattggagatggggaattctgacctgtcttacctacactatgcagagatatgcaaaagaaatgtgcaaaagaatggcttggagcctcccctccccagctgctggccctttccttcactggggtcttcacccccttcccttctttccaccttccctttctttcctcctttgatttcttactctcaacagaatggtttcaggctccttgccctgaatggctgaactctagcaggctggggctggaatttcatgtgggaaaccccatgtccccacattcctctcccttctccatcatggtcagtgggtgcagatgctctctggtgttgtgtcactctgggtgacatctaagtttgggctcgaactcattacattagcctcacatttcctcagattaaactcattctcttctggtggcgttaggctcttctgctatgctcagctatgaaacattttgtttttacaggtggttttaatgaatgaagctagatagctcctgaggacgattgccttagcaccttccatccttacagccccgcgtcttccgcagagccccctcctcctccttagctccctggccttggaagacccccagcacagatatcagtggtcagccaggggagcctggtgccttgtatgacctgaacttgagcttgagatctctgcaccagctgggaagctttctgaagtttatgaaagtcattgttaaaatttaaaaatatcaaataaggacctgaaagagaagaagcctgagtaggaagtactgtactaatatcttttttctttttttttctgagacagagtctttgttgctcaggctggagtgcagtagtgcaatcatagctcgctgcagcctccacctcctgggctcaagcaatcctccgacctcagccacctgggtagctgggactataggtgtgcaccaccacactcagctaaatttttggatttttagtagaatcaaggtctcgccatgttgcctaggctggtctcaatctcctgagctcaagcaatcttcccccatcggcctcccaaagtgccaggattacaggtgtgagccaccacacatggcttgtagtaataacttaaaagacatttatccagtataaatcccttcctgtgtgtgacagggactttgaacaggttaattcctcagatcttggtggtctactttatgaaaaaacaagtgctttgctcaaacatgggtaattatggtttcaaagtaattaattcctatataagccatcaaatacccatatcacctcatctttcatgtcacataaacaattgtttgtttctgttttattatactttggttgtaactgccttgacaaagaaagcttgtaaatacacagccatggcaaaacctcagtctgtccatctgtctggctatccatctgtctgtctatccatctttccctccatctgtctgtccatctgtccacttggctgtctatctgtccatctgcctgtctgtctctgtctgtccttctgtccatctgtgtgtatatccatctttctagctgtccatctgtctatccatctgtccgtctatctatctattcatctgtacctctgtctgtctagtcatctgtctatctagccatccgtctgtctgtccatctgtccatctgtccgcctgtctatctgcatgtgtaagcactggatcttttgcctcttttctccttcatgtgaatttcttcagaatggagttctgtagcctaattgcaggttaatttaaaacacaattccaagtacacctaaatatactgcagcagacttttcatttatttttcttttccctgttcctacttatattacatgtgctcctccctgagcttaaaatagaactacatattgctgacacctaggctccccaaagcaatgttccacagtcgactatgcctggagaaaaaatgcaataaaaagttaaggagctgtgaaaataaaagccctttaaaaaggtgtgtttaaacaaaatgaattcacattgactcggatgaagagatgaatgtttctcttttacagtcccatagtgttcataaaccagaaatgggacaactgtgttttctgaacattggcaaatacagtgtctaactggagactgcttacaaaaatatgttatctttttaaagactgaagctaccctgtaaaggatttaggtgctgctctgtttggggtggtctgtgcagtttgtcctcctcatataatgtattgtcgtctgattggtattcctccaggcacccttttctaaatcacatttttagacctactttgtctgcctgcatgtggctaattctcttccatgcatttctacccagggtttgtttatttttttttccttgggttcttacacccaaggaagaaaagtaaaaacttgaggttacttttggtttgttctgccattttgacacttaaacatattttatctttaattgattctccaagcgtttaggtatgtgcctgttcttctagggagattgcaagttctttgggagcttgtcttttgtattacccatgaagctgagactaataaatggaatggtgctgaattcggggctttgaatttggatctccgtcctcatctcatgatataaagtgaaatgtaatcacttttctctgggaatttaaggttgaagaacagcaaattagacaagcctacttactcttgattcgtttattcacaaatatatactgtactcttttatgggtaggtgccatgctagaccctggggacagcacggtgacaaggcgcagtgacagtggagtcggggagacagctgtgggcacagtcagatcggtgtctggtgactcttggtaattggtgctgcgcggcgaaggagtggactgtgagaggttactatggggcgagggagtggctttagattgggtgaggaaggcctccccggggaaatgattttaagctggacctgaaaaacgagaaaaggccagtgggcaaagagctatcaggcagagcaaaccgcaggagccaagtcccaaggcaggaaatgtcgtggtgcttttaaggaagagcaaggagtgctgtgggaagttgtggttagagactcagcagggccttgccatgggagtaagggtgatactctgaaacaattggaagcccctcaagcttttaaagcaggagtgcagagtgtccaatttacatttacaaaaaaagatcacacttaaaaggaggaaagtctccgcatgtctcaatcagttggcatgcgattgtaataatccaggagagaagtggcttggacgagggtggaggaagtggagctggatttcagaaatcttccagaagaaccaataacactggaaggagatggggaatgaggaagacagcgttaccaagagtcatccccaagttctgtttgccggaatgaggaggattggcataggaacaagtgatctgggctggatttggttatgagcctagcatataggattctggattgtggtgaacccaagttttggtttgtagattattattatttttttatttttagagatgaggtctcgctgtattgtccaggctggtcttgaactcctgggctcaagtggtcctcccgccttggcttcccaaagtgctgggattacaggtatgtgccaccatggccagctggtttgtggattttaattacttaactcgaatatctctttaaaagtattttaacttttcctgagggcaaagagaggtggagctgcaggctcagcagaaaaatgtctggattggggtggaacccagcaaaatagctatgcattttgctccagttaatttaaatgttgactgtggcagagaaagcaggactttctcctgaaaattacacttggagacactagagacattagaccaggttttatatttgttgttagtttgagagcaaggtgagaaacatttgttttattaaggtgaatatatgggcatggcggtgtgcacctgtagtcccagctactctggagactgaggcaggaggatcacttgggcccaggagtttgaggctgcagtgagctatgactgtgccaccgccctgcagcctgggcaacagaacgagatcctatctctaaaataaataaataaataaataaataaggtaaatatatttagaggtacaagcatattggcttggaaaattggaatggggtgttaatatgaaagacaacaagttaagacttgtgggtagtgatcatgtcttgttctggaaacatttgttcacagagtgttgtgctctaggcacctttagttagtagcaggttaaagtaattttaaagcaaagcaaaaggtttgcagattttataatagtcagcaagctgtcaggtgaaggtaagtttagcagttaaggaacaaggaaaggacaaagacaaagtttgtccactttctcaccccaaaaaaagttaatttaccaaatgcaatccacttaagaaagtggacagactttcttacaccaagaaagttaatttagtgaatgtaaaataatgtcatttcggcatatgggcaagttgggtctcaaaaggcatgtcttttattccagcaattctaaagaagaaattcttcaggtgtgcaaacataataacaaggtttaatatgtatggagctctgattctgtgcttttgttgcaattgctgaaatatatacttagctcattaatgcacccttgatcctgtgaagtaggctctgttatcatccctgttttacagatgaggaaattgaggcctggagaggcttgtaactttccccagggcacacagctaataagtgagagacaggcaggcaggctccggggcacatgctcttagcttgtctatatcatgtcccattgcacagcgtggtttattgtaacattattcatgatagcagaaaacaggaaattactgaactgtccaaaagttaggaaatagtttttaagaaatcatggtacacccatataaacaagtgattcaaaaggatgacataaatctttgtttactgacataaaaagatcaatcattgaatgtgaaatggaagttacagagcagttcatataatatccttatttcacaatatatctcatatttcataatatttcataatctatttcaatatcatatttcatatatttcataatatatttcaatatcatatttcataatatatttcaatatcatatttcatatatttcataatatatttcaatatatataatgataaatattattccaagaatatatccttcttggaaggatacatatcaaaatgttaacagtggttgtttcatgatggtcagattccagggaacttaaaaaacactttattatgtaaaatttcaaacatatacacaagtgcactgaataatatagtgaaccattgtatactcaaaaccaagcttgtgccatctctatcccatcctgtgctcaccacctgtattattttgaagagaatctcagacatctaatttaatctataaatattttgtccataatttttttaaacaatgacaactatgttatcatattaataaccagaatgctgttatcatattaattactatcatcaaataaacagtcagtggtcaaatttccaaaaagttcatagttgtcataaatggtttctttgtttgcatgttaccatttgtttacatcagaatggaaataatctccacatgctgggattagttggtatgtcttttaggcctctcttaagcaatagctttccattccatctttctttttttccccttatgcaatttgtttatccaagaaattagatcagttttcctgcagagtttaagacaatatggattttgctgagttccttttttttttttcctgaatagtattccattgcatgcataaaccacaatttattaatctattcacctagcatttggattgttttcagttttgggtgataaccagtaaaggtgctatgagtattcatttacaagtctttgtgtgtgtaaatactatggattggaatggctgtcttatctggtaggtgtgtttttaactttctaagattagaatgccaaactgtcttccaagtggttttactacagtatgttaccaccaccaatgtgtgggagttccagttgctccaagtccttgtcaacgcttggtaccgtcggtttgtaaaatattaaccattcgaaaggaagtatagtggtatctcattgtgatttttgtttgcattttcctaatgactagtaatgttgagtgtcttttcatgagcttgttttcaatttgtataacttggtgaagagcctcttcaaattttacccattttgtaatgggtcgtttgtcttcttattgttgagttctaaaggttacttatatattttggatacatattttttatcagatatttgtttttcaattattttctcccaagctgtggcttgtcttcattttcttgacagtgttgtttggagaaaagaggtttttaattattgatgaagtgtagtttgtcagattttttcccttttgatttgtgctttttctgtcttataatttctaaatgttaaaataaaaaaaattaaagggatacatccatataatggaatattataagggataaaaagaaaatgagctatcaaaccataaaaaatgtggaagaaccttaaatgcatattgctgagtgaaaggagccaatctgaaaaggctacacactgtatgactccaactacatgacactctggagaagacaaaattgtggagtcagtgaaaagatcagtggttgctgtgggttgtcggggaagggatgaattggtgggtcacaggatttttagggcagtgaaactgttctgtctgatactataaaggaggatacatgttattacatgtttatcaaaacccataaaatatacagtgccaaaacggaaccctcctgtgaactatagactgactatccttaatagtaatgtcttcagcaaatgttggttcatcagttgttacaaatgttccactaaactaagatgttaaaaatgggagaaattgaagatgaggagaggaaggtatatgccaattctctatttttcactcaatttttttccataaaccaaaaactgctcaaaaaataaataaataaagtttatcaattaaaaaaagaaagagaaaggtgcctttgagtggtagggaagcctaatgattttttttaaggttttctttttttcttttcttttcttttctttttttttttttttaactttaaattccaggatacatatgcagaacatgcgggtttgttacacaggtatacatatgccatagtggtttgctgcacgtatcaacacgtcatctaggttttaagccctgcatgcattaggtatttgtcctaatgctctcgctcccccacccccaacccctcaacaggtcctggtgtgtgatgttcccctccctgtgtccatgtgttctcattgttcaactcccacttatgagtgagaacacgtggtgtttggttttctgttcctgtgttagtttgctgagaacgtggaggggaagcctaatgattttaaagtagcttaagtctctccttgttggacacctcagcattttggagcaattgtgacctcccctgattcccctcgtgcaggtgcatcaccacttctttacctccctagacttttaacttcaggctttttggtctctgtcttgactctcccgcctccaggcagttgtcacctcctgccaagcatcttccacagtttccctttccatctgtgcttcctgcttccccgtggcacacttaaggctcacctaacccctgacctgggctttccaggcctcctgacctaatgagcttcccacctgagaatccattccggtcctttatagcatgtagcgcgttcctctttatcctaatattcagggccttctagtaatcctaatattgtcttctttatggcagcaagaggacagtgatagggaataacttcaagtagcatgtgtgtgtcccccagttctgcattattagggcgatgttccatgatcgtgagtcattgctgtgttccagagaccccctctctacatggctagaggctaaaggtcattatcaagagtgaatactgccaagtcctagcaaacttggtcaagttactcatctagatgattcagaaaatcaaatcaagaaatggatgttacacagcaactgccagcattgctaacaccaaacaaaagataaccaagccaagtaaatactggaactggaatgaaaggagagaagaattacatacagtggaatggttagcgggagaatcagcgcttgcgcaggaaatggctggtccacggggaaagggaacagccccagctaagcttgctgttttatttttgttgtgtgtaaatgcatgacagcccagttccgagccaggataaaacttacaggctaggaatttgttttcacatactgtgttcctgtggaatcatttctaaaacctgcgtttcctctagactgtcaactttcaggaaaactgaacttaaaaaaaaaaaagtcttttaaacttctcctagacagcatcttacaaaatccaaaccctattaaaataaacactctggcctcaaatttatgctcaaggacaacttgttctggaggctgactacttagagcacattttgtaagagtggaaacctacagactatgctcagagccttttcagatgtttttgtatatatttttgtcctgctctatgcctgtgtaaataatactgattcaacagagttccaaggtgatcaccttggtacagaaagccatggccattttccaaaaccatgcctttgtgtaagtgccttgaaccttccggtaaattctgaataccttaggccctaagatcggggtttgcgttcggggtttgctttcttgttttgcgttctggtttcctggtgcaggctcccttctccttttaaaggtgccggcctcattgttatgatctggcttttctctttctctgcgtggaagcatttccttctccctgtgtttaaggttggcatgtgtgtgacttatcccaggctgagagttttgtagatgagatgggtcccggtccactaactgaaccctgagaattgaccgtgaccatgaatcacacagcatttctccccgccatgcaaaacccatgagccgtgcccagaagccctcaactgctggggactccctccatcatcatttgttcctccccttttagtgacggctgtgtgtgttcctttcccacattcgttctataggtgaacaaaggaaggctcggaggttttaaataactggtccaagttcattgaactggaatgctgactctctcacatctcaaaactcttcctaccaaaggagaaaaatgaagtctgagaaatattttactctaataagtgaaattttgaatattctgaagataaaagaacctggcactcctaagaagccatgttcaacagctgattcaagagtgctgctaagagttcaaaacatgcaggaggggagtcttcttgagacagagccaggccttcctcaattttgcattctgtgcatcagtgctcattgttgactggggagagaaatgagaagcagcaaagaggaaggaggtggcggaaagcggggaaaggtgtggacagaccttcctggcatcctactttgctatctgtacgctcttcctttctagattttcattatacttttgtcactttaataactgtcttacatataaactttttctttaatttgtgtactttccaaagcaaaaaacttatgaaaacaagacatgagggaaataaagtcatggagggctaaaaagctaatgctgttctgctaacattaggattagcataaggacagcacaaagttttgatgttaacatagaatttgattttgatacagtgaaaaatgctaaaatgtcaactccttttactgataagtaaacagctcttggctaactagggcaacagctgtacccatgagaattatagtactgtccaaaaatatttcaggtgcaaaagcaaaagtcctgattgcagtgtgtaacacactcaggaggctcctgaaatattactaacttcaataatgatgtaactcgacactgtcacccctttctcttcaggagtaagtaactctttattggcaagatctgacttggctagatctttaaagagtactggtagtcattggagacttccttctctatttatcacttaaggttgaccaagtagaagaggcattttgtttactcccttttaattgtgataaatttaaaagaatagcatgtccagaaaaggaaaattcatacttatggtctcctttcctcctggattgggactgaagtttttggagatgtcctgcaaaagctctgtagatctctgttggctacacaaaatggcaaaagccacagctgcagaaattgttgcaaacttttcatttgcttcatcatcaaatgaagatctctactattacttttgagtttggagttaaatgctggtgaccttcatctttatgctgaagctttggtgactgtctataccatctgatctacacaatgtattattacctttgaaatcaactctttttgtcccttgtggaaatgcacctctgctggggtgttttggtgctctatattgtcattaggtaacacccacttgcattaaaagactttgtcagggcccagcgcatagtcagtattccgtgctatcagtgtgtgttcagattctcctcttactggttttcttagactgtactgttttctaagcaaatgcccatgtgtgatttttaagatgtgctggggaaaaataaatcaataccacaaccaaaaaaaaaaaagactttgtctttagaaccaatttcccttccacttctaattactggttccttagcaaatgaatacactaactagccaataatatagatagatagatagatagatagatagatagatagatagatagatagatagatagatagatagatagatagatagatagatagatagatagatagatatagatattcattttagcctaggcctggtggctcatacctgtaatctcagcactttaggagaccaaggtgagaggatcacttgaggccaggagtttgagaccagcctgggcaacatagcaagaccctatctctacaaaaaaaaaaaaaaatttatcggggcatggtggcgcacacctatagtcccagctactcagaaggttgaggtgggaggatccctttagccccggaattcgaggttgcagtaagccatgatcaagccactgcacttcagcctgggtgacagagtgagaccctgtctcaagaataaaacaaaatcctcattttagagctagtgtttcatgcctttttcaaggggcatagaaaagtagcaaagagacctaatgtggttcagtgggaagagcacaggccttgcgacccatcaggaagtcaaggtgtagattataatcaaagcaccagctgtactactgcctgttattgatgggaccttcagcaaagtgctcaagttctcgagtcacagtgaaatggtgataataacgaccattacatcaaattcacagggcgaggtgaggatggtgtttgtgaaaatctttgaaaactgggagctactaaggttatttccagattccattgccttttttcagaaaacaactttattgagataaaattcacataccatacatttcacccatttcaaatgtacaattcggtggtgttggtatattcacagatctgtgcagccatcagcacagtcaattttagaaaaatcacctcataaagaaacccataccctttagctgtcatctccctggccccttccattgcctgtttaattttgattttgtgtttatttatagagactttctgataatttttaaaattaagttaagtaaaaataagattacttgtggatgacattaaaatactgtttcctatgaaaagtgtctctgtagggctttccagttaatgatctaaatgcattggcaggatgagggatgatgagctaagtgttaataaatgacactgctaggaagattacaattcaaatctatttctattttgagaagcagaaaagatggatgagtactcactgttactgttgaagtcacggtaccatgaaagccgctcattaaaccaggatgggtctctgggaaggcagggagagggaagagcgcgctgatgagcggaggctggatgggagctgcccccaggagtggatcttcctagcccaggaattccacaccaccaggaaactgctggactgttccttacctgaacttcctaagcccatgaattgggcttcatgcagcagaactagggaggaaaggataggaagaaggaagggaggaaggaaaggaaggaaggagaaaggagcccctccaggaacacctttattttgtgcacagcccaaagcaggagtgttgaagcagggtgaaaatctgtgtgtgcagtgttggctgtaggaaagggaactcacccttggcctcctttttgttgcaggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattagggggtgattcttaaaggacattaggattggtgctcagaaatggttaatcatgctgtgtgctagccagggccagctggtaccttctttgccatgagcattcaagggacggctaacctttattgacaatctatatcgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgg

SEQ ID NO: 16030 - DNA, 12163 bp, Human
ccagtaaccgcccggttccagacgaggctcctgccactcaggccgcggagtcgcagcgtcgcccagcccccggctcctcctccctgcgtctctcctccctccgctcccggctccccagcggataggagccaccaatcccagccacagacaacccttcaaacgaaatagcgaggcggccccctctaacgggcggcgggggcgctggccccctccctgcgccacatctgtcccgcaccgggcgcagcagctgattcatctgcagccaggtccgggaaggaactgtgctcccggcagttgcagggcagcgtccgggcgggtggcttgtccccaggaccgcgctccccccgagccgttttaggtgtgtgttctcttctgtcccgagcagtcagcaaaccacagaagaaaaaaatcgtaaggttgctgccttcttagagagacgctttttttccctgttgattcattttagtcctgtaattggaaaaaccacccaggctttttaaactctggcctccacgcattctaggggcgggggtgtttttttttttttttttgagggagggtggcaggctggctctaattcctgaaacagacgctccgaagtcgagttagttatcccttggccgtcttagtactcctcgggtttaatcttatttccacagagtttcttctgccgggatctccaccgaggttaccgaacaaaaacagcacagagcccagactggaggcagacccgggcgctgtctctgctaggcttatttacgtttagggcttttctttcctttttttaaagtgacgggggaagtctcattgtgtggcatgtgacagttcgtttgcttcaaaacaacaggacgtaaccacgcgaaaactagaaccagaggagggggcatgcgtttcttcaagtcagccaaacagcatctggtctttgaaagcgcaatttcatcaagaaactcctgttggatccctcctaactgtggaccaaaataagccaacaggaacgggtgtttacttaatggctagtttctgtttgaaatgggaggagggatcccctagcagggttccaatccgaagagtagacactgttgaccgaaacagacgagcaggcacggcgtggtcaccccttagctataaaagtggccgctgccggggttcggcgactcggggtgtcaggcggagtcttggtgaggcaggcgcgcgcccggccgtccccgggcagagacgtttaaagagcatgtgagcgtgacaagtgtctgtccgcaacgtgtcagatttcgaaactgccttgcaatccagtccggaactcgcagctttagcccgggggaacagacgttcgtttaggctgtgtctcatcattcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtgcgggggaggggcggaggagcggcggggcgggagggggacggggcgggcggctgggggcggaggcaggacctcctgtaccttccctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtaaggcggccgcgggctgcgcgcaccagaagacgcgagtccggggaaacgtgctggccgggccgcgccgcgcggagtcacttggtggacttttccgcccaggggctctcatgctggagtggcggccgtgctctttgttgaggctgcgtctgaaacggcagcggctgttttcctgctagacacaacacgaggggctgttgtggggcgagcctctccacgctgctggcacgttgtcaagaaacacgctcagcgccttgtttgtgcgcctgcaagtttcattgtctccgccgacaccccacgctcggcccagccgccgcgtggcttctcgctctttctcgcgtgctggggatatggggtccgagtagggaggacccagcccctcgtttttcccgatccggacccaggcggccggggccgcgggaccgccgcggctttgtctgaaagttccactcctaggctccccccgcccccgcccccgccgcccccctactcccagccgggccctagcactgttctttagggatgtggtgtttttacgatcgaaggaatgcgattctggaccccctcatcgccctcgggtgtaaacagctttggaaagctagacttttacaaatccccagtctctaaaagttttcccacgatgaattttggggcaggaggaagagttagcacccagggccagcagcttcaagcggcatgcagtcaaaatgcgtccaaatgtgacaagcaggcttggttgtaagtgcaaagagcaaggctgtcattgtttccacgaagtgttctggaagctttacaactaaaacttgccgtcagtttggtttaaaaacaaaatacaccggagggggacggggggtggagaaaccacacaaaacaccccgaaaggtcagagtgtgaagtcccttttgaagttaacaaaaattgagtccctggctgggaggtcccccgagtgttccgctgtgggctggaggtggcgtttctgtcgtgatttatgtggagtggttcaaaacagaagttaatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtgacgggctgaaggggaaactttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctgagcccggggtaagcttggtttgtgataatagtgtgtcctcccagaaagctgagagtgacgccaaaagatctcctaaaatgacttaaaaacaatgagaaggatcgataaggaaaatccactaagtctttttgctcccagtttttaactgttgaattcctgctttgggattgctctttggctggggtagccaaccataccttggatttggtggcttgagtgttcaatgcctgttgcttctcccaaggagatactgattttttttttcttttgttcctggagaccgggtctggctatgttgcccaggctggtctcgaactcctgggctcaagaaatcctctcgccttggcctcccaaagttctgggattacaggcaagagacattgctcccagctcaaaggagaacttctggtcaggaaacttgttgagttaaatttgctttttcctaattgtgcatctcgacttttcccatcaatcttatttctagagtctcttcacaaccggtgtctccctgcctccctgtctcatgatgttaccgagctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcaaaaaaaaaaaaaaaaaaaaaagaacgtgcaggaacaaggtcgctgcttagggcggtgggatcctcaggccatgttgtggctttctccacaacatttccttgtatgtggatagcgtgaaagaagcttgtgatcctgcccccaccctccccaccgccacattttttaaagtgtaagcaaagcaagacgtttggaaacaagtcttaaccgggaaacttttcaaaagcgctgttacaataggaaatgagtaaggaggaaaaaagtctttgtttttccaagctgagccacaactaggagggagagttttaatgaaaacagtcctgacagcagcaaacgtggttttactgcagtgaaatatcagctggcgtagccaaggcactgaagtcttaacttcctgttacttcagcttttgtgcacatattggaaatatttgttaagagttccagaggtctggcattcatttatttaaatgaactgagaacagagtaaagtcgcgctgcagtttggtgttgcttaactgaaacctgcttttgtgtgtcactaacctattctgaaagatcaggcttcttgtcaaactaggcaagcagatcaaagggcagccttcaggggctttttttgtttcaaactctttgtgattaccaacttacagttgggaattcactgttcaatgagcaaattttcacactttttctagattaaaaaaaggaaggagataatagccttgagaagaatgtctggcttttcagacgttggagagtttaaacaaattgctttattcaaatttgctttagtcatttaattaacttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagaggaatattccgtgtttatttcctgtcaaggggaactggctcaattaaggtcaagtcatattttcaaccaaaattacatactacagaggaaagaaagcatacaaagctaaaaatgcttacctttacatttttgttattttaattacttcccctaatatagaagtactgatttttttcaagcatgccattgtttgtaattcatttctgtttttaagattctagattgtctacaagcaaaagaatgtatttctttagtcattcggagtagcctgctgtagtttttgaaaggtggaattaatagcgtttgttatttaattttttttaagttcagaatgatgtttaaatatctgtaaaggccagttctggagctttattgaaccccgtccatctgtgatttaaatattctctatggcttgtgaattcttaaaatttctggcaggattaaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagggtgcagtgttagggggtgtcaccagctctttgaaaacctgtggacaacaagccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttaccctttaaaataacctttgttcagtggtacatttagttaaggcatttgtattcaaatgtagcatagtatttgcagagaaattaccttttaaaacatctcaaaagtgttttctaaaatgatgaaataaacggtggggttctgtctatggtgggattgtcagtttattaggtgagtattttccaaggtctcagtttgtgaaaaaatggtgctatgtacaagtggagtttgttgggatagacaatcacttacaaagcccagatggccagaagggaattggtgttgctcctttcacttgtatggttgagcagatttgtcacatgccacaaaaccattctttgtagtcatgcttagtatgagcttgctttgttgttacggtcatgttctttccagccctgccccagctatgaattgtctaagtgtgagggagcatcagagcttcagtattgtttaaagaatgtagaaaaatacaaatttgtctaattttgaaactattttagaaagtccctactgtagaaagagctaaactcaaagactttccttgtaagtgaaagaaaaaaactgctgatgattaccaagaggcgtaagaaaattaggtgagggaatgttgtgctctagcctgtggggtgcagcttcgtagggcacatcagcttagaatggtctggcctcacctcagagagtcacagaaatagacaaaaacccaaaaagtactagtaaagtaaatacaaggaacaaaataaacattaataaaaatgaatgacgcaaaggtgatccagaatcattacttgctccaacagctagatcaaaggctgaacattttgctttagtatagatgagggaaatgagcaagtcctaaaaggtttgccctgttacggtgtttcatcactcatactggaaggagaaggaaaggagccatatgactcatttaaaagaaaaactgtaagtcaccttaaattccctatgttttacttcattttttccctattgaggttgttacaggtcatggttgataatagttggtgttgaatgaatgtaatccattatttaaaaacaggtacatttaagtgaaaagataaatgtaaaaagctgttcatatcaaagccaaatagaaatgatttttatgcttataatttacatggtgcaatatatctttttaatttgtttacttttcacctatttgtgtttttgaagttcatcccatagcatatagtttgggtcttgcttttttatttagtctaatgatctctgccttttacttagcatttgtcaatttacatttactgtaattattgatatgtttagattgagtttaccatttggcttttttctttgctcctcttttcctgccttctttcaggttgaatatttttattatatatcattatatcattattattatatattatatatcatatattaagatatatgagaatatcagcattctcatatatataatgtctttttctctgattttgttttaatttctctttttaaaaaagtattctttttttttttttttttttgagacggggtctcgctctg

SEQ ID NO: 16031 - DNA, 19383 bp, Human
  misc_feature (1)...(19383): n = A,T,C or G
aatcaaccgttgaggtaaaaggatgcttgcaagtacaacacatgtatcagtgcattttaaactcattataaaatcgttctgtaaaccaaaaataaaattctacgcccagaaccatctgaaaagaccactcctctgggtcaaaggcattccaaatttaaccacaaaaactagttcaggccatgatgggaaggggagccagacatgcctcattattccctcctccgtttggaatttaggcacagctgaccagcattgacatcaacacaggcctcaagacaggtagaacacactctttaagtctgacaagaaacatttacaatctatctctctaaagcctgctacctggaggtttaatctgcatgatgaatccatggtctccacaaccccttatcttaacccagatattcctttctattcattcaaatcttttttttttttttccccatacggctctgtcacccagactggagtgcagtggcgctttctcagctactgcaagcaacctccgcctcctgggttcaagcgattctcctacctcagcctcctgagtacctggggttacaggcgtgtgccacctcgccccactaatttttgtattttcagtagagagggtttcactatgttggccaggatggtctcaatctcctgacctcgtgatctgcccgcctcgacctcccaagtgctgggattacaggcgtgagccaccgcgcccagccctctattgattccagatctttagataacaattctttcaaccaaatgtataaaaaatcaagttgtagcccaaccaccttggggacatgttctcaggatctgctgagggctctatcaccggccattggtcactcatatttggctcagaataaatttcttcagatattttacagagtttaactcttttcatcaacagttcccactccccagtgttaatgttataaacaattcagtaaaactgggaaatgtggtctattaaaaacttggggccgagtgcggtggctcacgcctgtaatcccagcactttgggaggccaatgtgggtggatcacctgaggtcaggagtttgagaccagcctggctaacatggcgaaaccccgtctctactaaacatgaaaaaaaaaaattagccgggcgtggtggcgggcgcctgtagtcccagctacgcgagaggctgaggcagcagaattgcttgaacccaggaggnnnnnnnnnnnnnnnnnnnnnnnnnnnnnnnnnnnnnnnnnnnnnnnnnnnnnnnnnnnnnnnnnnnnnnnnnnnnnctcggaaaagccctggcggtctttttttttttttttttttttttttgggacagtcttgctctgtcgcccaggctgggagtacaatggtcggatcttggctcactgcaacctctgcctcccaggttcaagcaattcttctgcctcagcctcccaagtagccaccacgcccagctaatttttgtatttttagtagagacgggggtttcaccatgttgtccaggctggtctcgaactcctgacctcaggtgatccacccgcctcggccccccaaagtactaggattacaggcgtgagccaccgcgtccagcgccctggcggtttttaatcaagtagaaaagctgcattataccacttgcttcggttgccttcagtgagaacgaagaaatggaaatgcaaatcccttattagttgtaggaaacagatctcaaacagcagttttgtcgacaagaccgcaggaaaacgtgggaactgtgctgctggcttagagaaggcgcggtcgaccagacggttcccaaagggcgcagtccttccccgccaccgcacctgcatccaggttcccgggtctcctaagactctcagctgtggccctgggctccgttctgtgccacacccgtggctcctgcgtttccccctggcgcacgctctctagagcgggggccgccgcgaccccgccgagcaggaagaggcggagcgcgggacggccgcgggaaaaggcgcgcggaaggggtcctgccaccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagaggtgacgccgcgggcccctgcgggacgggtggcgggaaggagggaggcgcggctggggagagcgctcgggagctgccgggcgctgcggaccccgtttagtcctaacctcaatcctgcgagggaggggacgcatcgtcctcctcgccttacagacgccgaaacggagggtcccattagggacgtgactggcgcgggcaacacacacagcagcgacagccgggaggtaagccgcgtcccagcggctccgcggccgggctcgcagtcgccccagtgatgccgtggcccccgaggcgggcgtcatcgggcagcgtttgcccagtgctggagggttagggagagctgcctgggcttgaccgcgcgccggtctcaaagtcctggctttggcccctcctccgttttcccctgtggaccattccgcttcgcagcgttttcaaaaactggagcgaaagtgatgtgggcggggcaaaggcggcgggaagaggagagcactgaagctggcgcgggaacttggtttcctggtggcctcccatccaatccccacgaaccagctttcctcttaaaccttgaaaagagaaattcgggagttcgagtataagttcttagtcgtcctttcctctttcctttccgacaggagcaccccaggcaaaaaatgtctcgcgggtcattggcgccaggctttcaggggacagtggggcggggcggggtgggcacaggacgttaggcagccgttggccctccctaaggccacaccgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaagataagtttttacacttttatttctctgtggctcgacacttctgatgcctccctttttgttcctgggacacatgcttggtgttgtcttcacacctttgtgacaggattagcactagtgggcagtggatgatagctcctcccttttgccacatgttcatccctgccctcgccaccatctcactgtgtggaattcctgtgtccactggtcaccggggcacagaagtgctgtctcagcctgaatcgggccactgatgggacttgcagcctgggagctccaccgtgatctctggcccactttgcgggagtctaggctttctggatgctccagggcctcacgtcccagggcagttttcttccctgaagaaagttggatggcatgatctgtcttcccatcttgaaaccgtatggcaaattgtttttcagatgaattccctctgctgacaaccaaacgtgtgttctggaagggtgttttggaggagttgctgtggtttatcaaggtaaagaagtcgctgctattagaagtcagtagtctgttctcaacacagcagccagtgagatcctttcaaaactcaaagcagccaggtgtggtggctcacgcctgtaatcccaccactttgggaggctgagtcagatcacctgaggttaggaatttgagaccagcctggccaacatggcgacaccccagtctctactaataacacaaaaaattagccaggtgtgctggtgcatgtctgtaatcctagctactcaggaggctgaggcatgagaattgctcacgaggcggaggttgtagtgagctgagatcgtggcactgtactccagcctgggcgacagagggagaacccatgtcaaaaacaaaaaaagacaccaccaaaggtcaaagcatatcattcctcaccctcaagcccttagtggctccatttcactcagtaagagccacggtccttatggtgtccgtttttcagctctgaccttagctgctgctctctgcaccagccctgctgttcttgtgagtttttgagcacaccgggacatccccactccctggaaccttcttcccccacacttggcttcttcctttgagtctctactccactcgggcaagccttcctagacctcctgatttaaaactgtgactctcccccaacctccttggtgtttctccatagacgaacatcaccatctgatgtatgtcagcctttcccttcccctgttagaagggggacagcaggtagtaaaagtgaaatgtgctgtaagctttatgagggcagaggatttgtttctcgtgttcactgttgtatcgccagggcctcaaacacagcctgccacatagtaggagtcaacatatattgatcactaaatgtagataccacctgtgttcccatgttcatataaattctagaagagtctcttcagtaacaaggtgaaccccttccagagggctgagtaggtacctcaggccggggccagagtgctgtgaagacaggcagcagcccagaccaagcttctctgtgttccgtgtcctggtctagaaccagcgatgttctttctgaccagtgctttttggaaggtggctgaggtctgggctcaggtctgggccatactagaagctgggatcccttctatagagcacttggtatggcttgtatggtcttggggcaagccagacccaagccctcttatcccattttagaaagggcttcaatttggatccagccccaggtctgccttagctctgtattcttggggtattttgttctgtattggcctatcttgactaacaatgaaccttggatttgaaacatatcatcagaaacctcagaagacaacattcttaaactggctagagcctggtctgaatggatgaaaaggagagacttttgaagcaatatgtaaaagattgagaaatgatttgttggaaatttctcaattggagaaatttctttgatttgttggaaatttctttgattctttctcaatcaaagaaaatcgggacaaactcaacaatagaaagggaggaagcaagatactcagaaataaaatgcattcccctgtttcaacttaatgcttcaattcaggattctaaggaatccttgccaggaatgtcagactcaccttgatagttggagttactccattggtgactcgatcaaatacaggagttgaggcacctgcactgtaaaatactgattagtctgatcattaggaatatcctgtatgccaggtagaagatacattgaacagattgcatgtaggcattaaattcattttggggtattacatatagacaacacatttcattaagaaacataaaactgtcagatcggtggaatacttaaaagcacttggaggtgtttagcctaaaaagcttagttgaggggaatggaagaaaagatctgggagggtggttccaaagaagggatcagactgtcctaaagccctcaggaatctgggctgggaccagcctacttaaagataggatgggcagctgggtgtggtggctcacgcctgtaatcccagcacttcgggaggccgaagtgggcggatcacctgaggtcaggagttcgaggccagcctgaccaacatggagaaacactgtctctactaaaaatacaaaattagctgggtgtagtggcgcatgcctgtaatcccagctactcgggaggctgaggcaggggaatcgcttgaacctgggaggtggagggtgccgtgagccacgatcgcgccattgcactccagcctgggcaacaagagcgaaactctcaaaaaacaaaaaaaaggatgggttccatatgggtggtgtcaagtgcccacctcctagcaagtcagcaggggccagaggcccttgtaagtggtgtctcggggggatcaactgagatggcttaggatttacctggatgcctgctctgctctccccatctcttccagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcaggtgaggagatagaacaatgccttccatttcccgggtgcccttcctagcatgtgtttgctccgttgttttagataaggtctgggggatgagtcaatgtcacaggagctgatgtatagctttgaccttgtgaggggtggtgccaggttaagccacaattaagcctcatgaaggccgtttcacactcttttttttttttttttttaattattatactttaagttttagggtacatgtgcacaatgtgcaggttagttacatatgtatacatgtgccatgctggtgcgctgcacccactaactcatgatctagcatcaggtatatctcccaatgctatccctcccccctcctcccaccccacaacagtccccagagtgtgatgttccccttcctgtgtccatatgttctcgttgttcaattcccacctatgagtgagaatatgcagtgtttggttttttgttcttgcgatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttaatagtcctttgggtatatacccagtaatgggagggctgggtcaaatggtatttctagttctagatccctgaggaatcgccacactgacttccacaatggttgaactagtttacagtcccaccaacagtataaaagtgttcctatttctccacatcctctccagcacctgttgtttcctgactttttaatgattgccattctaactggtgtgagatggtgtctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttataaatttgtttgagttcattgtagattctggatattagctctttgtcagatgagtaggttgcaaaaatgttctcccattttgtgggttgcctgttcactctgatggtagtttcttttgctgtgcagaagctctttagtttaattagatcccatttgtcaattttggcttttgttgccattgcttttggcataggcatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttttacatatggctagccagttttcccagcaccatttattacatagggaatcctttccccattgcttgtttttctcaggtttgtcaaagatcagatagttgtagatatgcggcgttatttctgagggctctgttctgttccattgatctatgtgtctgttttggtaccagtaccatactgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatggtcttccatttctttgtatcctcttttatttcattgagcagtggtttgtagttctccttgaagaggtccttcacatcccttttaaggtggattcctaggtattttattctctttgaagcaattgtgagtggaagttcactcatgatttggctctctgtttgtctgttattggtgtataagaatgcttgtgatttttgcagattgattttatatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgatgtgttgttgaattttgtcaaaggccttttctgcatctattgagataatcatgtggtttttgtctttggatctgtttatatgctggattacatttattgatttgtgtatattgaaccagccttgcatcccagggatgaagcccacatgatcatggtggataagctttttgatgtgctgctggattcggtttgccagtattttattgaggaattttgcatcaatgttcatcaaggatattggtctaaaattctcttttttggttgtgtctctgcccagctttggtatcaggatgatgctggcttcataaaatgagttagggaggattccctctttttctattgattggaatagtttcagaaggaatggtaccagttcctctttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtaatctctgatggtagtttgtatttctgtgggattggtggtgatatcccctttatcattttttattgcgtctatttgattcttctctttttctttattagtcttgctagcggtctataaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctctgttctcgttggtttcaaagaacatctttatttctgccttcatttcgttatgtacccagtagtcattccggagcaggttgttcagtttccatgtagttgagcagttttgagtgagtttcttagttctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgatttggggtggagagttctgtagatgtctattaggtccgcttagtgcagagctgagttcaattcctgggtatccttgttaactttctgtctcgttgatctgtctaatgttgacagtggggtgttaaagtctcccattattaatgtgtgggagtctaagtctctttgtaggtcagatgattggcacttactgggcgcttggcactttccatactgtgtcatcggcagatagctgcatggttggtgttcgtgctggggaatgggaagttcatcggtgggacaagggacaaaatgcccccattgctttgttgtggctttaatctccctttcgaggctgagccacagcgtgctgtaggtggcgctgctgtgaagcgcagtgccagggtcacactccactcccagctctgcagaggtggagaaagaatgaaacatctcactcctggacttccactttcctgtcactgttggtgtcacctcttactggatgtcacagagcccagcccctcccacctgtccctaggaaaagcagatgccaccttggaatgtggggtttgtgtgtgcaatttactagctgggcagagaccagcaacctggagagcaggtgtctcatctaaggggacagtcacatttcacctccagccacctggaggaatttgggcctggtgatgtcagaattcttcaataaaagcctaaaatctatattttatgtgcggtcatgagatctgttaaatgttagcaacttcaggaagtttaaaaatgctgtgtggacctagaataggcaagttcttaaaggcagaaagtggaatgctagtttccagggactggggaacagggaggaatggggagttcatgtttaatgggcacagaggttttgttagggatgacgaaaaagttcgggagatggtgatggagatggtgatggtgatggagatggtgatggtgatggagatggtgatggtgatggagatggagatggtgatggtgatggagatggtgatggtgatggagatggtgatggtgatggtgatggtgatggtgatggtgatggagatggtgatggtgatggtgatggtgatggagatggtgatggtgatggtgatggagatggtgatggtgatggagatggtgatggtgatggtgatggtgatggtgatggtgatggagatgggtgatggtgatggttgcctaacatcaggaacgtgcttaatgcttctgaattgcacacaaaaatggcaagtttaatattatgtgtactttatcacaatgaaaaaagctgctgcgtgggccaagttacttgtgcaggtaagtgttctgcaggtcgttgcctgcacctcagttgtagggtgtccgtaggatgtgaggccagtccccgggcttaatgatgctttaaatcctgcctagtattcaattatttcttgtcgcttaaaaggcctaataaaattatggtcttagtttacagtggtatgaatgcttagctgttggattttagtaggaaagttcgtccctttttgtttttaattttgttttacagattcacaggaattttttttttttttttttttttttttttttttaatgcacagaaagtttccctggacacactacccagtttcccccagtgataatatcttgggtaacatcctgtatacattcacattggtgcattcctcagagttgtcagattttgctagttttacgtgcacttgtgtatgtgtgtatttgcaattttagcacgtgtagactcttgtaaccactacaatcaagttacagaactacactaccaaggttcatctttttaaaatctttgatgttacctttttcggaacagtgaccatgagaggactttcctcccaaaattttgagaactactgaaccagaatatagtctgacactaataggtagaaatttaaccaaaggagattatgaagctctgcacttcagttaacaaatcacttctcagcttccagttccatctcagaaggaaggaaagggattaaaatccagagaccagaaatgggagcaaagtacaaggtggtgtaatcattacagaggtttcctgatgtttccaagtcagtcgtgtgttgagctgctaaactctaaagtaattttaggtggaagtgttggaaacatgctgctgaggtgatagaaaggaatccatggtcctctgttagttggaaagtatatggaatactatattctacataagatacaacactctctgtgagacaaggataaagtagattttgtcagtgaaattgtgacaagaatcgctgatgggtttagagcctaagtttgcgaggagcactggaagaaattaagattgttgagattggaaagggttagctatggggggaacaggaggaggtgactccatgacagaccaaatattcaaaggactgtgtagaagaggaaaaagactttgttagggctccagaggacagagccaggagtcagacagggccttgaactcaacccaccgagatctgcaaactttgcaggatgcaccagatgtcttgtagccatgggtcaaggggggaccctgggtaagagactgtaatagatgacctctaaggccatctcatgacatgtgtgattaatgtatgtacctgtcctctctttttgacaattctacagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactttcaccttcagatcatgaggttgggcccagaggattttttttttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcaccatgttggtcaggctggtcttgaactcctgacctcagatgatctgcctgcctcagcctcccaaccagatgatcttaatttgtgtatttatactcattcttacaccaaaaagggttttaaattgcctagaaactacatgtaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccaggaatttgaggctgtagtgagtcatgatcacgccattgcactccagcctgggcaacagagtgagaccctgaatatttaaaaacaacaacaacaacaaaactctatcaggatatcataagtacttagagtgaaatacttgcatctgtaatagagacttattttttttttttttttgagacacagtctcaccctgttgcccaggctggagtgcagtggtgtgatctccgctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttctttaatatgggaaaacaaattgcagagtttagtctctgattagcttttaaatttgatatgtgtaagtaagaaatgaaccagcttttactttgaaaccttcctcttctggaaggttttctggccctgtggtatacgcactaacagatctatacaggttgtttgtgatacagcttctatggattttctcaaaagctatgctgaggttgggtatggtggctcatgcctgtaatcccagcactttgggagactgagacaggagcaattgcttgaggtctggagttcaataccagcctgggcaacataacaagatgctgttgctacaaaaaaatggaaaagctacactaaattatttttttaaaaaaagccttgcggtgtctgcatattctaatgtttttaaatgatgttttaaagaattgaaactaacatactgttctgctttctcccccgggtttatagccaggtgactttatacacactttgggagatgcacatatttacctgaatcacatcgagccactgaaaattcaggtaagaattagatgttatacttttgggtttggtaccttctcttgataaaaggttgactgtggaacaggcatctgctcaatgctgtgtccaagataaagatgactgctccaaatgtggggcttcagtttagggagaagtggtgggcaggtgggcaggacaaggcaggcatctgcctcagcaaccatgggcacttaacatgtcaggtgctgtgaggtactaagcaccagtaccagagagggaagagccacattcaagccaggggattgtccaaaagggggcattttaactcattttaacttgaaggagaattgaagtgcaaatgtttttccttttcttttttttttgagatggagtctttctctgtcggccaggctggagtgtgccgtggtgcgatctcagctcactgcaacctccacctcccgggttcaagcaattcttctgcctcagcctcccaggtagctgggattacaggcacatgccaccacacccagctaatttttgtattattagtagagatggggtttcatcatgttggccaggctagtctcaaactcctgacttcaagtgatccacctgcctcagcctccgaaaattctggaattacaggcataagccaccaccctggccataaatattttttgttaattttacattaagtacaatatttaggtccaaacttcaaaagtctgttgaaatccctaagttatagcagccaacaattgatatgaaatggcaataaaaatgtaagttcatctgcttcatgagccttaaggaaaaaaactcagaaccagacactttttagccccttccaggttagatccaggttttaaaagttactcctttgagggagtttggctgcttttgagtggaggtgacttcaggcttattctctctggctctctgctctggtcgtttttagacatagtaataggttgtgacctgtcttcacatcctaattgccactgtctgttcatcccaggaatcctggctttcatccctttctgttcactgtccatgcatgtcatctttccttctttctgccagggacagatgggttagggattgtggaattcaagtaaacgtagagctactatgagttacagattgactgtgttcctgtctttaataaatttgccaagagtggttataagaacttacacctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctatttttgtaagaacatcctcctggactttgggttagttaaatctaaacttatttaaggattaagtaggataacgtgcattgatttgctaaaagaatcaagtaataattacttagctgattcctgagggtggtatgacttctagctgaactcatcttgatcggtaggattttttaaatccatttttgtaaaactatttccaagaaattttaagccctttcacttcagaaagaaaaaagttgttggggctgagcacttaattttcttgagcaggaaggagtttcttccaaacttcaccatctggatactggtgtttctttacagattcctccttcatttctgttgagtagccgggatcctatcaaagaccaaaaaaatgagtcctgttaacaaccacctggaacaaaaacagattttatgcatttatgctgctccaagaaatgcttttacgtctaagccagaggcaattaattaatttttttttttttgacatggagtcactgtccgttgcccaggctgcagtgcagtggcgcaatcttggctcactgcaacctccacctcccaggttcaagtgattctcctgcctcagcctcccatgtagctgggatcacaggcacctgccaccatgcccggctaattttttgtattttttgtagagacagggtttcaccatgttggccaggctggtctcaaacacctgacctcaaatgatccacctgcctcagcctcccaaagtgttgggattacaggcgtaagccaccatgcccagccctgaattaatatttttaaaataagtttggagactgttggaaataatagggcagaggaacatattttactggctacttgccagagttagttaactcatcaaactctttgataatagtttgacctctgttggtgaaaatgagccatgatctcttgaacatgatcagaataaatggccccagccacacaattgtagtccaaactttttaggtcactaacttgctagatggtgccaggtttttttgcacaaggagtgcaaatgttaagatctccactagtgaggaaaggctagtattacagaagccttgtcagaggcaattgaacctccaagccctggccctcaggcctgaggattttgatacagacaaactgaagaaccgtttgttagtggatattgcaaacaaacaggagtcaaagcttggtgctccacagtctagttcacgagacaggcgtggcagtggctggcagcatctcttctacaggggccctcaggccacagcttaccttgggaggcatgtaggaagcccgctggatcatcacgggatacttgaaatgctcatgcaggtggtcaacatactcacacaccctaggaggagggaatcagatcggggcaatgatgcctgaagtcagattattcacgtggtgctaacttaaagcagaaggagcgagtaccactc

SEQ ID NO: 16032 - DNA, 10233 bp, Human
caggggtaagggacagggatgctctaaacatcctacagtgcacaggtcagcatcccacagcaaagaataatctagcctgaaaagtcaagagtgcagccattgagaaatcctgagctagatgcacagactatatttggcaggtgggttattcttgaagtctacagcttcaagagcttcctaaaccccttttcaaatgtaggctaagttgagagtctggtctggggaaagggtccacagcttttatctgattcttaaaaagatccgtggccgaaagaggctgaagaaccaggaaaaccaaggggtcagggaccttggctgaaacagattatttcactcagaaaattatcaggaggtgaggctgggtctgtttgctggagccagattatagtaaatcttgaaaaccaggcagagatagttggacatcaacctgaggtctctgtggaggcacagaagacctattaggaagataatggcaggacaaaaactgtgtcacaatatgaatgtcttgaagtggcttctctacttcaactgcccaagttcccttcaatcaggctgcaaaacttagtattcttatggagtggactaaactatatccaatcagtcaccaatccatattaattttttttctcaaaaatatattttagtctttctttccccgcttatcagggtcaacaccctattctaggcccagctcatcttaatcttggacaactgcaaaaccttccttagtgagtccttggcttattcatctttgcaaattgagcactggatatacttcctggcatgtggcagccattccgtaaggtacactctcaagtgagggtgggaggagaaggttgtagaatccccccaagttacagtgaaaacaaattacagagtgatttctcattagtcccattatggggaacatgcctcatccacgttcttaatgaggctccagtaagtctgtagactgtttggggctgagggtggggcattggtgtgaagcagaagtggtgcttcacagtaagtgttgggataaatccaacaagctgagttccccagggactgtgtcttccaccttccccgcagccacaggaaggtaatcacggataatcagcctgagaaagaggatatgagagttttttgaagtctacaaacctgttatttgccgattccaaactcatttcttaccagactatcctcaggctaaatttccttaaataccaagtttcgattatcacttttcacacttaaactctcaataagtcccaactctaaatctaaattgtgcagctaatttttcttggccgagcacggtggctcacgcctgtaatcccagcactttgagaggccgaggcgggcggagcacgaggtcgggagatcgagaccatcctggctaacatggtgaaaccccgtctctactaaaagtacaaaaaaaaaaaaaaaatgccgggcgtggtgcggacgcctgtagtcccagctactccggaggctgaggcaggagaatggcgtgaacccgggaggcggagctggcagtgagccgagatcgcaccactgcactccagcctgggcgacagaacgagactccgtctcaaataaataaataaataaataaataaataaataaaaataaatatatttactcttcaatttggtcaataaataaacacgagagggtacgagaaattacttaaaaaaaaaaaatccccgcagaatccaacaatctctgaagcctttaacacctaacaaccccaaggggagtatttcggctcttggactgtatttcaaagcgattggaccccagaccattcccccagttactcaaaagatccagcctctcctcaggtgtagcccgctctagaaaggccgcctcgggagtaccacccactcctgacggggcggggagttctctccgaccccacccgttccaaggacgcagccctgtgattggccatgacgcgtgccagagctgcccagtcgcggaagagcagctgttttggcgtctgtttgctgcggtaggaacatggcggatcggctcacgcagcttcaggacgctgtgaattcggtgaggaatttcattcgattagcctctgtctttctctttcttgaggtaaagcaagggaggaaaggggcccaagaggcaaaacttgaaagtggggagcggactgagagacagggcttcggcataaagcgctctctcgggaggcgccaccgcgaactcggaggtttgaggccggctgccgggcggtgcttgaaggtgcgggagggagcagactctttcgcttgaggagaccgggaagatcgttcttgtccgggtgaggccgccaggacttgtgggctgcgcggtcctgtcgtgttccctgaggacagttttattttcttgtcagtggtgcttacgggttctctttcttttgggggttgggaggagaagcaggagcttttttctttcctcatcaattttaatccaccaagggagatctcatgctctggatgactgggtttttgtaatgaaatgtcagccgagagtattccttcaccagcgctttcaggttggtgcgggagcgatgctgaggtgaggtgagagattttctttcatcttagctcgttcctttgggcccagagtatccttccatctcttgcctcttggccatccctcagaatacatcagtttggggacatctttatgataggaaatcttctaatcctcgtatgtctttccgcttatttgagtcttttttcttttctttttttttttttttttttactttggagacagtgcctttcgcccaggctggagtgcagtggcgcgatctctgctcactgcatcctccgcctccccggttcaagcgattctcctgtctgagccaaagtagctgggattacaggcgccctccaccacgcccggctaatgtttgtatttttagtagagacggggtttcaccatgttgtccaggctggtctcaaactcccggcctcaagcgatcctcccgcctcggcctcccatagtgctgggattacaggtgtgagccaccgtgcccggcctacaagtcctttttaatgtctcccccaaattctactctctattaaaggccaagtctagtaagtagctccccagctttgttccttctggttatttttcctccacactatgcctgagtggaaagtagaagcaaagccagaggatgcgcagtcatgggcccctaatgaaggggtcatgttctgagaaatgcatggttttggcgataacttttttttttgttttaataagtagaagtacaatgtaaaataacgataaaacagtaatacataaaccagtaacaaagtcatttagtatcattatcaagtgtcatggactgcacataattgtatgtgctatgctttcatacactggcagtgtggtaggttgatttacagcagcatcaccacaagcactaaggaacgcattgcgctacagcgttagtactgctacgatgtcactaggcaataagaatttttcagctttattataaccataggggactgacataatatgtgcatcccgttgaccaagacgtcagtgggtattcccatgcggcaatgggtgtacttattaccattacgagttagattgttttctgctaaatagttttccattgatagttatgtttctcattgtctgattgtgatttaatgtcctagataaggggctagagagaaaacatgctgataggaaaacctaagtacctggtttccttgccagttttttttttcctcactgtaagctaataacttggcatttttcttaatacatcagaatttgtacacttgaagagtgtgaatctacttgtgataaaactgatctaccctgggtgaataacactagtttttaagctgagaggaccagcctctaagtgttgaattcaccaagataaattctaccctgcagggacttgcctgggctgccagccagccttcctcagggaactactcctttgaggttttacgaaatcaaattgtaatgatgctgctggatagaaatcttattttagggaaaattttgcatattcatacatgtcttgtaactagaaggataataaggacagagtgaatatggccttaactccaggttaggcataatgataattggattttggagaaaagcctttaggataactagtatgagtgcctactgtgtgtaagcaccatcatgtttacaaagagatactcctaaaggaggttaaaaaatgtcaaatactcaggagacatttaagtgatggaaaaacagtatgtggttagggagttataatgaattgagtattttcagcttcaggttctgatgtaaattggaatatggagtgatgtgaaccaaaatagggggaatcttcttagcatttatcctaatcagaattatttgtataacttttaacatttgttctaccctctgaaaaccgtgagtgcagaagctatgtcgcattcactatgtctctgtagtgtttatatgcagtactttagttattttccataaatttttgttgactaaatggatcttaaaagcttttgaaggatggaaaagatagacactgtgttgaatatttttttgtgtgtgtttcctctattacaacaatgctataataggagaatgtatccaatttaaaaatgaaaaatgctgcttggattaatagagctaggatcaggatctaggtttgtatagcatctgagcacttattgctccattacaattagcaaaacctgggcaaagccatttagtcataagtgactttatgactagttagataaatatgaaggagtagtggaaaacgagtcagtagagttgacttagattattgaaagcttcaaaacagcctgagttggagatttatcttgaagacagtggtggagtaagcttaaatgttttgatcaggttaaaataaataacctggtgaactggaaaacaacaagaagactattgtaataattctggtgtgagataattggttgaactaagcaacagtgatagaaggaaaagagaaagatttgtagtattagcagaatatgaagatcaaaggaaagtaagaatctgaagttagattggttgactaggagactttcaatacaaattaaatattaaaaagaggaaacagttgcctttgagttctgtcattgaaacaatggcagagaaacccagtggaaatacttattagaaataggaggtttgagaggtcaagactaggtgagagaaattggtagggaagataggtgtatttaatttggagatggtaaggaattgctattcccaatctttaaaagtacttaaggaatacttttagagtacaagagtttacaaattgagtcttgaacaaatacatttctgcttacttaaggtgcttttctgagcagcctcttcctcactatttctttacacttgtaactactccagtctcagaaaaggaatcatatactttgtgcatgagaaataaatttttattaaacatggtgccatagatatttacaagtcaaatttgctcttttccatcactatccccaaaaagtctttacttgtggcttacaataagtattggccaatattctcttatcattttactatcacaagaaaagaaagattattttgtatttcaactgtttcaactagatttatatcaaatttaactttacctagattgataccaaacttagtttctttgcagaattaaaacgtttaatcaacattaataataactggcttattttatcaacaatcactcctttctgttttattcccttgctcagagattatcattacagaaacttattgttgttgccattaccaataaagtccttaaaactgataagtcctttctaaccttgatatgttttctttggcctaagcttgcagatcagttttgtaatgccattggagtattgcagcaatgtggtcctcctgcctctttcaataatattcagacagcaattaacaaagaccagccagctaaccctacagaaggtaaacaggttttcttagcttctcttagtttgactctcacattttttgtaatcctttaaaattagatttcttgagaaattcagcttattttatttctaaaattattgttgtttgagaatattacaagttttgtttgttgtaaaaaatttacagtcaattcacctaacatctcataattctggttcatgtcagataatagattgttactcctttagaggagaatttgtattaatttagctgagtgagggaccttaacaaggaaggcatcccatttataaatttctttattcaggtgaccactatattgtcataataaatgaaattacatacattatgcttaattcccaatttgagctaaatgtgtaacaggattggtgtatattttaatcattagaatcttctttttttttttgagacggagtctcgctctgtcacctaggctggagtgcagtgatgcaatcttggctcactgcaactttcgcctcccgggttcaaggaattctcctgcctcagcctcctgagtagctgggattacaggctcatgccaccacgtctggctaatttttgtatttttagtagagatggggtttcaccatgttggtcaggctggtctcaaactcctgacctcgtgatccgcctgccttggcctcccaaagtgctgggattacaggcgtgagccaccacgcctggccgaatcattagaatcttagggcagaaaaagctatatgaagtttctggtttcattaacttaaaatttgtttctgaaaacttgaggttttctaatatcctaatctagcagtatctttctctagagtatgcccagctttttgcagcactgattgcacgaacagcaaaagacattgatgttttgatagattccttacccagtgaagaatctacagctgctttacaggtaagcctctattcctttgagaattttaccagtaatagagaattttgaattaaaggaggtagatttagtaccttttgtctgtgtccatttgtgctgctataacaacatacctgagacagtaatttataaagaacagaaatttattttctcacagttctggagtctgggaagtccaagatcaaggcatttattactcactgtgcatgagtaatgaatttttattaaacatggtgccatgtttagggccatgttgagggccttcttcctgtttcctcacatggctgaaggcagaagggcaaaagagcaagagctccctcttcaacctcaagccatattttaagggtactaattccatctatgagatctctgccttcatgacttaatatcctcttaaaggccccttccctcttaataccatcacattggggattagattttaatgtatgaattttggaggggatgcattcaaatcatagcaccttttgttataatattcaaatttccattataaggaaacctcttattttcctcaattttgtctcttttcctagtgaagaatgagaggagggtggcattctacaattggagtagaataatggtgtctaaacgtaatgtgtaagggagtcacttaaagatatctagagatctctaattgaaaagtcattctttttaataattcacatggggaaaattcttaaaagttgtctgatttttagaatttctttactgaaaaacatatcacaatgattgcaaagtcatccagatttaaaaataagtacatctgtgacagcttctctttctaaactctaaagattttaaaatttgtgtcttataaaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttgggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaaggtcaagacatttttcaaatgagggaaaactaacaggatttatcactagtaaacctgctctaaaagaattcaagggaagctttttaaaaagaagggaagttatagcagaaggaaacttagaatggcaggaataaagaaggcataatgtatagggtaaatataatagacttctcttgaggttttaaaaattacatttgttatttgaaagaaaaaaattaacgttgttgtatgtgattctctgtagaggatatacagtttttttttgttgttcttgtttctgtttttttaaggtgaagtctctgtcacccaagctgaagtgcagttctgtgatcatggctcactgcagcttcaccctgggttcaggtgatcctcccacttcagcctcttcagtaactgggactacaggcatgtactaccacgtccagctaattttttttttcttttttttttagagatggggtctcactctgttgcccaggctaatgccaaactgctaacctcaagatattaatactatacagtagactataagaaattaagtatttgtatcatccctagagcgacacagatttttccctaaaaaactacagattattttcaaaagcattaataaattaaggtggaatactaaaaaagattcaggtaacccaggaacgagaaacagaataaaacaatagtaaacctaaattttattttatttcattaatacagcaataattaaatgtcaatgatctaagctgatttaaatctaaaaactggataagaagctgtggcttgtaattaaaaatagacctttattcactagacctacagtttgcttttttcatatgttaagaaaagtttaatatcctgcttctctatttcagttctaggggcaccactatcagttaaccctaaagatttctgtgggtgaaaccattttgattaccatcttgctc

SEQ ID NO: 16033 - DNA, 7649 bp, Human
  misc_feature (1)...(7649): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactgcaacctccgcctcccgggttcaagcaattctccctgcctcagcctcctgagtagctgggattacaggcgcccaccaccaagcctggctattatttgtatttttagtagagatgggggtttcaccatgttggccaggctggtttcgaactcctgacctcaggtgatccacctgcctcagcctcccaaagtcctaggattacaggtgtgagccactgcacctggccgttttttttttttttttttttttttgagacagggtcttgctctgtcacccaggctctcgagtgcggtggcacaatcatggctcactgcagccgtgacctttcaggttcaagtgatcctcccacctcagcctcctgagtagctgggaccacagatgtgtgccattatgcctagctaatttctgcatttttagtggagatgggttttcaccgtgtttctcaggctgatctcaaactcctgggctcaagcaatccttccaccttggcctcccaaagtgcttcccctctcccatgtttccttcatcctagcctgcttccctatactgatatggcacggtatgtctgtgtgcgtgcacatagacacaatgtctgaccgtagagatcaggaagaccttgccaaatctacttggaatctcttgctgacggcagggaaaacagatgcaaggaaggtgggtgtcagggaatagggaggtagcatgaggagagggactgacagaagaagataaagacacgggtgagggtttgctgagaattctaagctatccaagcagaaagggacctccaaggtcaatttgtccaactccctggttttacaaatgaggaaacagaggcccagagaagtgagatggcttgcccaacatcacactgctgctttgtggcagagctgcaactagaacccaggtcaaaagaaaagggactggagggcagtgtatattcaaggctctaaagagacattgcccagaaggagaaagagagactgacactccacagaaagaactgatgaatgtagacttccagtagaggtttggagtatgaagatacaggggcaggaggggaaggtgcctagaagacattatagtcaggtagagtcaggttctggacctcatcctgctattatttatcagcttcagtctcagtttctgatgtacctttagaatctttgtgaaaaccagtcttttttttttttttttttttgagacatagtctaactctgtcagccaggctggagtgcagtggcgcgatctcggctctctgcagcctccacctcctgggttcaagtgattctcctgcctcagcttcccgagtagctgggactacagacatgtgccaccccaccacgcccagctaatttttgtatttttagtagagacggggtttccatgttggccaggctggtctcgaactcctgacctcaggtgatccacctgccttggcctcccaaagtgctgggattacaggcctgagccaccgcgcccgatgaaaaccaatcttataaactaagcttgcaataccagcacagttcttaacaagtgcttactaagtctttactaaggttatattacctcagaagaggaaagacttctgattgtatgggttaaggtatggcccaaatgaccctgtgaggacacaggacagaggtccagtgtctccagagcccattccttctgtgcctctgctgcctgcaactgataaacctcttatctggcccaggcaggggagcccagggccaggataggaggagagggcagagctgctatcaaccaccaggcctgggccatatcttggagaggaggaggggctgtctgcttgcctctttccacaacttgttcttggggatcctcaagcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtaaagacctcctgtgctaccaaaggaactgactgtggccatagttggcgaggtggagatcacaacacaggaaaagactttccatcttaagggattgatgaatccagcatgagtgaggatggggaggaggcggtctctccttccctcaggggaagctggagggagcccctccaaggaggtagtgcaaacttgctgaccctagcaggtgtagctctaacacctcttttcctttgacacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcaggtgagtaaggggggatagggcaggggaggccgtgtgtcggagaagagagaagcagggagttggccaggactgaggcagagggcaggagcaagcagggctcagggctggtaatgctccaggcactgggaaaggaagggaaagatccggatggaagacactgaggaacgttgaggaggaggagtggaggagcagtggtggggagggaatgatctgattgggagtgtaggctctctcagcagccacttgactcacatctctctctaccccacctcctgctctccctcccgtgctcaccttcttctcttctgacctgcctctctgatcctgccatcttcttccctcattacctccgcctgcccttggcaactgggcccgtttaccccaggtaacagagcagtagttcaggggcctcaggaaggggagtcggactatgccagggtcctctcctcctgctacttggacaaaggggtgtctgttggcttgacaatgatgcctttgtccccagctgggctggagcagggtggctccctgatgtaggttgggggccttgtttctagcatgttctctacttctcgctgcacctgggcagggacagagggactgaagaggagaaggcagagcttgtgctggctccccaaggtgcttcttagcccccagccaccccccttttactaccctgctaccatgcttagcaccctcaggatctgccctaggccctcttcccacacagcggctccctctgctgggcatctggggcatggccaggatctgaacttgaccctttgaccctagataactgcagcaggaaagggttctgaggggtcatcttggataaaaaggctttgacttcctgaaggaaataaaggaacatgagccatttcttttttttttttttttgagacggtgtctcgctctggcgcccaggctggagtgcagtggtgcaatcttggttcacatcattctcctgcctcagcctcccaagtagctgggactacaggcgcctgccaccaccccagctaattttttgtatttttagtagacagggggtttcaccgtgttagccaggacgttcttgatctgatcctgtgatccgcccgccttggcctcccaaagtgctgggattacaggcctgagccaccatgcctggccgaacatgagccatttcaacccagtaagagcttctccaaggagagttcataattgttccaatgttaggtagtcttttctgcagtccaacctcagtgacttccattcttgctaaagctgcatttttcattttttctttttttgagagggagtcttgctctgtcgcccaggctggatagtggcactatcttggctcacttcaacctccacctccggggttcaagcagttctcctgcctcagcctcccaagtagctgggattacaggcattcaccaccatgcccggctaatttttgtatttttagcagagatggggtttcaccatgttgtccaggctggtctcgaactcctgacctcaggtgatctgccgccttggcctcccatagtgttgggattataggtgtgagccaccattcctggctttaagctgcatttttcttgcaacaactgtatcataactttgcaggaagcttcccgtgatttgtggcaactttgtttccttgttactacctcactgcgactttcagaagaatccagcttggtcctgagagagtgttggtttctcttccttagtctgtctccaaatctctttgtgtctttccttgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaatggcttttcactgtgtcttccttcttgagggagggtggaagctgagataattatctgtttgaatcttaccaagttcacttcattctccccagagctctgtatgagaggtaccataaaatttgggcttgaggctgagcatggtggctcacacctgtaatcccagcacttcgggaggccgagatgggcagatcacaaggtcaggagttcgagaccaacctggccaaaatggtgaaaccccatttctactaaaagtacaaaaattagctgggtgtggtggtgcacgcctgtaatcccagttcctcaggaggctgaggcaggagaatcactggaatccgggaggtagaggttgcagtgagctgagattgcgccactgcactctagcctgggtgacagagcgagactccatctacaaaaaaaaaaaaaaaaatctgggcttgagcagtatggggatctaccaccttcacctccttttcagagtcagaggccatggatgatctgaagaaccccacactccctggtggtgccctatttgtagagcttggagagctgtccaaactgactagacaccctgtgcaaaggttcctgatgtttacgtctcttttctctcaattctcccagcacaaaaaagcccaggatgcccataggcctttctttttttcttcccctcctgcttacctctcagcctgggtcctcctaatgtgccagagttctctcagaagactgaatgggctgttcttggctggaatttatacatcaaaatttcagaagatttcacaccgaagctttggtaaaacctgctccacagtggagtaaactatttattcctgtgaaacgttttctctgattatgttagacaaacactacccagatcttttttttttcttttttcttttttttgaaagagagttttgctcttgttgcccaggctggagtgcaatgacacgatcttggctcaccgcgacctccacctcctgggttcaagtgattctcctgcctcagccttcggagaagctgggattacagacatgcaccaccatgcccatctaattttgtatttttagtagagacaggggtttctccatgttggtcaggctggtcttgaactcctgacctcaggtgatccatccgcctcagcctcctaaagtgccgggattacaggagtgagccaccgtgcccggccaacactacccaattcttgttttggggccctccttttctagatccttaaagatttttttgtttgttttctttgagacggagtttcgctcttgttgcccatgctggagtacaatggcgtgatctcagctcatcacaacctctttctcccgggtttcaagtgattctcctgcctcagtctcccaagtagctgggattacaggcatccaccactatgcccagctaattttgcattttttagtagagatggggtttctccatgttggccaagctggttttgaactcccgacctcaggtgatctgcctgcctcagcctcccaaagtgctgggattacaggcttgagccaccacgcctggctttttttttttttttgagacagagtctcgctctgtcgcctaggctagagtgcagtggcgcgatctcagctcattgcaacctcaacctccaccttctctgcctcagcctcctgagtaactgggattacaggcgcccgccaccatgcctggctattgttttgtatttttagtagagatgggtttcaccatgttggccaggctagtttcgaactcctgacctcaaatgatctgcctgcctcggcctcccaaagtgttgggattacaggcgtgagccactgtgcgcagcctagatattttttattagtctattttgcttcttcttgaaacagaatataattcactaagtttcagattccttacccatatcagttaaagtccagtcaaacctccctgacaggacacaatctccttgcttggagttgtatagtctccagtattcccagtcactgaattacacagcttacct

SEQ ID NO: 16034 - DNA, 16344 bp, Human
tctattcaatagggtaagaacaccttacagggttgttcaggattaaaggtccggacagtagtcaatacatgttttcctttcctcactctctcttctatgcctttgcataggaaagaggaaactgagcacctacttgcaactattttgaagcttaaatgaggtaatacaaagggcctagacaatgcctggcattacaataagtgcataataaaagcattattattctcatctcatacgtctttccttcttgctcactgtggctcctggcccatctcctttctgctccttgaaggtgccaataaaagttgaaagaaacagttcattcaggacattgtagaaaaatggtgatgattcgatttcatcccaagacaatcagaatgtgcctggaacacagtaggcattcagtagctaagttgttaaattactatatgacagggcccaaggtctatgtgttaccctaaccctaactcggttaatctacataacctgtgagatgttctactcttcatctgggaagcatgctccagatcacacatccagtaatggtggaatcaagatatgaggtcagcacctgtcactgaggtctatctgaagctacttaatgactatactgcctctgaatttagtcaaagtccctacatcaattgtcattaaataccatttatggctgtctaatgctctgaacccagcataccttcctaacctagtttcctaatggccccttaggagttaacaggcccactgcaaacaccacatattgataaataactgcaatgtgctgtagtatatctggaacccctgtcattcccaaaagaggtactttctgtaccttccaatgttcctcctcctccatccacttagaatgccatccatctttgtgattataaaaacgacatcacgttttcttagtactaaactttgcccgtggaaagtctcccattcttcaaggctgggctcaaattccacatccttctcgaggccttccccgtgattcctccctccataaacttaacaatccattttcctgaaccccatcacatctgtttgcagttcacccgcaagcaggcgctttatattctttagcacgccacctggtatctcaaagagtctttgtgcacaacaaccattgcctgaataaacaagaaaaaggaactgtaggtaggagcttggtgagacaagtaaagaagatggagagtgattaaggataatggagtaaaaatatcacaaagggttctcaaaaagcagggagtgaaaaatgagtactaaacaggctcttcgagaaaagttttttcttgggctgcctttgtgcagcctaggggcagctcacctgaaccagaagtcccagccagcctcttccggggtctcgacatggtcacgctgcaggggactttagtgcggacgattctggaatcaacggagatacaagaaagaatgctaatgtcctccaaaacccgcgcagagcgagatggaggcaacgagaggcagcctagaacgtctccaacttttgcgaaacacagacgcctacgtttgagccctcaaatccttccctccgttatctgcgccatttccatctcgcataacctgcccctaaactcttctcggttctgtccttggtccttctcatccaggaacccctatctcagtatgtagttcactgggaagtggctccacagagacacttttgttgggtgaatataagtaagccttgtgttaccttgttatccttgctaattaggatcaactgaatggataatctagatgatgaagtaatttgctggctacagacccaacactctgcagactcgactgcggtccgcctccgctgcgccgcaggctgtgcagcgcgacccccgcggcgcttggtgggcggtgcatctctgcggcgccgaggccccgaggacttctgggaattgtagtcctgtccccttgggagcccgcctggcacctgggttgttagggctcgtgggaggactacaacccccagggtgcagtgggacaggcgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgtaaggatctcctggcgggcagtaggacaggtgtccagaaccccggcggacatatgtccgcgaggggctgcagtctccccgttccatccagtcaccccggcgtcagctccccttccggccagtcacccccccggcctggctccctactccggccggtcacccccggcctggctgccccctccggtcggtcaccaccatccgggtccccatctggcccgtcacccctgcccgggtcctcctccggccggtcacccccgccccggtcctcctccggccggtcacccccgccccggtcctcctccggccggtcaccccccgcaggttcccctccggccggtcatccccccgcaggttcccctccggcccgggtcctcctgcggccggtcaccctcggatgcttagagaagtgaagaaacttggggcttggttgttgttgggttggttggtttttaatcataacagtaggtcataaaagcagtgagaatataagaagctggctgggtgctgatggtgacaactgcacaagaactccaggtcatacaagatttgctcacacacaaagatttggtatcttaacacctctggctataagacacttttagtgttgaaactcatgcaggaaaaataattattattgccagtgggaaactctaccagagctgacaaacttgagtgtctttaggctctgaacagtaatttgaatgtagcgaggagtggtggagacccggccagtttgtgacttctctgccaagaatgtttataaacacttttttcttctgaaatatttttaaatttattttaaataaatggcagttttctttacaacagaataagtcccttagatatcagatctataaagtacagtaaggcatagaatactgttttcttctgaatgtcctaaaactcattcaagaggtgctgccctggcctagcgcttagaatttgataacccagattaccctggttgataccgaagcagataaggaattatttagaggtgggttttgttattgtttgcatcttgcttacacttgagtggctctgcagtcaaaggcttttcccatttcatttggagtgtttttctatttagctttacctttttagtgtatatgtattggcatcttgagctctgctagtaactatgtattggcatcttgaactctgctagtaactggcaaagttcatgagtggtggtatttgttttgtttttatactgtatttccttctgggaacttgtgtttacttatgcatatgatttgcataaaactatttccttccattagaatgcaactcagatttatttcttaagcctgtggttccttgaactatttgttttaggaagtagccatttacagaagaagaagatttgttaacatttaatgagctcttgctaggattgaaatagtcatcctttgtgtgaatggatcttatttatttatttttttgagatggagtctctttctgttgcccaggctggagtacagtggtgcgatctcaactcaccgcaacctctgccccacgggttcaagcaattcttgtgcctcagcctcccaagtagctgggattacagcacatgccaccatgcccagctaatttttatatttttagtagagacggggtttcaccatgttggacaagctggacttgaactcctgacctcaagtgatccacctgccttggcctccccaaagtctgggattacaggcatgagccactgcgcctggctggatcatatttatttttgtaaccccagcactgctacctagtaaacacccaataaacattcttttggaaatgatctttgagccatggtctacagtaacagcaacccttgtacaaaattgtgtgaataaatggcctgaccccagtcagagaaccatgaattgtttatccctaactctgttcctgagggtaatacccaacataggtttctgctctgagtttctcaaggcagcctaatcgttaatcctcagaactcttcatttctgactttcccattttaatgagagtactgatcacagaaagcagtgccctctccaggctcgcatagccagccattactgatgcccagatttgccccaaggaacagactctggcacctgcccttgtgttcttctgtgaggactgcatcgcttgtaggcactgaagtaaattattgccaagtgtggcgccatagtcttcccatagtgctcttttttctttttttcttcttttgaaacagagtcttgctctgtcacccaggctagagtgcaatggcacaatctcagctcactgcaacctctgcctcctgggttcaagcgattctcctgtctcaccctcccaaagtagctgggattacaggcatgcgccaccacacccagctaatttttgtatttttagtagaggcggggtttttccatgttggtcaggctggtcttgagctcctgacctcaggtgatctgcccgcctcggcctcctgaagtgctgggattataggcgtgaaccatcacgcccagcccatagtgctcttcagtgtcagttataatgaccaaagttctagcactgtggcctcaacctctaggtctacaactgcattttactaagtgctaggataagagatgtctggaagtcccctatcctgttctaggttgatctggatgtgtgctagaactgtcctttctccatatgacaagtggaataacgacagaagctgccattctctagctgttaaaggctataccgtgtatgggaaatactacagtagatccactttcacaacttcgtggtgcttcttgttggcaacaccttgttggcaacactgaccctgtcctagaacagtatatgcaatcctgcccacagcttccatgggacttaatgaagagcagaaagaatttcaaaaagtggcctttgactttgctgcccgagagatggctccaaatatggcagagtgggaccagaaggtaggcgtttttcttgtgcttagacgttctaacaacagatgtctcaggcagacctttatctttgtctcctgataatgtaattgttaaatgtctcctccacttaccaactcttactgcaagtgagaataccggtagtggatgatttttcctagaaggcatcctgatcatcttgtacataactttttttttgttagttgaataaagatttggatataaaactaaggcagttctatagataataaaaagaaacttcttaatgccagaacaagtttttacaggacccatgttaactgataaccactgtaagatgacaaacaggcatattaagagaattcatacgctgtcgcatgtgcaagcctcctaatccctcactgtgccctctaaaaggaaggccgtctctgaatcagctgctgatcaccctgctctcttttgtacataggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaagtgagtgcccaagcttggaaggcacaatgaagtgctcactcgggctgactgtgagagttcagattcgtaggaaaaagattgatcttttgaagctgagtgtcctcaaggaactggacttaaaagtacactctaggggccgggcgcagtggctcgtgcctgtaatcccagcactttgggaggccaaggcaggcagatcacgaggtcaggagtttgagaccagcctggccaacgtggtgaaaccccgtccctgctaaaaatacaaaaaattagccgggtgtggtggctggcgcctgtagtcccagctactcgggaggctgaggcaggaggatggtgtgaacccgggaggcggagcttgcagtgagccgagatggaccactgcactccagcctgggcgacagagcgagactccatctcaaaaaaaataaataaataaaataagtacacgctaggtctgttgctgcctgttggacttgattctgtcatcctgtgtattgcttagggaatcaggtcagccagctttctcagaaatcttattttgagctggtaccaggagacttctccaatagagtgatcagggtcctctcacccttttatttatttatttatttttaagacagagtctcgctctgttgcccaggctagggtgcagtggcatgacctcggctcactgcaacctccgtctccccggttcaagtgattctcctgcctcagcctcctgagtagctgggattacaggcacgtgccaccacacctggctaattttttttcatatttagtagagatggggtttcaccatgttagtcaggctggtctcaaactcctgaccttgtgttctgcctgcctcggcctcccatagtgctgggattacagatgtgagccaccgcacccggcccctctcacccttttcctcaatccaaagatggaactgccagtgatttgaggaagtaatagaaactactaatagaaagcacatataactctgatttttagaggctcgtgtaacctaactagaagtagtacaaacgtgctggtgagaagtacctcagcctggttatctctgggtagtccttattccaggaatatgttttaatccaccgtttgcctttaaagagtcttcccaattgtgactctccccttcccactcttctgctttactccactgccctgccctttgttctctttccccttctcccccatttttttttcttttccatctttatttctgtcattgtcttttcttcttggtgtacctatcagcatgtgtgcctggatgattgatagcttcggaaatgaggaacagaggcacaaattttgcccaccgctctgtaccatggagaagtttgcttcctactgcctcactgaaccaggtgaatttgccacactgcactgagatatagcagggagagatgcttcctgctcagatggcattaccgagcactccttccagcctcttgacatgtcgagccactgtttatctagctgtttggttgaggagtaatagagtcctgtgacctgatgtcacaaggaccaagaagcctatctggtgtgttgggaggtaggcagtggcctgactggtatgagcagtttccaccaagtacagagagttcctttggccacttgggttttgcagtgacacactctgagcagggtctgtttagagaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggctccaaggtactagcgtgcgtcctcccagagcactttggagattgttcccagcttcctcctgacatcctctggttccttcacatccgcgggttaatactcccataggatttttatgtgttgggaagagaacctctgacccatttctctttctttattctcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacctgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttccaggagagaagccaggaaattcctctgtcagtcccaccactgtcctagccagagcttgtgctttatttctgtccatcttttcttgggatatctttaacgatattaaagtgtcgggtgagtgaagtggacttagcacttaaaagcaataaatttcctctatagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgtaagtgattcctctggctctcctgggatggacagggaacagctgctaggcccaggggtcttgagagacatgagtcagatttggaacccagccctcctggaatcccacaaggatcaccttaagcttaaggatataaatgaactcatgagcggcctatgtgggagctctcatcgctggcttttaggcctgctgcatgccattatacacttcattatgtcactgttgtttggttgtgttctaggcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacgggggcgggatcgctgctttccccactctctgtccccatgcctcctgggcctcagggtgcagtcaagccctgtctgtctcgaggcttcctcctccctcccgttccgcagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggttagaccgctgctttcttctgcaaacctcattccagaaagatgtttatgggctcagtcgccagtgttcaaactgaattcccgagagtcgttttccttccattactcttggaattgctttctcactgagctttatgtgcgtaggaaacttcgccttcattctaactctctctccaccctgcaataataagcaggaaaacatttattgtaggccacaccatcacccacttacagaagaattggggcactcatcactgtatcactttgtttcatcatggactttactgttggataaatctacagtttatgctttatttgagacgatgtgactactgattcctcgagggggtttatatttctttttgcattaaaggccactgctaaaaatgaagcaaataattgataccctcctttcagggaaaatgttttcattcttttgtaagtcagttttctgattaccaaagaaatgtgtatttattgttgaaaccttataaaattaggaaaagtaggctgggtgcggtagcttatgtctataatcgccgcactttgggaggctgaggcgggtggatcgcgtgaggccaggagttcgagaccagcttggccaacccggtgaagccccgactgtctaaaattataaaaagttagctgggcgtggtggtgcatgcctggaatcccagctactcgagaggctgaggcaggaagatcgcttgaacccaggaggtggaggttgcagtgagctgagattgcaccatcgcactccagcctgggtgacagtgagactccatctaaaaacaatacaaaaaattagccgggcctggtggggcctggtggcacatgcttgtggtcccagctactcaggaggctgaggcaagagaattgcttgaacctggggggcggaggttgcagtgagccaagatcacaccactgcactccagcctgggcgacagcaagactgtctcaaaagaaaagtaaaagaaaaaaaatcactcatgtttctacatccagaatgttattttggtacatctccttttaggcattttactctgcctttgttggtacatttttaattttaattagaattatcctgtatatactgtttttattctgcctttttaaactttatataagcatttttaccatcagaagaagtttttaaaaaagtattatttcctgacatttttcagtactttgtagagaagtctctgataatctcatctctcccaggctaaaagcaatgattgtagtttaaatctgcagctactctgaactaggcctggagcagcctggtcagagctttactaaactctcagactttgctgctgtgaaattcttcctccttcctccctcttacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaagcaggctccttaaattattaataactttgcaaactaagcattgtttatgatgtatgaaagtagaattaaagtgagattcacagatgggacttcaggagaccttgttttgtttgtttgtttgctgttttttgttgtttttgagacagagtctcgctctgtcgcccaggcaggagtgcagtggcacaatctcagctcactgcaacttcttcctctggggttcaagcgattctcctgcctcagcctcacaagtagccgggactacaggcgcaagccaccacgtccggctactttttgtatttttagtagagacagggtttcaccatgttggccaggctggtctcaaactcctagcctcaagtgatctgcccacctcggcctcccaaagtgctgggattacaagtgtgagccactgtgcccagccaggggagctctgttataacttactatgttactccatcccctcatccctattgaaaagaatacgcaagacattaactacaagccaatgtttagagagaagagaatatgtgtctgtaacaacaacaaatactgtcttttttgaatgaaggaagttttgggtgctgcaggaggacagggtgtgggcacactacaaagtttaaaatgtattcctgccgcccaaggccttatttaagaggagctaagagctgtattgcaaggcaatgatatagatctgtataaagctgagaaggcgacaacctataaaagtgatgagggaggaagggattcaaattaagcttttatgagaatgtggtcaggcatggtggctcacaccagaagtcctaactacttgggagtctaaggtgggaggattgcgtgagcccaggaatttgaggctgcagtgagctacagtcataccgctgcactccagccttggtgacagagtgagacccttgtctctgaagaaaagaagaaaagattttatgaaaacgtctaattagaatcaagaaagtcaatttcagacaggaaggaaccaggagcaggaaaagtacaggatttatgtaaaagctgtttacactttggtttaattgtggtttggggttggcatgagacagaaggaaaatagaagttgaatccggatggagagttatgaaagccaagggtggggctttatttggtaagcagtggagagccatggaaggtttttaatgcggaagataggagattgattcattcataagagcactctggaatgcacatgtgggatgaatatgagtgaggcaagacagaagacataccagtcaatgggttcttgaaatagtcaaggaatgtggcaattcacgctggatgtggaaggtggaaggaaagacaagtgttagcaaatgcagacctgtctgctgtggaacttgaagaccttgctagtagtcaggctgcttcctggcattccaggcctgagaggcttctattttgactcaaagcaaaaacaaatgctatgttaatgtcttcctatgtgtccccttcataagattttggtgaaatcatattaaaagtgcatttctcagtatcactctcagttatttagagatttcagttccccagtaccctggcaagggatttgacgaacgtagcaagaacgtcgtgaactttgagctaatttatatcattgttcatttgtctgtttaataaataaaagcaagaaaaccagagcaacaaatgtcttaaggaaaagcctgtgtgtcaggggctgtataggtgcagaacacatgcaggtaaccaaatacaacttcgctggacagacctaatggactgggggctgggaaacaggagacacaatttcagtaggaggcggcaaggacaaaggcatacaccacgtgctctgaggcatgagaggccttgcggtcataacacaatgacttaggtcagaattggatttccacgtggttttaatcctaataattcctcaaactgcctccaattattacagttgtgaggaaaatctaactgtatacccacacacacacacacacacaagaatatttacag

SEQ ID NO: 16035 - DNA, 11376 bp, Human
ctttttataaatcagaaagtgttcgaggttcaaaggttgacatttctgagtgctgatactttgtcctttcatactatccaaacaagtctaacatttagaaatccttacacattcaagggaagttgtggaaattcccagagagagagtgtgtgtgtgtgcgtgtgtgtgttttggttttgttttgctttttttctttgttagtgagaagaagccgagtcttttaaggtacggggtttacagtaatgaactgaggaaggcaggagcttctaagaaaatatgcccccccacccaacctaagcagtaaactttaactgctagctagctgcagtgaaccagtgggagccccgatgagcgagggtctcggtgacagcgtgctatttctcccaccctgggtaaaatatgtggagcatcacccggaaagtcgggcttgataaaggccacattccttgaatcatctcaagaatctaaatcacactagccttctagaaactaatgaaccctaccagcaggattgcctagaagacaaatatcccttgaatggttcccagtccactcgcgctcttttcaaaaagttagaggagccctggggagggtatccactcccgctgcaatcctttcctagatgatactacccagtaattccgagcagtctttcttccccgcccattagctttggaaagaacctcggctttcccgtcgcttctcccaggcagagcagcacataaccatagttccactgcatctgtccgctggctgcagcgactcggatacagtcttccaagaatctgtaacctgggacttttgagggggaggggacaagcaggtagggtatcagagaaaggatgggttagactcccgaccatgagtgaaaagggccgtgtgcgtgctccaggagtgtcggtccccctctgcaattcaaaagggggatctctcctgtgcgcgggttttttgggaccggctccagatgtctcccagcagttctgaaacagcaaaaagtgcaatttagatatgaaatctggaactgtttttgttcttctaagcaaaagatctccctctctctagccgatgctccccactcagttcatcccgggaatgggccagggaggaaggttctcatgcatcgccccgagctgccaggcgagcttcgggctccttaaattcacaggccaacagcccgcgtcctctccgcgcaggctcccggttgcccgcggtccccggcccagctccttggcctcctcctcgtcggtccgcccctggtggtcttggcgcccgctcgtccagctcggcgcgccggggaccgccggctgcccggggcagtccgcacgccctcggggatctcggctcccggatccgccgcgccggcaggagccggccgggcctggagggagcaagcggatgcgcccacgcccccggcacggggatggcgcgacagggcccgggctccggggtggggctcggcagagctcctgacagctccggggctcggcagcgcgggaggggggagctccgccgctcgccgctcattcccggctcggggctcccctccactcgctcgggcggcgcggggcccgttcgggccgcccgtcgccgcccccgccccccgcgcgcccgcccgccagcccgcctgcgccctcgctcgccccgcgcgcgttcctagggcgccacctctttgcgactagctcacttctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtagacagacagctatgtatatatatgtgggtttcgctacaagtggctctggaacgaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtaagtgctgagaggctccagagaaattttttttcttttcaacttgggagatgcccttgatgttgaagaggctttttgagagcgggctaaaaagggggagcggagtagtgcggggagatggagagtccagactgacactcgggtcccattcccttctgttgcaggtcccgagcgcgagcggagacgatgcagcggagactggttcagcagtggagcgtcgcggtgttcctgctgagctacgcggtgccctcctgcgggcgctcggtggagggtctcagccgccgcctgtaagtgccccatcctccccagggcgccgggttggggaggccagggggaggggctgccaagctgggatgctgccgagggcttgcagcggtcaccgatgctccttgcccgggttagggagagggaccatcccggatacctgccggggcctgagcccgggtcctcaaacctggcaggagaactggttgatcttcaacgggagacaggcaagagagagactttatgtgtgtttccataagagggagcgtttcacagaatctcttctagggaaagatcctctgcctctagtggaaaagaaaaaaagttggggggtggtggttactgtcaggacccgggaagcttctgaaactcggaggaagctgagcggtcctggggacgtatggcctgcgcgcttgtatacatactgaatgtgggtggcggtttgcgtgtgaaaaagcaaaagccgtacatctaattttattatgaatgacataattttaagcatataaaataggaacacattacataataaaagcgtattatataataaagtagcaacaactttgcagtggcacgactccaatgttagtattgatacagttcaggaacgctagagcgcttgattccaaaatgaattttaggtgtggaaccttttttttcttggagttattgctaacagttctttaatctggagtcaaatatttgcattgtagactgaaaacttgtattttggcattctcacttggtgattcttttaatgataacttcaactttgaaataatcatacatccaagcacaccagagaaatatcactatgtcgtgtgactgaaaacttggaagagtgatagagtaacatgatcttaataatctgttggacctagcagttcactaatgtgtataacaccatagttgggtgatctttaaactgcagactcagtgttcagaatgggaaaactataaagttcgagaactgagatgcgtttgactctggagaaggaattaaggcaaatttttacactaacaataaaaatagcagtatctaatatttacagtcaggtttatggtgcttccttgtaaattcccgagggtgtacaaaaaggcaactgttttatacgtgcttgtggtctattattattagaggagaaaatccttaaatgaaattactttagacatgtcggaaccttggcatcaaaatgaaaatctattatgaatctcctaaggcaaattgtgtagaacattataccgaagataaggctgcattgtattcttcagatcaacattttaccgatgtgtttctgaaaattgtcttcagactttttgctcattttgaaacttgtcttaaattcaataatttgaaattcatacataaatagaaatgaagactgaatttttaaaagcacacttaaatactatatttatttggctaagaaatactaccttggaacagagccaattttttctttaaagttgcttaagaaatacctgttttctcttttgagaaacagcaaatgattcacgattatatacacaactatggcataaaaatactgctaagttgtcctaaaggctatttttaactctttctttgttgcaccttacaaaacacacatcagaaaccatttagcagccagcgactgttatagttttgtttgtgggtgaaatataatattgtagttaaacactcacactcagcagatggttataaaactaccacaaaacattctcatagttaatgggtaatagatcatcacattacaggcatggtttttcatggaggctgaaatcatcagtagatgaagatgtttcatcaaattatcatagccaaatggagtttttaaaaacaagtcattatttttgtcttgctgccaagtaacagtaaattttgtgtgctagacaaaacataagtctaccattatgctaaatcaagctagtttcttgaaagaaattttaacatataatcaaaccatattactccccggttttcacaccaagtattagggaaactgctttagaagtatagattttttttttaactagatgctaacttttaagggagaggaaattactataacaataagacttcctaaaccatgcaaaggaagcagttacaaattgtgagtctttttgacctgttaatcccaaagattttaattaatggagctagagcatgatcaagttggatactggaaagtgaggcctatggatgttcttgtgcagatgaacaaggcttctggcaggtggctatctctatgtttaagttagagagggaactccacagattcagaaacctaaaacgtcattggctgatttgcttaggagccagactgggtctattccatttaatgaaaagcataactttctactgagtcatttgggttggaaggaccttctggtgagtcatcttaactctaacaccctaaccctgtctcttgcatgtaccacagaacttttcttctcaaacacagagtccgtccttagaagcctagcatcagtacaagcatactgcttcttcctgtgctggaaagggaatttccatcactgtttttatgccctctgttccttgatagttccttagaaatctaagcttcttccctaaaaactcccttggagtgattttttttttaaaggagaagaactatgtttgggctgaatttagggttatctatgataagcatttccccaaaattttgcaatttttttttacaataatcaaaggagaacatgatacataacctacctgtttttccattttggagcttaggtatgtaagtgtcatgtgaaccatagtgctatgtaatgtttacagacaaattgagtaaaagactattattgaggccatatttacaacttaaatatttcagagttatctaaattgaaaacgtccttaatttgaatttattactcactacctctgtatacctagtttatactgatgccattatattcctgatcctctaatgcaactgcctagtgagagattcattcttcacaatactttaattgcagaagtttttgaaatactaagtaaagtgtctaacagcatttccaatttagcatttaagaaaacttgtgttttccaagatactaacagtttcccccaaaaggcagatgaaaagctttgtccctcgtaagcaatgtactattttaaattgaacaaagctgtgccatattgtaggctttttataaattagaaggatggaatgatcactgcatttcccaagagaactatcctgggaaaatgcagcttgagttaggaaggcactgtgactcacagttgacaggctggccaagatgacaagcacatatgcccatgagaaggggcatatgagcaatggtggcttaattagaatagaccaaccattaaaagttttggcctcaagttaagctaaaatgggctacactttatccatttggagagcaatacagaagacgagggcttctgccaggaacagagaaagaaataaaagcccccaatactataaattatcagtggttaagaactgctttttaatgtgacattttgctaaaagatacttattaaactgtagtgcttatgaaatatgcaattatatctgtcctattattttataaatgttattaaaggatataaataccttgtaccaaagcctcaaacttgtagattcttaaaagtttccagaatactaactattaccacagagtaagtgaattttaatctagtcacatgtggcaccttctaaaagaaagagagactccttcatgcctcatttaaaccaggctcctgttaaattcctttccattaagtcatgtcttttttgaatgagctacatggcttcaagtcagtccacacactaaaatactagaaggtagctgacattctagctagaagggccagagaaatgatgactgtattttcatctcttactcttttctttgactcattcatccagtgataatccaaactcttgtagttcctaaatttgatgatgaaaatgaactttctgggcaataggcttgatcttcaaggaaactgataaatttctgtccaatctgcctattattgtggtggcttgttactctatgccccatgcatataccctgtactctccttaccgtgttgcctcaacacaggaacaggctgggacttcagcttcagcttccgcttaggcaggagaaagcgttgaggaaattgaaaaagcagtcttggctttagaatcagaagacctagtttttggagccctggctctgccagttctcattgtgtagactagggcaagtcatttaacctctctgcacctcactttccccatgaatacaatgggggcagtaataatgctatttatgattgccatatttctctgaggagttaaagacattgcaccaacaaaggcaacaaaggacccagacaccattgtttcagggaagtaagagtacatgggatgtagccctgggaaacactttgagatgcttttgaggatgggccagtttggaggactattccaatggtagaaattggagttaatgcagagttgaagcaggcatgatatgactgattaacagatgcagtccgtaaatatggttaataatatacacaaaataataaaagaatacacaatggacatttaagcaagagtttgggtgttatctaaaaggattgatagagaattagtttattctttctcacgatattttcattagagtgtcatttaaatagaaaaatcctttatattttttcctagagaattttaagacaaagagagcaagtagaaaagtgaacttctcaactaagtagtaaggatcatactctctgaagttctaaatttaaaaaaaaaacatgaagcacagaagaaatagaatgagctcatttaagcacacaaagaaacccattttaaggagaccacccactactttacagaaaaatacacatactctccctctctttctctctctctctctctctctctctgacgattggccttcaaatgtatgttcttggtagccagtagtctaaaatgttaaagttcagtctgtgaatcagatggtttcctagacaggctacactgctcacttctccttcagcctttgtttgtttttactcttacggcttgctgtttcaatattattattttcttaatggggcgtgtgtgtgtgtgtgtgagagagagagaggagagagagagagagagagagagagagagagagaatactcaggtaaaagcagctgccttttatttcccaggctgggacttctagatttattttctcagcagaactctgaaaaatgtgaagagatactccgtggtttctgtctatttctgatcataactgaatcatatgttttaaaccgggaaggaagtatagaaatcactgtctctgaccccttccttttatacagttgaagcccatgaggcccaagaatgttcatgttcccaccaaggtcacaacctagtgagtggtagaactgggaccatgagctggagccttccaactgccagctctttccttcccactggttacccttccctgcgcaatgagcttgctacccatccagcttgtgtcttacggtggaccaactagaaaactaaagagatttactcatgtctttgttgtctctatcagcaactaaaatttaactgttttcttcccctctaatattttctttcaaagcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattattttggtgtttttggaactagttctgattgtaccatctacctatctataatctatttctatctatctatctatctatctatctatctaggggggtatgtttctatgaggcaaaaagtggggcaaatattaatcccattttataaaatagaaagccaaggcattccacggctaaaagacctgagtagtccttggaattgaaataggtggccccaaagctggatttatctccctgttttctgacacgtagacagtgctatgtttgccctgcttctttatcgatgcatttccattgaaatgatttttttttcttttcacttttcagtacagcacttctgtggggtttgaaaaaaaaaaaggaaaacaacagaagaacacatcatatgcaactaatgatctcattatttaagagtcccctgttacttctttagtcatttcctttgactctgctacagataggattataggatgatgcttcaaaggggaccttgaacctattcaccattatttgtctctttaagctggcaaacccatcattaaatagcacataaaatagcaatcatatgggataagtagtacagcttcagtaatcaatgggcagtggcactagaaaaatcttgagcacagtgaatgacctatcctgcaaacatctaatggatctctaaagggtaacaaaccctataaattctggcttactgcacatatttagtgtgttttaagataggatcctaactgtatatatttataactaatgtaaggaccctactttattgccaaaacctatttttatccattgtctcatatatataaacatgtcatatatataaacatatatatataaacatatatgtatatagtaaacattcaataaattgcaacatattattttggtgtttttagacctagttctgattgtatcctctacctatcatctatctatttatatctatctatctatctaggggggatatgtttctatgaggcaaaaagtatatatatacgtgtatatatatatatatatacgtatatatatatacgtatatatatgagttataaaaagaggtataaataacttttgatggattttatttatttcaaatttgcaatgttctttaagtatctggagaattgatgaaaattaaacactcgtcaattcttacgcctggaactacccctaagttaaagtaggtctagtgaaaattagacagtggcctaatcaaatccagacctagggctgaaagaaataggaggtttctgcttttcctttctcttccctgtttgtgagggacattcatggaaagaactgtttggcagccaaatgttggcactctcccaacacaatccaacagaggttcagggaagagtgaggaagcttaggagtgtattgatgagaatgtatggggccatgcaagttttgtaatccagataaaatcttttcagaatacctaaagttttataagtgataagtcttttattaacgtcccctccttagtctttttgcattgttacatggtgaaccaagaggtctgatgatatggcaagcatgaacttgattataatacatacaatagtttgaaaaacaatattctttttttttttttttttttgagacagagtcttgctctgttgcccaggctggagtgagatggtgtaatctcggctcactgcaacctccgcctcctgggttcaagagattctcctgcctcaacttcctgagtagctgggattgcaggcac

SEQ ID NO: 16036 - DNA, 69709 bp, Human
  misc_feature (1)...(69709): n = A,T,C or G
agtgttcataagactctggagtgctaagtttatattttattttgaaattgatgagaaatcaaggaagagacatagtaatattaacttttcagaaactttcttctgatgatagtgtgaataatggattaaagaggggcaatactggaagcaattagacatgttaaattcactgtgaagcacttttgcatccaactgagggggaagctttcaagccaccaagttttcagccacatgttttctactctctcaattgaactcagttaattgacccaatctatcttaattatctgctcctgaaaagatcacagcccctcagctgtgttttgcccacatcatcatctttattaaatgtaattagaaccctctcttctgggttaacctcaggaagaaccagctccttgatattttcatgccattgaaattgtggcgccagatatggccacagtggatagaaacagtataacttttctgcttacctttcactacatttttgagaaggtctgaaaatttttcataaaactctcagggatgtagttttcagtttctgtgacctttgtctttctgaaatgggagaggttcccttgtccccctcacagggcgtgcattgggggtgtggctcgcttcttcagtgccccgctgctcagacctctagagaagcatacagaccggcaggctgtggggctccgaccccttgacagagtctgggggtgaatgtttacagctcctgaagccccagtgggtgtgtgttacaggatgctctttcagtttgcctttagggggcttgtgttaaccagctcaattagaccctctaccttgtcgcacagacagcgagctttctgtatcctgggttcttgccttggtgtaccagaagaattggatcacacgtgggcttggagaatgagtgcaaagttttattgagtggaagtagccctcagcagatgagggacccagaagggaaatggttttcctctggagttaggccgcttggcggcccgggctcttttccgactgcccaggccaacctccgcatcgttctgcccgtgaatggcctgcggatgtgccagcgagctcctcttcttccacccttatgctcctctggacgtctggctgcctgtgtacctgcctgctagggtctggggttttcataggcacagtatgggggagtggcaggccagggtggtcttgggaaatgcaacatttgggctggaaggcaggagtgtcagtcctcacctaggtcggtgggcgtggagccctagcaagggaccacacactcctctacccagcacttcacttcgcccatccctatcatttaaagggaccacgctcttcccttcccagcactcccctatcatttctacactgtaaattttttttgtttatatttgtctcatctatcaggttgtgaattccttcacattaacttgcatggaattcatcttgttataatgtggtacctaaaaatcctagtactctggttcaaaaatatatgtttaacaaatgttcagtgaaagcgaatgaatgaatgaacgatgactcccacacacggaggaaccctgtcctcctgtaaggtacatgatttgaaggtcccaacaagtctatcttggaacaggcccagttgcgatgcccatacagttctcggactaacaaaaagtgtcacaccatccagatatgcttaatttggaagcagctgtaagcagactcccggccagctcaagtttcctcacctgggaagaggcgggaggctgtttaccgtacggaagcatagcggccgcctgcctgagttcgggagcgcgggttcctttccgggaaagaagcctaggccgttttccgtacagcagcatggcggccgccgacgggaggcggtcatagcatcacgcccgggggaagaggccgccgtaaaggaagctctgcttcctcttcttccttctcccgcctcccaccggctgtcgtaaaacggtgaatggagagcgagttgtgggggggaaaaagggaggacagggggcgcggagtcagagtggcgcagcaagtggccgcaggtggcgacggtggcggggggtggggtgtgaggtaatccagaggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccaggtgaggagagggtcttcggcgaccctcttccgccgaaggggcgcccctgccggctggccgggctccctctccccggcgcccctcgtcctcacccccaccgggctggggctgacgcctcacggctggtcccgctctccgaccccgctgccccccggtccagtggagcagagctcccaggatctttgccgaacagctcgcgcacctgttggccacctttgcaccttttcgtgtcgtctcccttctccagggcagtttgttctgcctacttggtccgcaagaagcagtttttgcaacctgtgctagtgttttcagggtgtgatttattttccttaagtgcgcggacttggggagcaggtgggaattttacttacagttcaaatctgagttcagcttttttccaaacccagccctttttaggtgttgctgtggagcacgctgcccaccgcctcctcctgtcgggttggcaggactgttttgacaccgattggccgagttttgcggagcgctgggcagtgctgttgggagagtgctctgggaagaataggcagttttcatggtgatactgctttatctaagacacatcaaagtaagatgtgttggagaaatttcttatgaatgctaaaatgtgtaagacttctttcttttctccgtctcctgttcttcctaattagccttgacgtctttccagcgttacccccacacttcaaaattttaatgatcccaaactccagcttatttcttcttccctaccggtacttaagaatcacagacctcttactaaaaagtagggattaagagctaccactgggatggagcaacagctgttttaggttgtgatgacttgtaaaatgtaaatattccaaaatcagctgttctcaaagcgttgcccaggacctggagcttcagcatcacctgagaacttacaaattatgcaaattacggggcttcagtccagacttaacgaatcagaaactgtgggggtgggaccagttgtattttaactagctcccccaggtgattctgtgcctcccgaagtgtgactgaagtgtgactgtcctaagtaaatgtttctgttggaattgactttaaaaagctgcgtgttgggaatctttgaaagggattattttaataggaaacctaggtggagtttggagtaggtataaatgcaggattccccagagataaaagggagagtgaagacactgccaatggagaggaggttgggttgaactaatgcccaaagataatgcactggtgcctgaaaaagaaatggactgtcacttagaatagggggaagttaaagtcagtacctgtcccaggctttgcagagtaaaagtactgtatgttggctggctggaagaatagtaatccaggggttagttaggaagaacaaagcaggagctgaatttgcagtctactaatatgaacaggggagttggcctgtttatgacccccttctcacaatgaggccaggtgttcctttgatatcaggttacacttccctgcccttcacctaaccttcatttctttctgattcatcagtatataagtacagttgatgttatagaagtggaaaaagtatatgagaaagcctgcagaactaggagacatttaagacccaatcctattttttttcccatggtatttcagacaaaagcaggcacgttcagggtggtatggccgtagactcttgatggtagttcaatccaaatccattccatcatcactctgccctgccccatagtgtcccacctcatcacagaccgtggtttccccagcaatttctaaaggtagcttattgctataccactcatttagcatttataatttatataaagcatagtgaaatgctttaaggttttttgaatcggctgtaaatagaacaaaatataatgtcacctaacagtgtagtaaaacatgcttatgatgatgggttttgcctgcttgtcctttgccaccactgtaacatccgactttgttggataaatgagtgggtaaatcaccataagtggttatggtccacctcttcgactttagtctaggtctcccctcagcaagtatgttctgcatagggaatgggagcagcttctgcggtatactgatggatctgtcaattgccgtttagaaaaataagcagcttctgcaccacagcctatattccaatggataaattctcatttggagctatatatttttttcaggccagcatttttctgttactagtgagtagttttctgactgctatttgtgatattgtttctgtgggaaaatgtatttgtagttttatctcaggatattgagcgaaccctatacatcttcctcattttctatagaccagaagtcccattagaggcagcatagaggaataggaatgggtaggtaccttgcttaagtaattcatccagaaaggtgtcctcttttaataaattatccttcacatgggctcggtagggaaataagtttttactttgattgccaagcttttgaatctctgctttccatgcatgtgtacatgcaattttcattaccctttattaagataatttgtttatgtaaatagcacagaaatatttattaagttactatgttgcagatattggtataagagtttgtttccatggagctggggatacaggcaagtaactaatataatttcaggtcataagtgctgtggagagtaaagcccgagcaagagtgttgggatgtatagccattctctgaagaatggcattgagtagagagttggatgttgtgaaggaatgggccaggcaaagagcagagagaggaacaacggttcagaaaaggccctcaacttggcgtgctggaggactgagagggaatatcggttcagaaaaggccctcaacttggcatgctggaggactagaaaggttaatgcagcggagcagtgagtcagaggatgggaggagacatcagttttttgctttatgagttctcataaatgcagaatttagttaagcaaactgcgtatttgcagaaaacttcacagatacaaaatatcctcaggaaatcattgagaaattagtcttatttattttttagaaactcgaagcctgaagaggcacaaagaaattgagtaactatttctgagtaaagtagtatgaaaatatatctgactatatctctgaatgttttagctggccaagttaatatagaatgaatcaatgctgaaagaagacaaggtttctgaaattttttaaaatggcaaacagttgcaaaaagaggagtttcaaaatctgtacaatggcaacagtgttgacataaaagtctctgcaataggtatattactttcaaataagtagcatttatttaagtgtaaaggttattttgtatgtgtggaataagatttttaaacaaataacggaagtcagtttttttatgattagaataaactatatagatgttttaatctttgattcatgacaagatctttcagtatttacaaagataaacatgagttataatacatatgtagaaggtgaaggctgggtgaatctgtgttaattttgcctcctatcaacggttgttagaacaaatctgttttcttaaaaactgctttgaaattctgatggtttcaattatggataaaaaagaatttacatgccacagatttgtgatctgaagactacacaggatgaaaggaagaaaattataattcaaaattttgtgaaggatatagaaagattgggaaagcacaatgttcttggatgaaaaagattaatatttttaaaatgccagttgtgtccaaattaattttttaatcaaacacttaccttcatagatgtgattttaatttaaaaaaatgaataatatgcccaaacctagctgtgtattgaaagggatgcccccacagatccaggctctgaggagaggggtgagctgaacagactctctgggtcattgtctggtttggcctcactggaatttgagtcttttcaaatgaatgtcagtggacaaaggcatatgtggactctggaatgtgacaggactgtaatatagtccaggtactgtacatctggatataacgtgatcagaaggagtggatgctctgtatttttttgctttgaaggtccccatcgccaaactcaggagcagatcatagtagagcacacctgtggggtgaagtgacccaggccacagggcagagcaggagcttcatccccacaggctcacttaggcattaagtgtaaaagatagtacagcagtagagggcagctggtgatgacagtgtgctcaaccccatctcgtgagtcacactgttccaatctggactggcttctctccattgctcacgctcaactttgtaacattatcttctctgttttgctctgttgggtctcctatttcctgtagcctttgtttttttgttttctgtttgtcaaaaataccataaacaaaattgaagcacaaataatctaggaagaaatacttgccatgtataggtcaaataaaagattgagattttaaattcataaatagctcttagaatttattaagaataaagcaaatactccatttacaaaaggataaagggagtaaggaatttgtagaaaaaacagccaacaaagaggaaaacacccaacctccttagtaatagagaaaatgcaatttaaaacattaataaaattttaaagtttcaaaggaatgatgatacctgtattagatagatggacactaccatatgctgctgttgggagtgtaaattggtatactacttctggagaccattctgacaatatgttaaaaaaaatcataaaaatgttcacattcttttattcatcagtttctgctcaggaaatttttttgacttgaagtattttagtaatcttcattttgccttgaagggtttgtctcagtttaaaagtttttcttttatttggacagtaatgtattcagtaaccggtgctaacttataagctactcacttatattgccctattttataaaacatttctttgtaatttcagtcctacaagattatcaattttgcccccagtttacttcggattatagtctctgaccatgtggaattcccagtacgacaggcaggtgagttggttttttatcctttataaatttatttataggtgagagtagaatgggagttttattttaattttacatatctgtaatttattgaaaaattcagaagcactagcactcatgaagtatttccagtgacttcaaaactcactttctttttccccagaaatttagaggtagatactgagctctcaaatatcttctagctcttttttttcctcctctcccttttacccaccaattccttgcctctgtaactttgcccttatttttctcaattttaatagctgatctctctaacgttttatgatttctggtagcctagcctctgggcccatagattaagaccatgaatttatatatgtgaattcgagctctgttacgtggcaaatcatggaggtaatgtgttgcacagatgttcctaacccaggtgactgcggagcaggactatgttttaaacatgaaacttacttttaagtctgtgggatcttacgttgtttcatgatgttgtacatcgttcttttatcttgtttttttatggactggtcattagagcccagaaggttaaaaattagagccttagagtatcatgaattttcaaaagataataatcaaaagctaaaggaggtaaacgacaatagctaattaaaaataagtatttaaaaagacttgttatgtaagtgacatatacatgtaagtaatttggacaatttagaagaatacaaagaaggaagtaaaactacccaacattcatcactcagaaatggccatcattactcatcattaacgttaggtgaacattagcctttccatgtgttcacgtagaaggatagatgaacagtttcagagaaatgggtcataatctacatgctgatgaaagtatttaatttgatttgaacatagaataaaaagataaagaaatattaagctttgggaagatttataacactatatatgatttcctgaaagatcactttgtggttaagataaaaaagaaaatcctatggaaaaacactgatgttggaattattttttgcttttataaggtttacaagacttctgtgtaaatttttgaaaccacaattggcacttgtttcatctttgttttataaaatagggctgttctggaataacattttgttgaatggaacctattttaaaaacctaagtgtttatagggccattgtaaagttcctatgaagcatttaagaaataacattttaaaagatcttaaaacaagtttttacattaatgtcttcctttaatgacatggaaacattagaaaaacacagtttataacttacattgttcttaatacacccaaagatgactgccatcagctttgatgcgtggctctccaattcttttttttatattacacatgctattttacagtttcctttttttcatttaaccatgtacccttgaagattgctccaagtcagtgcatatagatacttcattctttataacagctgtgcagtatttctttatataagaattaccatggtttacttaaacgatttgatattgatggacatttcgcttattgtctttttttcattgttgatagaagcaatgctaaatgagtgtcatttgatatgtatctaggtacttgtgggagtgtttttatagaataagttataacaaggggaaatgcttggctaatggatatttatgacatttagaatttagaatcttctcactaagttgcttttgcttacattttctaccaacagtgcattagaatgctaggttccccaaatcctcaccaactctgtacaacttaatgaagttttgatgtaaaatgtaaacagcattgaaaggcatttttttcttcataatttgttttttcataatttagatttcaaatcctaaatttaagtggtatttataaattttctgttctgtttaatctattattaaaatacaaggatgctccaagacacctagaaagataatttatctttagcatgacacttaaaaaagaatgttgtgatttttgctttaaaagaaagcctgtataaagctgtaaaaaaaaagttatgctaatgttaagtggaaatacatctgcaaaatactttttctcttttgcttgtgggcaatctaaagtgttcttgctaccatcaagcgtgctcactggtgaatgtgctttcttaccttactgtgagttttcaagaaacaggaaaaaattaagtattttgatgttgccaagcaaaacaaaaaaatttgaatgtttggtctgctgcttttcttttgaggtgttgataagcataatagcattattaatattatcatgtgcggtgaaggaagcctatcttaaatttaggatagttatgatctggaatttcaaatcacttttgtttctaattttttacttcttacatctgaagagactctttagtaaaatttctctaatatatgtaaatttaggctcagaaatgtacttttttcagtgcattttggagttgctacgagaaggagagagtagtttggatttaaaagtggtggttgagaggtattagacctgaagaggtcatcagtggtgacagatgtgggactgtcatttaaaaaaatagcatggtttttgatttctataagtttgcctgctccttgttgtttctttttgtttgtatttccaaaggatggacagggagaagatataacaattcattctgtggttatttgtttagaggttatttgttaagattgacgtcagcattgcagagtgcagaacctagaaataaacagaaagatgcctctgatcagtccagaagcactttaagaagcttttattaacattcatgcattttatttgtagaaagctttgtggcttgtgctcagaatctatttaatattgttttgatagaattgacacatttgttgtctaatctagcctttcacagagtaataagggagagaaggggtacaaaattacaatgaaaaacagcaagacttagaaacatcaactcaaaagcatgacattctgcccaccgagataacagtactttctccactttgaggttatgaaacccaattgattctgtagttgtgtctctgggtccagagcttaagtgatgattcattgtgctgaaggagaaaagtgtgtgtgtgtttttagaaagttaatttcaacttatgatgcttaaaatggtgagtggattttgtaggaaaactgtcttagagcagccatttttatcatagaatctgaaatacatttataaaattctacattataactatcctaaatttaagtgccatttgtagattttctgctctatttaatctattattaaaatacaaggatgctctaagacacccagacagatacagtaaatttaatatttcctttatgaattggattaacatgatattagtcctttgtttcttagttctggcaaatggtttgtatttaggcacttgaattaaatgattaaagggaagttttcagattattggttgatatggtaacagttatctttggtatttttcctttatccttagtaatccataattatccatcatagtaattaaaattttctttttaatatattttcaattttattttacctcattgtacatttatttaggcatatacaaattagtcagtgtgccttttttaaaggctgtctcgtttgatgcaccataatttttaaattataacttttcatttataaaattaatattaatagtatttaatgactaaatcataaataagtccatgattttaccgtgtctgtatttttactgtctaaaggttgcttttctttgttttcaagactagttctatagggatcaaaatgattttgtgactaatatagttgatttttctttttgcaaagattgatcctgtgaaatcaggctgggtgttcatgcctgtaatcccagcactttgggaggctgaggtgggtggatcacttgagcccaggagttcaagaccagcctgggcagtatggcgaaaccctgtctctacaaaaatacaaaaaaattaactggcgtggtggtgcacgcctgtattcccaactacttgagagactgaggtgggaggatcacctaagccctggaggtggaggctgcagtgagctgtgattgtgcccctggactccagcctgggcgatagagtgagaccctgtctcaaaaaaacccctaaatcctgtgaaatcagtctgaactgctgacaggttggttcatatccttagatcattcattcattattttttgaatagtctatacatttttatggaatgtgtactctttgccagtcactgttacataatataatgactatacccgataaaacatggtacctagtctagagcttgtgtggtctgaattaaaaacaagtaagggaaaaaagaaaactctaacacacatccccctttatataatttttgttttcacccaaatgaattgaaatcatagatggaacagtttttcagaactttagctactcaaaactaatgaaagaggagcttaccagatgtcaagttcataatttcactaaatttcttttaagttttagctaatgtagaatgtattggtgtattctttatggtatagtgctttgactacccaatttagttttttttttttttttttttgacagagtcttgctctgttgccctggctgcagtgctgtggcatgatctcagctcactgcaacctccgcctcctgggttcaaggaatttgctggaattacaggtacctgccaccatgcttggctaattttggtatttttagtagagacggggtttcaccatgttggccagggtggtctcgaactcctgacctcaggtgatccgcccgcctcggcctcccaaagtgctgggattacaggtgtgagtcactgctccgggtcatgaatttagttatatgttaaaagttgggtgaagaaagagttgggtggggaaagaagagaagcttaagggaagaaagttatgctgctttgcaaatcacgtatctgtattctttacacacacacacacacacacacacacacaacattataagtatttacttacattcactgttcaactgggatggttagaaagctttacattctggccaggtgcagtggctcacacctgtaatcctagcactttgggaggccgaggcaggcagatcacctgaggtcaggtgttcgagaccaacctggccaacatggtgaaatcttgtctaactaaaaatacaaaaattagctgggtgtggtggcacatgcctgtaatcccaggtatttgggaggctgaggcaggataatcgtttgaacccgggagacagaggttgcagtgagccaagatcttgccactgcactctagcctggatgacagagaaagattccgtctcaaaaaaaaaaaaaagaaaagaaaagcttcacattctttcttaaaatgctgtagcaatatgtcagcctgtttctttcagaagccttttgttaaaggttgaagacgattaaaaagaacagaacaaaatcagattatgtattttgatagatgtgaacatataaaaattttctgagcttttttccaaaaatttttgatggctgatgttcatttccctattatatttacaagtagtacatatttcaaaaaggttggatgaaaattaccaatactataaaaagaagagataccccaaaatgctagtgtttgacagtagccagtgggaaaacaaaaaacaaaaaaagccatcttcatgaaggaaagtagaactttacctgttgtcacctcagaattaggcattgcgaaaagtatgattttatgatctcaaagtatgtttactatgcattatttctagataattttcctgtcctgtaagctctgggtcttgacttaatgaaatgttttctgcttagactagctgaagtgaaacctttaaattcttatccactttcccttcctgatttggctgtttatacctgtaagagtatccatttttgctgggtttcatgtttaacattgaagggtttggactttcatgctctgtaaggctgaattaaagccatcctttttggtactgctacattagcattttttctcaaactcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgaggtatgtggtgctatatatttgtgattactagaaagcatgaaatggttagatctgagggtgggtgctgttggatctaatccttggcctcatgtttcattttctaaagaggtaaagtaataaagagggacactcaaagaatattattttacttagtggtctttgcatttgtaattctttgcctcaagatattttggaaaagattttgttgtcgtatgttgccacaaaaagaggtaagatttaaaaaaaatgatacttaaccaaaacaattgtgtaagtcttgctacttaaatgacctttattcttagtaatgatctcttgagtttttttactacctgcttttcttttctttgatacagagagactgattctgggaatttttacctactacctgtcttaatctttccctgtatttttattcacatttatgaattgagcatgttttccttcagagaagacaggatagagtaggtataaactagaagaactgtctccagttttttacagtcatagattagatgctgtagagcagtagtgtccctcagaactttctgcagtgacagtgttctgtgtcagtgctatctaatattagccacaaggcatcaatgactgttgagcacttgaaatgttgctagttgtaactgaggaactgaatttttaattctatttacttttgattcatttaaagtgtgcatatttaactagcagctgctctattggacagagcagctgtaaagtcataaaaattttgcaatcttaaaataggagaaacaaattcttttcaacatacaagatagtaattaggtatcttttgaaaatgggagggacaaataggtgaaaacagaggtagaggaatgaaattttttaatatcaagaggttgaatataacgttagcccttagtatctaatagccatcatgacataagcagtggaaaaggaaggaagtacgacgggtaacaggaaggagaacaaacattgaactcttagagcaattaatttgttaagaggagaaaataggtgtactggttaaaaagaaaaaatcactattattcttattggttgcccaaatgccagtcatgggactgatacccctgtggtaccatcatgtatccatttattttcaaaatcttaaattttcagatctcccttaatcttcgagtggttctacacagtaatgcatgaaggatggcctttcataaccatcctttgcttggaatgagaaaggactgggagaatcaacctgaagatgaaattttaaaaaatgaaaagcttcagttttattttttacaaatatgacatttattgtttaaaggagcagctactactggcactaaaggagatcttttatctttattacgggacggttctctgtggctttgctccttttatgtccttaaggcttaattataatcattgttgaaatttcttccacctattctcaaagtttaagagtattacaaagggatttttcaaatagatttgataacgtgaagaaaaggcatcattttgtttaattttaccagtttaagtgaatctgagttactggttgttcaactgaaaatgctttattttttttttagttgccctgtggaatcctaattttgccaagtttgttttctaaccatttgaaaatgtcatgtaaggtcatatttggtgataacattgaattgatagtttatagaaaagaaatttttccccctattttcttttcagttccagttaaagttgaaatctcattgaggaaatgattacttatctatgttatcagataacttattttagcatttaactttgtggttttattaaaggaatattttctttttctgttttatgtctcttctgttgcctttttcatttatttctttggaaatagctcttagctctcctcttcaggaattgcctcgctaataatacatgtttctttcttatacttggggtacaaaaattagtatctcagactgctttggatagattcaacatacgatgttgggttttaattgataatggatgagttcaaggttttggcccatagagaagcttcccaccattatgtaggccttctttgtacttacttgtaccatctttagactaggtttatctgtttgaagtgttattttttcccccattcaggatatggtaaccaaaatatgagatataataagctggaaattttacagagtggaggtagattcattggagttttttgaaaattttaaactatttaaaacaatttttttaaactgtatttaggataagatagtttgaaaggtttcattcattttagaaactcacccattctgtttattttcaacaagttgagccactgaggatgttttttagatatgtctttttcccctaccccacatatgtaagtatataatacacgtaaatagaagataacaaacttttatgtaaaatattagaggtctttgaaacacagtatttataattacttagattttggacttttcttccctactttgtagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgagtaagttggtttccattggctgaagaaagcagccttgtgtaacttagaaataatgaagttgcaaagagtggtctgttgtggatgttctgcacaggttatcagattagtttgggaaatgttgggttaaacatgcttaaatgtgtttatttgctgcagttattgaaagaaactttaatgtgctgatggatattgctaacctctgagacagtgatataatatgaagcacttctcaaacttgttagttgcacagtaccatttattaacagctttccttggaaactctgatatagagatacctttatatttgtcttctagggagtatattaagtaaaccaaaacatttacttttttggatgcaagatagaaaatgttaacgtttctttgctaatgacattcttttccataaaagtagcttgggtaggtagaggactaatatcacacttaatagtattgctttctggtttctaggaagattgctacatgtgtatatgaagtcctgtagttctccttttaaactgactagttcctactctgcttatgaaatttatagaacatattttagatttatggcaattaaagcaatctaagagcacctaaattttaaactattttaactactcaattcagggagaaatataataagaaaattccccccatattatttgttatatagtctatttaaaatagcatagcaacttatattttatagtaagaattttggctggatgaaaattaatttaaatactagaaacattcatgtaggaaaactgcaaaatggtctcggattgttttaaactagtctaaatctttccagaaagattttaggtgttgtgcctaaaacaggatgtgttattttaaatttcttttcaacttaattctagcaattcaaacaaactagaagccaatgttaatgactttgttttgttagttttatgtatttaaaaaatattttataatttattgttgatggttctttgggtgggaaaaattacttttctgtttttgtctttgctcatgtagatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcaggtaggtttctattgcagaaaacaaacatggagtcctgtatttctgcctgacacatggaaagtgctcaataagtgtcacttattattaaaaattattttgtattatcccatatatttctttaaaaaatgcttatgaggaacaggttcacagaaattaattacccaagatcgtctcaatggcatatctgcccctatgtgcttttcactccagtgtctgaaatcatgggtaaagcagaaccagggtaggtaaacctacctgctctaaaacctgattactcgcaactatctgttctgtagcattcctgcctatagattagttatgattacaagagaagaagaaggaaaagaagaaggaaaagaagaaggaaaagaagaagggagtccctcttctattgggaaatcatattgatggtagtttctttgcatttgactcaaagctaacagaggatttagggttcattttccttggtttaaaatactgcctaaaaaaaaaaaatctgaatgctataagggataccaacatgggaatccggaaagaaatgagaagatagagatggaatatgtttgaaatataaaaatatttaacatcaaatccttgaaagatttgggtaaattatttaggtctgattggaggaagcataattgttttcagtcttaactgtttgatgaatgaattaaactctattacatgctttctagttgaatttgtcgtgagaagaggatggttttgttgagctcaaaaaccatgatagtttggatccatccttggctttttattgacttagatacttaaactatttcaaaatattttactttaataaagatttatatttttattaaagcttccccttttaaacttttaatagggatagtctgaggcagatattttttttttcccccagagcagcctttttgcagggaaagagaagagggaaggaggcaaatgtgagaagagaagaaactagaatactaggaaaatatgttctctcacttgttttgaaataatattcagaggccagacttcctttttctattggcagaaacagctagaaattgggaagtaagacaaaggctaatgaaataatttttctaaagcctctacctctaattggtttgctaagacgacagaatcttcatatttttctcagtctatacttgctaaaaacctggaaaacctcaacatttttaaccattttggtaatctgttatgtactaatacattaatattctcctctgggaagtagaaatttagaaggcattaggagccactattacaatgctgacataagtaaaaagcgataatatgagaaggagcagacaattttgtttttaaaagtatgagcagccgggtgcagtgggtcaggtctgtaatcccagcacgttgggaggccaaggtgggtgggtcacctgaggtctggagttcaagaccagcctggccaacatggtgaaaccccatctctagaaaaatacaaaaattagccagaaatgatggcgggtgcctctaattccagctattccagaggctgaggtgagagaattgctcaaacccaggaggcggaggttgcagtgatctgagattgcaccattgcactgcagcctgggtgacagagcgagactccgcctcaaataaaataaaagtatgatacaacagatcttgtctaagtagcataatatttgtacaggacacttggatattctatacataagctcagcctaaccctcagcctacttctcctctgttccctatatcaaatccaaatggcttccaaatgcacttagaataaagtgcatttgaaacttcttaatatagcccataaagcccttcatctcctcaccttcttctcttattcctacctttgtacatgtacagtcatgtgttacttaactttggggatgcattctgagaaaatgcattgttaagtaatttttgtccctctgtgaacattgtagagtgtacttacacaaacctagatgctatagcctactacatacctaggctgtgtgttgctccctggctgcaaacctgtacatgttactgtaccaaatactgaaagcagctgtaactcaatggtaagtaatagaaaagatatgctaaaaatgcagtataagatattttttaaaaagcactcctgtatagggtacttaccatgaatggaacttgcaggactggaagttgctgtgggtgaggtagtggtgagtgaatgtgaaggcctaggacgttagtctatgcttataaatgttgaacatttaggctacactaaatttataaaatttatctgcaataataaattaaccctagcttagcttactgtaacttttttacttcataaactttaaatttttttttttttttttttgagatggagtctccctctgtcacctgggctggagtgcagtggcacaatctcggctcactgccacctccgcctcccgggttcaagcagttctcctgcctcagcctcgatttacaggcgcctgccaccatgcctggctaattttttgtattcttagtagagacggggtttcactgttttggccaggctggtctcaaactcctgacctcatgttccgcctgccttggcctcccaaagtgctgagattacaggcgtgagccaccacgcctggccaaactttaaaatttttaactttttgactctgttgtactaacacttagtttaaaatattaacatgttgtacaactgtacaataatattttctttatatccatattttaaaaggttttatattttagaattttattttttttcaaactttttcattaaaaactaagacacacacacattagcctaggcctatgcagggtcaggatcatcaatatcactgtcttccacttctgtattctgtcctgctggagtgtcttcatttcaggggcaataacatgcatggagctgtcatctatgataacaatgccttctggaatactcctgaaagacctaccagaggctgttttagataacttaaaaaaaaaagtagaaggagtacactctaatgatgaaaagtattgtgtagtaaaaatataaactagtagcatagttgtcattaccagttacgtactgtataaaattgctatactttatacagctggcaattcagtaggtttgtttgcaccagcatcaccacaaatatttgagtaatgcattgtgctgtgactttaagatggttactatgtcactaggcgataagaatctttcagctgtgttctaatcttatgggaccattgttgtatatgcagtctgtcactgaccgaaacatttgttatgtggtgcatgactttatatacattttttccagttagagtgtaagcttcgtgagggcaaagattgtctatcttattatgtctgtagcatgtagcatgttttgtactgaatggatgtggaggcaatatccgtcttctgcaactcacagtacagcagaggtgagccatatatctgtttagtacaaagtggactgtagttattatgctacagtgtagaggaaagtaatttaaaaaaatgtttcatgagtgtttaatgaaataaatattttcatcaaggtggttaaaatggaaagtttgaccctcaaaggggtaagtcataaaaatcactcacttagaatctcatgctgaataaatgagacctcagtggtattcatttgtttttccttttaaaaagtagacccaagaaacaactcatggcaggtagtcttctaaatttaaaaatttaagttctatatggtcgtatgaatctgttttaagttaggttgaaccatacaagattgctattttcattctcaaatgttagccctttcatatattttagccttacaatatagataaaattgctgatttttttggatgggaggaattactgttcatgttgttcttctcttttccagtatgcattgcctcttcagctagtgaataaccaaaccatgacaacatggatggagatcttccgaactattatcgacaggaccgttcctcctgtaagaaaaagcttttcccaagaaaaataggggaaacgggtttggaatgtttgcggtagactgatgcattatccctgactgctctttgaaaaaatttactactttaataaaataaattaataaaataattcataataccatttttagaaagcttagataagcaatttaaatcctaccaaaaatgaaaactgtttttaaaactttatttctttagtctttttttcctctgcatctatatacaacatatttaatttataaaagtagtatacgttggctgggcatggtgtctcacacatgtaatcctagcactttgggaggccaagctgggaggatcacttgaggccaggagttcaagaccaatctatgcaacatagtgggaccttgactctacaaaatgtaaagaaaaaagaaaaatagctagatgtggtagcatgtgccagctacttgggaagctgaggtggggggatcactggtagtttgaggctgcagcaaactatgcttgggggacagagcaagaccctatctcaaaaaagaaaaaaaacgtattgataatattttgaaattcagttttcacttaaaacttacaaatatttttatgattatgaatgcttttatactgtctttttttcttttcttttccttttttttttttttgagacagagtctccttctgtcacccaggctggagtgcagtggcatgatcttggctcactgcaagctccgcctcccgggttcacaccatcctcctgcctcagcctcctgagtagctgggactacaggtgctcgccaccacgcccggctaattttttttttgttttttttgtttttttttttagtagagacagggtttcacggtgttggccaggatggtctcgatctcctgacctcgtgatccacccacctcggcctcccaaagtgctgggattacaggcgtgagccaccgcgcctggcctatactgtcatttttgttgaatgttttacttgctggatgtttaggctttaattttttagtgttttaactcttaagaatgtacttaaatttttgtgcacatatatgattattttctttggataaactagaaacatggaaggcttttcactaatcttgcagagtgctctgcaataaagtgtgccctcggttacactttaataagcagtgactgagaatgcctgttatgggtacacacttaattctaagtttgtccatttgatagggaaaagatgtgtttcattttgatctgcaataatactatctttaatttatcacattagttcttgtatctattaaaattttagtttgtcttaaaatgtgcagtattatttctcttgtccatattgtgagacaaagtattttgacatttagcttacatacataaatgcacagaacttaatgactagttcagtgaattttgacatacacttgtgttatcacccagataaaaatgtagaaccctttcatcatctcagagtgtcctgaaggaaccatggtgttttgtattttgtcctctacttatttaggccttttgaagacaggaggtaaatgtgaacagcagcattgtttagttgaaatttactttgcttatttaattcctgcctagcaatctataaagaattttcatttgtatagcaatctaacttcacatttaatatgacttaacctatatcaagatttatcttgcctttgttattcacataaatccttttattatgcagaactttaatctgggtaattttgtcctgttaggagactctgcacattgatgaggatgatagaccagaactggtatggtggaagtgtaagaagtgggcactgcatattgtagctcggctctttgaacggtaattatctgtttattacattgatgatcatacagccagtatctcagtatcagatatgattatctgtctttagagccaccgagagccaagagtcactctgtttaaagtagcttaattttaatcattggctttgagatcataatgaagtgggtggtcttctctggatcttttctattcttctgtgaaaaacttggaaaaataacattgttcagcccattggtaatatctaagaattatgcaagaagttgcatggtcactcaactccgtaataatgtcaaatttaattttaaaagcatttattgaaaaaaatctatgtcagttgtaacattttaatttccaatattcaccctttaggagctcttggtttagcaagtgaaagcttctgtctgaaactttacagtatggcccatagtctaagtacaggttatcttgatttcattttgtggcttgtgggaaaaaaaggcagtgttagttttctgtcccagtagaatccatctttgaataagggactatatttaaattattagcaagcatgctgtttgtaaaattcacggtatttgtacattttctctttgtattttaagatatggaagcccaggaaatgtcacaaaagaatactttgaattttctgaattctttttgaaaacctatgcagtgggcattcagcaggtaataaacttatgcttttaaaatagaataatggttactactgaaagtaaaggcatttctgtctactggaagtaggttacaaacatactaattcattacatatttatagaggatggaaggacagttctgggaatgtattacagtgcaattagttttaaaaccaagtttccagtgcaattagttttagaaccaaatgtcccgagacagccaccaccagaactgaatcctagactctggactcaaaccttttaagttgatagtggtgtagcagtcaccagtattagattgggttcttctattaattctctgacctcttatgagttttttgatctttatttcttcacctctttgttgtaagtttttattttagaagacttatataatatgaattggtctgtatgaagagtagttgagcttactagacgtcaagactcttagctgagaacttaaacatttctatggaagtttggggaccattctatatagtgaaaattagttcctgaaacaatccaagttgacataatgtttaaaaattttaaaagctacaaaggacaagtggtccatgaaaattggttgatcagtgttgccgtttaaatcatatttttatgtttcaataaaatttattaattattgaccactggctgtgtcaggaccatattgaggaagcaaagactaattagacatagggaaaagctttactgacatagaaggtgtttctagattttttttttgagatggagtctcactctgttgcccaggctggagtgcagtggcacaatctcggctcactgcaacctctgcctcctgggttcaagcaattctcctgcctcagcctcccaagtagctgagattaaaggcacacatcaccacacctggctaattttttatatttttgggtagaggtggggtttcaccatgttggccaggctgatcttgaactcgtgatctcaagtgatccacccaacttggattcccaaagtgctgggattacaggtgtgaatcaccgtgcccggctctagattttttttttttaaatagctctttattgtcagcattataatgttaagtacttagaacctgttgtcttgagatggaatacttccgtttatgtgttatcattttgcctagtagaatgctttctaaaaagtacaatgcaacagttcaggaaagttgtagttatatagttgaatttctcacaagttattttgttggctggtgagacaatctatagggaaaattagtgaataaaaccaggacaatcaggaagctggtcatctgtcttctgccccttccagtgctgtccactaatgttaaactccttaaagtatcttaaagttaattcccacttgaagtgtggtgagtcaatttttttttcagtgtcataaacatgtatgtgtgtgtatacatgtatacacatataaaaatgccattatatccgtgttataaactcttggtaccatggttatttaaggatatattcctgatacttaaaaatggttttcttatcagggactcttctctcccccactgttgtgtagggagagaatctcccatttcccatctcccatcacccctactttgtatgagccacatctgtattagaaagaatcatgttcagtatcatccatttctagcttgcatcacagaaggggtttctacatgatgacaggacttccgacaaatttggtaaacctgagttttaggaaacttgaataaaatccatattctgaatttataatttctgtacctattttgaaagaatgctttttatttattcagcaactcacttataagcttgatatggtgaagagctctggagaccaggaattggaaggcaacttgctgtagtgaagaaagttgcctaaaggtccttgagccagttcagaggtgctttggcatggctttttccttataaataattttttaaatcagtttttaaaaaatcagtttttaaaaaataacttctcagttgtgttgtgtttacaaataccttcttttataatctgagattataaaagaaaattctcccatgttttctttaaggaatcctgtgctatcattttttgtcagtgttaaaatagttccccatctgaagtttattttggtgtgaagttgagggagttaatttaaattttttcagggggctaatcagttatgccaatactattttttgaacaacttttctaatttgaaggagtctttatgaaataaagaaacatctttgtgctgtctcttgttgtatggaagtttttaatgtttctttagtcagatctgttattgtaatttttttttttttttttttttttcttgaggcagagtctcgctctatcacccagggctggagtgcagtggcgcgatctcggctcactgcaagctccgcctccggggttcacgccattctcctgcctcagcctccccagtagctgggactacaggcacccgccaccacgcccggctaatttttttgtgttttcagtagagacggggtttcaccgtgttagccaggatgctctcgttctcctgacctcgtgatccgcccgcctcggcctcccaaagtgctgggattacaggcttgagccaccgtgcccggctcctgttattgtaattttttaaacaggagttttaacttactttgaagagctagcagtggaatagaaatttagactttgcctggaagttacaatgagacaccgtttagttcaatataacatggacctgtctaataattaaagctgtttatctgagctttcttacaaaacattgatttttctcccaaatctgtttatttttctatggattctgaattttaggtcatgccaaaaatggcacctcccccttttaaccttataattgtttatgttagtctgtattttctgttttcttataggtgctactaaaaattttagatcaatatagacagaaagaatatgtagctccccgtgttctccagcaagcattcaactatctcaaccaaggggtggttcattctataacctggaagcagatgaagccacacatacaggttagtgtcagagagcagctctccaaaattattctctggttaaattaggttttctagacaaagttagtattactaatcctatattttacattttatatatatacattttaccattaataatttctaatgagtgaagtcctatgtcagatataaagggcttagaaatttaagcatttgagaaaagtgaagccttcaagttttatgagtcgggagacctggattcacttgatcttgcttaatctcattaagcctcattttctcctctattaaggcacatagtgtttttctattcttatctaaaagttgctaggattaaatgaggtattttgtgagaaagtattttgaaaacttaccagggctctactaaggtagtgttattttgcaggaattgaagactgatatgtgaccgttttattttgtaggtatgagcaaggtttttatttattttcttggattgttaagttcaatagcatcattgtttctatatcgtttgcctaaaggtagaattcagtattgttatttagctaaagaacaaatgggaatggaaaattataggccactaataaataaatacttccttgtatacaaataattggataatttgacagtcttaggaactgaatacctactctctcccaaactgtgaattcttaaattttataaatgatatctgaaaagaaaaatctttcactttgctgtttgctgtccaggatagaattttagtgttattacccgtcttaccaacagatatcttttctttgatttatgtagatatcttaataactatttgcctaatcactttgatcaaatagtgataatttctttgcaattaattaataaagatactgatttcatttgctgtgttcctgtaaagtaagggtgagttgtgataacatttcttctctacttcatacctttggctttatttttacatagctgtaaagtaggaataagaaaacgctgatccttaggctgaattttttcacttagaattatttaatttggaattaagtggtaagagatgatcctgtttttatataaattgttgttagagcctaaaagggcttaataggacattagtagcagtgcacagagaggctagtagataggacttttctctaactgaaacatttgtggagtaggaaattagtttttttgggaatagaagtaaagaaaattccaattttttttttttttggagctggagtctcactctgttgcacaggctggactgcagtggcatgatcatggctcactgcagccctgagctcctaggctcaagagaccctccaagatggacgccaccatgcttggctacgtttttatgtatttttttggagatggggtctcgctacagtccccaggctggtcttgaactcctgtcctcaagcgatccttctgcccttgggcttccaaagaggtaggattacagacatgagtcaccatgcctggccctttaatattgttaatacatggacatttacgactaaaatggaaatgttaaaaaaaatttcaaaataagaactataatagtaaatataacctcgacttgacattttacacacacacagagtttggaaaactaacatcataaaggctgtcaacaagtacattattagtattcctcaaacttgaatagcctatacccatttgttacgtttttttttttttctcattttagaatatctctgaagatgtgattttttctgtgatgtgttataaagatgaggatgaagagctgtggcaagaagatccatatgagtatataaggatgaaatttggtaattgagatggttttatttctcatcagttcctggatatgtaaagtaatataactaaatttatatttttaagcaaatgttattactttattaaatctcccaggttctgttttgcatgacataatctgaaactttgagagtttgatgttattttgttgaactagagaactggagattgtcggatgtgggagatgaaaagccacctcattcatctctcttacgggtgctcaagttgagccatctgttacttatgctgttgcgatgctgatctgcagggaccatccgtttttgtgccttttgggagactcatttatagattgggttgttctcatgtgggaaatagtttggatttctgcatattttaggggtaccccaatttggtttgcttgcttgtctgagagactaagtgttccacaagggaaataaatttcgtatgggggccctactgtgtgtggtccaattctttgggtgtccttttaacttggatcttcctggaaactgttgaattgtgtaggtggcctgatttattcccttttattcccagtttgtattaattgcttcatggaacactcaagcacttaacatagcaaaatattaatttgcatacctatctcccacaacttagaagctttctgaggacaggaattttaccttatttgcttaattttgcattttctctctcttctacacctctgcattcctccactagtgcttggcctccagtatgccttcaatacatgttgaaagaaatgattgctaaatctagcgctgcgtgctgaaagtgctgtaatgaagcagtgctttccccttagttgagccaggtgtgtctagctacgtaagctaaacctactggtacagatgctagttttttgggctgtgtttttacagagctttgtgtttatattatttgattcagtaagtgaggatcctgttttctcttggagacaaagtatcagaaaagcaaatcaatgagaaacatttatcatctgcttgatttgttatttttcttttgaaaatcattattcatatgtgtaacttattatttcccctttcttatgcctttgtttttctagtttgctttgagtgattagccaaccattcttctctctctctctctctctcttttttttgttccagtgactctcccacctcagcctccaagtagttggggccacaggcatgtgccaccacacctggctaattattttttgcagagacagggtctccctgtatttcccaggctggtttcgaactcctggcttaagtgatcctcttgccttgcaaggcattcttttagtgtttacttctttcataatacctatgtgtttttgtgatgtacagagtatttgtttagctttcagaaagttaccattatttatatattcttcatatctgataagataggtatacataccctagtttttagaaaataagaactctatgtctgttgattaacagtgggaatttacattttattgtttaaaagcggatatgggtaactcaagactgactagctgaattgagttttctttaatcgtttccttctgtagactggaatgcagtggcttttatttgatatgtgtattttacttttgggtaaccatagggaagaacaattactgcattttctttttatatgtttggcacttgcaattatttacgtgaaacaaagcattcctatctaaatgtattgactgattaataataatgttttagttttttctttttatctactctttaaccaacatctcctcacttcccccaataatgttttttgatttggtaagaactaacaagagctcaggctttgatgttaagatagcgtgggtgtgaatgctggtttggtcacttacctgctgtgtgactgtggacaggttacttaacctctctaaaattcagtgctttcagctgtcaaacgggtgatgataatagtgctgggaggattaaatgggataatacacatgaactaactgcttagcatagaatacaagatgcttctaaaactgtagcatactgcttggcacagagtaagtacagtactccaaaaatgttcttattatgtttgtattttatattttgaggtagacttagatttggttttatcttttgtatttaaacaaggacttatcagatacctctcaagacttcagtttcttatgtaaaactgcctattctgaaacttgtgaaaatgttcatggtattaagtgatatgttaagttttagataggtatatattcaacgaaacctgctgaacttacgtatcgacagagccaggcatggtcctagcagtccttcaaggcttttatacttgctgtttcacctgcttggagtactttatccatggattgctttctccctcatttcattcaatttctgcttaaatgttaccttaacagagttggagaggcttttgctaacaccctatttaaactagcaccccatactctgtcactctgtctctttaccctattttacatttgttcttagcctgacttattatgtgtgtatatatgtataatctgtttctttgtttcacgacataagctccgtgagaacctttttgtttgatctttgtatccccagggtctagaatggtacctggcacatagtaagagctgagtgaatttttgttgttttttgatagaaataaagcactttttctgttctcagtgaaacagatgtgtaaatgcattgttttcttcaatataatagtttgaaaggacagcctgtagagtttgaggaacattgttttgtgcaggagacagcaatgttgtggtgccactgtatatccttacctttttagtactgtcaagcagtgtcatatgtggatggttttatttttttggtttggaatagcggtcagtcaggtttaaaatctagaataagtaattatattttcactaacatggttttaaccttttaaaatcttagatatttttgaagattatgcttctcccaccacagcagcccagactctcttatatactgctgcaaagaaaagaaaagaggtatttcatttttctttttaaatccaaaactgaaaggtggcctgtgttgagttgatactctagtatatccctagtatttgagaaattatgttgttattcgttataatttgtcaccttaaggattttttttttcctctcctggtgaggggaaagggggtatcatggttatttcgttttcttaataaattatacttttcttattgagcttatagttgcttgataaaacataataaaatggctttatttttaaaaatttgtgcatcatagttaatactatagtaagacaatgaaagttcatgtagactaaatggattcttctgtttctttaggtgttgccaaaaatgatggcattctgttatcaaatcctgacagacccgaactttgaccctaggaagaaagatggagccctgcatgtgattggttccctagctgagattttactgaaggttaagataatcaaaatttaatttacttaataacattgtaaagtacaggcaaatgagagaatatgaaagttatggctaatttaaagctggtgactacctctggataattgagttcacaactatcctcctttctgtcatctatttctttaattaaaaagaaaatttgactgtttaaagttttcagtatgaaactattgatatgtgaaagggatacaaagtatcttatgtctacaaaatcaatcaatatcaaactgatataaggtaatatttgtcttgttttaaaacatgcaatatataggtcaaataattttacaaaattagaagtatattaaatgcaagtcatagtaaacacacttgattaggaagtgattcttacgtatgaaaaagaaattgataagttgaaatttgtttcctaatagaagagtttattcaaggaccaaatggagctgtttctacaaaatcatgtatttccattattattgtctaacctgggatatcttcgagctagagtaagtttttcatatttctgttatgtatcttaaatcttcataagataattattcaaataaatgttttttggacaaattgaccttttgccacatattgagatgaaatagagtcaattagaatgtctgcctatggtcacatcagctgaataaaggacagactattaaagaaaaagatttataggctgggcgcagtggctcatgcctgtaatcccagcactttgggaggctgaggtgggcggatcacttgagatcgggagtttgagaccagcctggccaacatggtgaaaccctgtctctacaaaaatacagaaaattagctgggcttcatggcaggcgcctgttatcccagctactagggaggctgagccaggagaattgcttgaacccgggaggcggaggttgcggtgagctgagatcgtgccactgcactccagcctggacaacagtgagaccctgtcttaaaaaaaaaaggaaaatatttatggattttatttcctgctggttttatttcatttgtcaccctagcctcacttgctgcatatgtaaaacatgaaatgagaaaggtgattttatagcagtgatacaatttaaattcacaaatggatttattttgtgtataaaatgacatgaaattccagattggctaagaacttgaatttgattttcagtatattaggtagatttgccttagtaaaatggagagattaataatccatgtgaaattgtgctctatgtgtatattcttttagaatcaatatattttatggagaaatagaaacaggacttttattcaagagcctagcatttctctttataaatatatcaacacaaaaatgtcttgctaaaaacaacatatattaacaatgccttgtacactagaaagcattttataaaataatagttactagcgcaatatctgggcaaatgtggactagggacgctgagggcacatgagcatttttacagtggggctcctacctttgagaagttatatgaattgtgattctcttgctaaaagtctttagtaactagaattaatttctgttgattgtgtttgatgcacacagagagtaaaatataataatgattctgtggtctaatagttaaaatgtgatcatctataccaggtttaaaatttttggtacctatgagagtgaaaaaaaggaagcttactaaaccagttagtgtaagggaaaataatgttttacctaagtgtgacaaatgaatttcagatactggtttggagttgcttttacatataacaaattaattatgagttataatatttattaaaagcgtaaatagatttttgtcaaagacatatttggcttctttttctctttcctatgaaaaatgttattgcatatgggtaatttagaagtaatgaaaatgccttacttgtaaaaagggggatgtagaagttagaaactaaggctactgtgttaccccaaaagcaaacatttcttcatagaattgatattttactaagaagttcttatatctgtgatattattacagaatgctataatcctaatagctccctacttaccttttttaataatacagtcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaaggtaaagccaaaataccttttagacatcttctcaaataatttcatttactttcttccctaatgaagatgcatctccatgtctgagggttcagggtttggaattctgaggttttgccctctcagaattttgtaggaatttattcttgtcctttttaggtgttcctattgactgtagttttcagaattttaggttaggaaacatgttaatcattgtggggccctaggataggctgggcataaagagacctgggcccagttttgattttgctcctaacttgccatggaaacctgggcaaggtgtgtgatctgtcaaggctcaggtttccacatatttaagtttaggggagttggactgaatgacttcatgattcctttcacctctgggattctgattcccctagttttgaaagtagcaagtagtatttctagtgagtgataacagacgtctcatttgttcagagtgttctgatcaaagttcaaataaacctttgaaagtaagttcagctttatgaagaacatgaacgtagtttgcctctattcagcaatgtttcagtgggaggattggatattgtacacatggcaagggagggtggtagagatggcctggggcagggaaggggccccatcagtattcgggatagtcttcacatacatgattttttataacttgtcatgagaactgattcatgttttccaagtcattctgatgaccaagtgtatgtataattagaatttctcagtgggggctattagtattttgggatagtttctgcacaggacagttctctcctgtgcaggacttcttatccttatattactcttgggaaactgatatattggtgaacattatttaggtacagctttgtaacttaccacagagcaagtgtgtatctagaacctgatttaggtattaccctgggtcacttgaccttgtgaccaagttaattccttttatcatctgggcatggtaatttttattacttttgtttgttttattgaattagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggtaagaccgggcagttttatgttaatttggtttagaaaccttgagtaatctaaataaactccaaaatatggagttcagttttatttgtacagtcatgtgctgcataacaacatttcagtcaatgacagattgcatatacgatggtgcactcctaagattataataccgtatttttactgtaccttttgtatgtttagatacaaataattccattgtgtcatgattgcctaagtattcactacattagcaaactgtataggtttgtggccttggagcaataggctatgccatctagatttgcctaagtacattcaatgatgttcaagcaaggatgaaattgcctaacgacacatttctcaaaatatatccatgttaagcgatgcatgactgtaactggaatattgataaaaaaattattctgatattactatagttcattagactttaatcacatttaggataatttctttcatctagaatattctgaaattttataatatgtgctttctaaagttttaatttctgggctttgaatcaggaagctcatttccttcagtttggggcaatttattgttttacttttttgataaatttctccttactatttttttttctgtttgtatttcctgatatggagaatcacatctggactgtgtctcttaatttttttaaaaacttttcctcctgttttccatgtctgtttttttttttttgtttgtttcattttctaagtgattcctcgacttctcaatcttctattgcatttttctttttactattacttgatttcacttgtcctagattgtgattttacttgcttagtgacaaccagaagttaaatattagctctctggatataatagttaatgtaaatagctatatttaaaacatgacaagttctgttattttaagaagagagatgattcagtcagcaaagtgcagacttcaaagtttgagcaatgcagacttcagatgtgtgacactgccattttgctaacttttgtaaagcggggacgtaacagtactactaattgcggaatactttaatgttattttcataggctgagatatttggcaaagttcttcaaagtgatgaatatgaagaagttgaagacaaaacagtaatggctatgggaattttacataccattgatactatcttaacagttgtagaagatcataaagaggtgagatttctttgtggtttatgatagtagcatttaactgaaatttatgtgatcagtggccatgaattttgaagtctccacttttaaattgctacttagttatgttgctaggctttaaaaattgccctcacattttatggaaacatattaaaatgactgagtaacattataaagtatattatattataaatatatattatatttatataatattataaagtatatagtatatccctttatattaacttgagttcagttaatcatatctgctatgtgccaggctaggttcttggggaataccaaattgaataagaaatgagcccagctttctgggaaccaacaatctagaattcttggtagagagtgacagacagcagttcaatcacagtggcaagtgttaggtaatggaacagaattctgatataacaagtactgtaaaaatggaaaggaataaatgaaagagctgaaaagcatatttactcaactgaattccaaagtgttattgggataagactttatacagctatttatctagtgctttcacatccatcagctgatgtgatcttactggtgccaccatgacatagctagcacaggtaatggtagtctgttttgcagaagcagaaaacaaagttcaggtggatttaagaaacttgctcatggtcccagagctagtaagttgtacatttgggtttgtagtcacatcattttgataatgtatcagtttatccccatttaaaacctacagctgcttcccaagtatcccatggcctctccttaactcaaattagatttttgttcattgcttctgtgagtgcaagttgacttgtttggcactgatggcaattattgttttacaaggtgagcacttaggaagcaggtgctagtactacttttatttgtttatttaattttttgagacagtctcactctgtcacccaggctggcgtgcagtggcatgatcttggttcactgcaacctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttccaaattaaattacaagtaaatttaagggatagttcttttgtcttatacttaggacttgtattttaaatttgaagagaccttagtaaatcaccttatccagttttcacaagtgtgtgtggggcgtagtagcaatgagctgcaggggtagtttaaaaacaaaacagcatcttttctgtttttattttttctcttgatattaaatttattttgaattccaaataatgttaaagggacaggtgaacttattgtgattatcaagagaggcatgggtgaaaattgagacacactaatatagcatccttacctaaagacaaaaaaaacctaaagccttcagctaaatggctttaccaaggccatgaataactacaggcaaaaccaaccggaatcttcgtctcttgaccaagattttgagctttaacttattaaaagcaaactttgaaaacaatatttccttaaaaggaaaaaccacatttatgaaacactgacaaatagtgtatgaaacacaaaattgtgaatctaaaataggtgcttaagcatatgcatttttgtttaatggttttaagcatattgacagttttttaaagtgggaaattttggatcatttgaaccttaagacagtagtttaagttgaatattagaatatacttgatggttgaaataggacatttacacgaaaaatgtaacccgtcataggttttaacttattttaaaatatttgataccaacatatgttgaaaaattcaaaagatgtgaaaagaaaattcagtgaaattttaccttctcactcaactccccagctatctaattctcctctctggaagcagctatttttttccttttttttaaaccaggtttttgggtccttctagagatttttctattaacatataagcaaaaagtgaatgtgtatatttttcttttacgaaaatgatagcatgctatacacagtttttatttgccatttttaacttaatatatcttgatgatccttccatgtcaatcaataaagttatatatttttaatggttgcttaatattcccttgtatgatgtgtcaaatttatttcaccagtcccggtttagtggatataatttaactgtctcttgtttaaatgggcatttgattgctagtaatcacaaacattgctgaaatgaatgaatggccttttatgtgtcattttgcacacataatatgtgtgaagggtaaatcccttgaagtggaattgctggtttgcatcgtgatttgtatgggtaagtttgaaggatgttgccaacttgtccttcattgtgtataccatttacactccagaaatcaatatacaacagggtctttcttcccagccccataattgtgatcatttccagtcttaataggtgaaaattgttaatgttgcacttggaatttgtactcttaccatgtattataacgaacatctttttataaacacaggcaaagattataaaaaaagaaacacatttgttttctattgtatttcaatttttaaaaattcactaattttatgtaaggggaatttgatctttgtgataccatttgaaaatatttcactcatttttttttacttccccatgccccatgcaaaattctttaattttttagtcagatgatttcattcttttcatttcttatttctgggctttgagtcactttcccttttcaggattatacaataattctttttattctatttttttatggtttatttcttcacactgaaatcttttatctattaggaatttattttggtataaaatatatggtaaggaactaatataaattgttatggattttacccccatttctgtcagtctatttttcaaaattttctgattattcttgcatgtttagtttttcacatgaagtttagaattgtcaagttaccgtctcaaaaatgtcctcttgatatttttattggcacaatattaaatttatgtattaattatgataattttaagcttaatatttaacatttatctttagattacccagcagttagagaatatctgtctacggatcattgatcttgttctgcagaaacatgtaattggtaagttcaaaggttaaataaaaagataaattgaaaaaattttaaaaatttgaactcaaagtataattttagcccttcagatttaacaagatggacaattttgagaaagagaagcataatcactttaatttttggatgtcctttctagtgttaaatatctgtattttcattcagagattaaaaattatacatccaacgaataatttttgattttagaattttaaaggacagtaattttaaattgtacattgctagaaatgaactgggatgaggtttaggtgaggttaccttaatctgggattgaaaaatgtttaataggcattttttaaaatcagaaatgtgaaatggctgggcaccgtggctcacacctgtaatctcagtagtttgggaggctgaggtgggtgaattgcttgagtccagaagttcaagaccagccagtgcaacatggtgaaacactgtctctacaaaaaataaaaaaaattagctgagtgtggtggcatgtgtctgtggtgccagctactctgtaggctgaagtgggaggatcacatgagcctggcaggtagaggctgccatgaattgtgattgtgccactgcactccccctgggcaacagagtgagatcctgtctcaaagtatgaattaattgtcctattatctattatggtacctgacttctgagtagaatcagtaactaatgctagatgttacaagctgatgggaattttgtagaggaggtgagtcttccatcgtattcaagcattttgaagatgctagccccacgtcatgtgggtgtgacacagatgcaagctgtgtagtactcagatagaaggatgcaggaaaagcctgtctctgattaagagcagttgtctccaggctttttattgttcactctgttagtaaaaagttgagcatgcactgctaatatatgtgaataatatttgaagagtacttgaatataacatggtagatataaacagtgggatactattcagccttaaaaaggaaatcctgtcatttgtgacaacatgggtgaacctggagtacattatgctaagtgaaataagccaggcacagaaagacagataccacaagatctcaaactcatagaaagaacagaatttagttagcaggaagtggagggaggggagatgttggtcaaaatggtgaccatagttagtaaccatgtattatatacttgaaaattgctaagagtagattttaagtggtgtcaccacaaaaaggtatgtgaagtaatggatgccagatttagtcattccacaaaatacatatatttcaaaacggtgtataaatcatagatacaatttttatttgtcaattaaaaaataaatatttttaaaaagtacatctttcagtaaaaagaccagtggttgccagggcttggggatgggagagagggaaggatgaagaggtagagcacagaagttttatgcagtgaaactactctgtatgatacaataatgatgaatacgtcactatacatttgtcaaaacccttagaatgaacaatgcagagtgaaccttaatgtaaactgtggcctttaattaataataaaagaatttctgaaagttctgttttggcctatttcacttaacatagtgtgtccatctctgttgttacaaataataggattttcttttttttttaaggtggactagtactccatcatgtatatataccacattttctttatctgttcatctgtcagtggacacttaggtattttcatatcttggttattgtgaaacatgcttcagtgaacataggagggcacattatctcttcaagatcctgattttaattcctttggatatatacccagtactaggatgacttgatcatatgatagttctatctttaattttttgaggaaccttcatactgctttccacagtggctgtttttactctctcaccaagagtatacaacagtttcctttttctctacatcccctccagcatttaactttcgtctttttgataatagacattctcgtagatatgatgtggttttgatttgcatttccctgatgattagtgatttaaaatatttttttgtatacttgttggccatttttatataatcttttgagaaatatccattcagttcctttgcccatttttaagttgggttattttctttctactgaatggtttgagttccttatatattttggatattaaatcttcatttgatatagattataaatattttctctcattttggaggttgtctgttctgtgaattgttttctttgctatgcaaaagccttttagtttgatgtaatcctattttgtctgtttttgcttttgttgtgtgtgctttggggtcatatcctcatataaaaaaaaaaaaaatcattccctggaccagtgttccaagtttccgtgaagcttttcccctgtgtttttttctagtagttttatcatgtcagatcttagagcttaagtatttaattaatttcaagtagatttttgtatgtggtgtaagatgagggtctaatttgattttctgcaaatggatatttagttttcccagtgccatttattgaagagactgtcctttctccattgtgtgtttttagcatctttgttgaaaattaattgaccctaaatgggtagatttacttttgggctttgtaatcggttccattggtctgtgtgtctgtttttatcccagtgccatgctagaacttttagaaattccatatttagataatttatttttcaaattattttcttacataaattatttatcaatatttgtaatttccattttattttgctagcttttgaatatattaagttttaagtaatgttagagaaaccttaatcaagtttccagggtgaccactagtttttataagaggaaaaacctttcaagttagacttctttgctcagtggtatggtaggaactatttgaaatttttgttgagatttgtgtttcctggctgtacgtgtagatataatttacttttgactgaggataatgatatttgtgagtataagaacatttcctttgaactcttctactttatagtgggtcttattgtcttgattaacttgaagaatactgtacgttttacaagttttgtaaattgacaaaatactgcccagtatatagttgttagtaaaagtataaatttgagataggtagatactttagtctgatataattaagctctccaaagaatattattaattatttgtacattttaaatcctcgacataaatgaggaatgataatctattccttcttgtatctatttctaatacagttttataaatatagattataaaatagaaaaaaactttattttttcaatagtataagaaagtttagtgaaaacaaatttttgccttgccttattgaacagaggggcagatcttggtaagaaatggaaggaggcagatacatagccgaagatacaaatactgagaaagggaggcttatgagtacattggatagaggaggactctgtgtgcgtaggtagtctaaaccctcctctgtgtggtctttgttttaacttttgctatttcctagcattctaactagagattttctttcttctagaattctatgaagaaattctttccctggcatacagtttaacctgccacagtatttcccctcaaatgtggcagcttctaggtatactatatgaagtgtttcagcaggattgctttgaatactttacaggtatggctttgaccatataaaatttttgcttttctgtgtctagatacttcttcctgttgacacctgaaataaaaacacatatgattccaatattgatcagaaaatgtttttatttcccggtcacataaaagctggggctattgtagcagtgtttttcagccctaggtatataggcagaggaggtaggctgtatttcttattgagtcttaagttagtttatgaccagagcatatatccatatattaatttaataagtattttatggacaccaactatattccaagccctattctaatctcagcaatccagcagtgagcaaaataaacaggctttgcccttttgaagcttacattctaatggggatgatgggagggtagggaatcacgcagacaaatgagcaagaaaatataaagtatgtcagatagggatgagtgtgcagtggagaaagggaaaaaattcagcacaattacttcataaatgatgagcatcttagtctttctgctccacattttccccatctataaatacacatcagacttattactttcatttctagccttttgtggttgcatgggaagatactaatgtgtgggtgctacagaaatatggtttcagtgggaataatttatttctatttctgtcactcaagtctcattgggattttgattttttttcagacatgatgcctctcctgcataattatgtgacaatagatacagataccttactatcaaatgcaaaacatttagaaattctttttacaatgtgtaggaaggtaagcatgacctaatctattgtttcagtggttcttaactaatgtttgcctgttttgcttcaggatactttttcagtttgtttcttacacatttagttctgcattatcttcatcaacatatattttttcatttgtattttcaaaaggatctttgggatttgaaagtttcatattgtgtgtcgtgcttatgaatgtttgccacttctatatctgtactttttactttttgttttttcttttggacatgaattttctacttgattgaagtgctaggaaaattaaccacacgttttgttaatcagtgacaaatggaatgatcttttttattttttaatttaatgtatatattggaagtcactagatgtaggtaatttgagcataaacaacataagataaaaattttaatagttggaaaagcatcatttaacaagataatctataatctacaatctacataatggctactgttatccttatacacaaacatgattgtctgccatattgtctttgccacaagataggtttggcccactattggttatcttttgggatctttggctaaataacggttttcttctcctttaggtaaataaataagtaaatatatacatacacacacacacacacataaatatgaaactgaaactatattgcataaagctggcaggcagattttataaagctcaaataaccagaaaccaaaacgtttggccgtagagctgggagtgaaatagctagtgtacaaccctcccaacacacttttgttttccttaccagaaggggtgtacccaaaatctggtaagagctctgcactgataatcagtagatctggtttaggtctaggtctcagttcagttctaaagagtcagggaaattttgggaagtcagtaagctgcttcaggtgtaaagtgaaggggctgaactgtgagttgtaatgattcatttacctctgtggataacccatgttgttaaatcataatcaccgggcagtcttcagttttccctgttagagaggtagctgatagagaaagagggaaagaaacaagtaaaacagttctgtgtattccattagtaattcacagcttcccctgtgtatttgcagatatagtaaaattgatgttcacaatgatttccttatgcttatcaagtagttaaaatatatttcatattcttttatgaatatgaaatactagttttaatactagctaatatttgtcgaattcttattgtataccagccattttctaagcactttctataatattaacctttatgacagtatgaggaaggtatcacatttgtatcaaaaggaaactaagacatagtttcttgcactatgctgaggttaggaaatagttgcaatcacatagctactatgtgttggagccagatttgaacctaatctgactccagagcctatttaaaaaattacaagatacatttttgttttctttccttttggcaaaccaaaacaaatggtccccaagtaaatgcaattttgagaaaagggagtaattatttttctttttgtatcatacgaccccatgaagtaggttcttttattcccattttatagatggggacagtaaaagaggttaagtaacgtttctaaaaacacagctaataagtggaagagctgcggtttgaacctaagcagcctggttccagagtccattcacatttagaagctagactgtggtatactgtcctagagatagcattttaaatttatgtaaatacagttgactcttggctttgcctgatatctgcttatcattcagctcactattttccagcttccaaaatgtgtattgctgttctctctacttttttctgtctttgtatatgtacatctttaaaatttctctgttgtcattttgatagcattttgggagagaatgaaattaaatgggaatgttaaatctgtcagaattatctggaatttcttaattaatttttcttaaattttatttttctagaaaatcatctaatctgagtttttaaatgtaaagaatatagtgttctttatagtattatttctaatctgtcttttgtctgtatttgtctctttcctaatatttttaatgttttgcttttttttcttcttaaaaataacttatataaaaagcttcttacttcgttaagtcttttttttcaatgaatttgcttttagttctctctgttacctctttttgtctatattttaaatttctggcccacccttatttctttaagtctattctttttcttatgtcttatatttgaatcattaatttattctttttaccttaaacaatttttaatataagcatgctctaggaacattattgggaatcttattataaggcagtcatattccacattgtatgtatgaacatgtgcattgtggaattgtttataatagtgaaaatacagaattaataataggggaactgtctgataactttgttatattcacctactgtcatattgtatagttataaatggttacaatgtccatgaaaaatattcctaattattaagttcatgttggagaattgaaaggtatgtaatatgaaattatggtggttatgaaaaaaatgggttcatatggaccaggattcaaaaggaacagaaaaatagtttcattgtttaataagaagattattttgttttggttttgatttcattttgtagttttgttgcctttaaagggaagcttcatttatgtggaaaattagctcatatagtctactttattaatccaaggtcaaataagtgaattattgctccttataagaaatgagatgatggatggaatttattttgaccattcttctttgggttggtgaggtaaacttgcacagcaagcaaagctgtggttcctatggctgaatttatatgggacatttgtgcatgtggacttgattaacctctatgcagtgccacttactgctgagctaaattgtaattactgcaggtactatgtggagatgcaggagaagatgcagagtgtcatgcagctaaacttctggaagtcatcattcttcagtgcaaaggaaggggaattgatcaggtaatatatgtctggaaagtgccttacttgagggttacatttgaagtttacatgcctgcttgacttttcatttatattatgatgaaaaatggaaaggacagcctatagattgtgctttctggtgcaaattctgtttaaatgacaaaaagagccaggtagtttggaaaccgtaccttgcattgtagctgaaaaaggtatgcacagaaaaatatgtaataatataaggggctatcaaaaaaataatgaaggaaacgtataaattctactcagttggagtctcagagatttcatgttccctttgttttgtgtatcctatttaaatactcctaggtaccttttctaaccagaaattaaggtactatagaaaaaaatatttcttgaccattttaaaaggctaaattttatactttatatttttcatgttataaatttttaatcttttttcaacaagattaatgcaatttttgatactattgtggtatgttcaataactaagaaaaatgttgaaatattccagtaaaattgaatttttcttttctgtaagttttgctttatgtatttcttataatagttttgagatctaattcacgttccatacatttcatccatttaaagtgtatacatacatggtttttagtgtattcaaagaattgtgcaactgttacacaattttagaacatgtcattacccctctcccaaaaaactcattaacagtcactcgccccaagctctgggcaaccactatgactttgtctctatagatttgcgtattctgggcatttgatgtaaatgtaatcatcttatatgtggtccttcgtgactggcttctttcacttgtcataggttttcaaggttcatctgtgtggtagtgtgtattggtactttatttcttttaatgccaaataatatttcattgtatagttaaatcacattttatccattcatcagttgttggtcatttgggttatttttactttttggctattatgaataatgctgttaggaacttttgtgtacaagtttttgtgtgaatatgttttcatttcctaggagtggaatatggtcattctgtgtttaatcatttgagggactgtcaaactgtttttaaagcagctgcaccattttccattcctacagcaatgatagagggttccaatttctttgtgtttttgccagcacttatttcatttgtgaagtagtgtctcattgtggtttttatttgcatttttatgatggctaatgatcttgagcatgtttcatgtactgattagccttttgtatatctttttttggagaaatgtctaatcggatcatttgctcatttgtaattatttgtctatttattgagttgttggagttcattatatattctacattgaagcctgttatcgggtatcatttgcaaaattttctcccaatttgtcttgatggtgtcctttaaagcacaaatgtttttaattttgatgatgtccattaatttttttttatgattattgcttgtggttggtgtcttttttttttttttttttttttggagacggtctcattctatcacctgggctggagtgcagtggcacaatcttggctcactgcagccttgacctccaaatcctcccacctcagcctcctgagtagctgggactgcaggcacgtgctactacacctggctaatttttgtagaaaagtcctgggactacaggtatgagccactgtacccggccgttgtcatatttaagaaacattgctagctccagtgtcatgaagatttatcctcttttgttctaagagttttatagtttttttctcatatttaggtcttgatctattttgagttaatttttgtacataatgtgaggagggggtctgcattttaattcttttgcatgtagttatgaagttgtttgagcaccatttgtggaaaagactattttttccccattgaattgtcttggcattcttgtcaaatcagttgactataatgtgagggttttttctggactcagtctatttgatttatgtacttatctgttgttattccagtactgcattgtctttattactttagctttgtagtaagttttgaggtcaggaggtttgagtcctgtaactgcattcttttgtgagattgttttggctagacagggtccgttaaattttcatacgagttttaggatccgtttgtcaatttcagtaaattagccagctgggattgtgacaggcattgtgctgaatctgtagattagtttgagaagtatttctgttttaaaaatagtctttcaatccctgaacgtggggtgactttcttttatttaggttttctttaatttctttcaacaatgtttggttgttatcagagtataagtttttcaattctattcctaaaatatttttatatattttctttttgacgctattgtaaatggagttgttttattttcaggtttgttgccagtgtatagaaatataattgtttttgcatgtttatcttgtatcctgcaaccttgctgaactgatttattagttttaatggtggtttagtggattttttagaattttctgtaaacaggatcatattatctacaaataagagttttacctttccagtttgggtgcctcttatttttcttgactaattgccctggctagaagctggagtgcaatgttgaatagctatgatgaaaagagacatctcatcttgttcctggtcttaggagggaacacattcagtctttcaccattaagtctgatgttacctgtgggcttttcatatatgcccttttgtcaggttcagttcttgactgttgctaacttgttgcttttatcatgaaagggtgttgaatgttgctgaatgcttttttctgcatctattgagatgatcatgtagtttttgtccttttagaatagagatgtattacattaattgattttcagattttaaatcaaacttgcattcctggtataaatcacacttatcaaatatgatctctgtatgtatttctagattaaatttcctggtagtttttaaaaagtatttttgtgtctatgtgcataatatatattgatctctaactttcttttcttgtgatgttttttgtctggctttggtatcagagtattgttggactcattgaatgagttgggaagcgttcatcctttctctttgttcaaagagttgtgaagaattgctcttcttttttaaatgtttggtagaatttagcagtgaaactatctgggcctatttttgtctgtgttttgttttgttttgttttcggtgggtagttttaaatggccaattcagtctctttatttgttatagatttattcgtagtttacatttctttttaaattcatttcagtagtttgcatcttggaatttttcaacgtaatttatctaattcattgcacgtggttcatagtatttccttatgtctttttgtatctgtaggttccatagtaatgaccctgttttgttcctgggtttagtaattagagtcttctctctttttttcttagttgactaaaagtttatcaattttgattttttcaaagagctaacttttggttttgttctctatttttgttttccatttcattagtttccactctaatccttattttttcccgtctgcttgctttttgtttagttgttctttttccaatgttttaaagtaacaggttagattattgatttgagatgtttgcttacacttcttaagtccacaatttatatttggttctctctctgtctctttttttttttttttgagatgaagtcttgctgtgttacccaggctggagtgcagtggcgcaatcttggcttactgcaacctccgcctcctgggttcaagtgattcttgagcttcaacctcccaagtagctggtattacaggcgtgcgccatcacacccagctaatttttgtttttttagtagagatggggtttcgccatgttggccaggctgatctcgaactcctgacctcaggtgatcaccagcctcagccccccaaagtgctgggattacaggcgtgagccaccgcacctggcctggttctcttttacaatgcctgtatctttactgtaattttatctttgagatattgtctcatagctttctttaacagtagtttattttattctttaagcattatgatggccgatttgccattttcaaagttcatctttgtggcggggcgcagtggcttacgcctgtaatcccagcactttgggaggctgaggcgggtggatcacctgaggttaggagtttgaaaccagcctggccaacatggtgaaaccctgtctctactaaaaatacaaaaatcacctgggcatgatgccatgcgcctgtaatcccagctacttgggaggctgagtcaggagaatcacttgaacccagaggcggaggttgcagtgagccaagattgcgccattgcactccagcctgggtgatgagcaaaattcctctgtctccaaaaaaaaaaaaaaacaaaaaaaaaaaacaccaaaaagcaaagtacatctttgaggtttgtttggacctgagggagcttgctttgcctgtctccttccttggccatctctggtgaactgctggcccatctttttgctctcaatggagctttacttaccaccaaaatcttcattatttttgagaatgacttctgcctacccccaagctttattggggtattagtgacaaaaaaattatgacctttctaaaaaatcataaagttttactgatatttatttaaaaaccttttttttttttaatggagattggatctctcttttgcctaggctggagtgcaatggtgcagtcgtatctcatggtaacctcaaattcctgggcccaggtgatcctcccatcttacctcctgagtagctgggactgactacaggcatatgccaccatgcccagctcattttcaaattttttgtaaagatgaggtctcactatgtggttttggccgctctctaactcctggcttcaagtgatcctcctgcctcagcttcccaaagttgtgggattacaggtgtgaactaccacctgtccccaacaggtatctttgaaggctcttttctccctttgttattatgtactttttaggtgacatagtggaggtgaaaataaattatgatgttaacaaaataagaaggtagtaaagcacaagacatgagtggggctaaagaagtatttagttctgttgactggattttggagggttctgagctgtaggctttaataatggaaacataggttggggagaggttcagaagactatagaataaatccatgccaaagactttagaatccattctgtacgccagaagctggcaagctatggcctgtgctgtaccacaacgtggtggaaggtcaaaggggaagtggatgtatgcgaaggggcaaaacccaggggtgtccttgctttataacaacctactctcatgggaactagttcattcccacaaaaagtaattcagttgtgccagaatgatagtgagaagtcgctcattacatcacaacaggagaatggccccaaggcattcataaggggtcgaccactaccatgactcaaacacttcccactaggccccacctcccaaaacctgccacactggggatcaaatttcaacatgagtttcaggaggacaaaccatatcgagaccatagtagtattcaagaatttgtgtatcagaaagttaaggacacaaggtgatctctactgttagtgaggttaccattacaatgcactcaagtacagctgaaggactgtattgattggcattccattcctctaaatttcctgtaaattagtgattacatttagtgttgtcttggattcaggtttgactcaccaggctagagtgcaaatggcatgatctcggctcatgcacttcatgggtgatggtgtgtaattttactaggaggcacagtatgtctggtggtctctcatgatgttagtgttgctgatggtgatcttctaattctgtcatttcttctttattaggtgaaatattcctgtaaagagaaatgttttctcataaattatcaggctactttgagaaacagcttgagtatttccctttatttaccattattcaagataagtttcttacctagcattctccaaagatgatcagcaaaatgttttattatgttgtttggttttaaaaatttttagtatccttatgaatgtatagatccaaatttactctatgtgtttcagtgtattttaagtatacatagtttcatttttgtcccatgggagcctcttgaatttgtcttatgagcccttttaacctgattctaatagtctttggtagtttccttgctgtcttggtacgactagatattccaggcttatcttatagatgtctcgtcctagcctgggaaatggtattcaagactacaagctgggcacaggggatattcattgctatacatatatatctaaaacatatatatgtatagtatatatgtgtgtatatatataatatgtactatttatatatcgtattaataaattgataattagctacatatatactaatgcatattaatgtatataactaatatgtcgctatatatatatattcattgatattggattggtcattgtttctacaaaatagagccaagaaatatgttgtttggctttttttagtcaataaaacattaatgtacacagataattctttttttaattttagatttgggggatacatgtgcaggtttgttacatggatatattgtgtgatgctgaggtttgggtttctattgaacctgttgtccagatagtgaacacggtacccaacagatcatttttcaacccttgccccattctctcctttacctcttttggagtccccgtacctattatttccatctttatgtctctaatactctaataagcacagatttttttttctgtttttttgagatgaagtctcgctcttgtaccccaggctggagtggagtgcaaatggcttgatctcggctcactgcaacctccatctcctgggttcaagtgattctcctgcctcagcctcccgagtagctgggattacaggcaactgccaccacgcccggctaatttttgtatttttagtagagatgggggtttcaccatgttggccaggcaggtctcaaactcctgaccttgggtgatcctcctgtctcagcctcccaaagtactgggattacaggcttgaaccactgtgcctggccacacacaggtatttctaattcagattcatgactacattctttatccttaacctactcgattctgttctatatctcccacaccaaaaattctggttctcatcttaattacttgcttgctttatcccattaatggatacatttagtctcagactaattataccaacattattaccaagaaatggttactactgtttgttttttttagtagctctttttatctctaagatatgttcatccactagcaatatacagtgaaaatacagtcaaataattaaattttaaagttattaaaataatcctcatttggttgattcacttacttcaatttatcttaatttttagaaatagcttaatttgcactctagcctgggtgacagagcaagactctgtctccaaaaaagaaaaaaaaaaaaaaaaaagaaatagcttaattttttggtaacggatatgggaaccatagacacagttctaaggtctaatttataagacaaggtatattcagagaagtccagcttccaccctatccctctacccttcttcttcttctccatttcttcccctagttttagttcatcctttcattaaaaaacaaaacaaaaacaaaaaatagatattctctccttgccttcttaggtaaacggtagcatactatacattttctctgttgccttctacgctaagtaacatatcctgcagatcacctgatagtagcatgtggagatattctgcattccttctgcagctgcacagtgctctaattgtgcatttacgtagtagtccaaccagcttccataatcgattttgttttaatataatggaattcttttagttttactagttctaaaacttcacaattcctttatgttcttatggctttgtgtgtaatagtaaatacttgttaaaatgaaactttattttctatttatttaagctgacataattgtatgtttatagaatacatagtgatgttttgatacaatgtgtagtgatctgatcagggtaattagcatatccattgtctcaaacatttatggcttctttgtgttgagaacattcaatgtcctcctcctagctatttgaaactatgtattactgttaactatagtcatcccatagtgctatagaacaccagaacttatttctcccatctagctgtaattttgaaactttagttttaaaacatctcaaaaagagcttttcaaacttaatttatattttcttgtggctgcgtttatccacaactaattatttgaccatggtaataatttttaacatagcttatatgtgttatctcaaattagaacacagaatatgttgtatcagcataagtagacgtagagttaaactagttatctcatctttgtagagagctttatggtcttaaaagtatgtgtagtcatgtattttgatttaatatgttatcctaaaccagactaatagtctgctgacccaaatatatatccaatttggcctactaaaaagaaaataataaatataactcaactttctacacaaaaccttgatttttttaaaagtttaatttaaaaaggggcttatagtaagacctcagattttattttatagaaatcatttcagctcatcccctttaactgaaaataactattgggaaatagttctagtaaaattagttcatcaatattgcaccttagaattggagtcagattttattttaatgttcaggctccaccattttttctttagcctttttcatcttatattaacaggaattttctttctcaaaaacaatctgattacatcataattattttcagtcccatttatttatttccaatttaatttgtcaaagaaaatgacatgcagtgatttcaccttagatgtgcaagtggctgtgtccacatagggattattgacactgtttgagcgtggactcttacaggacaatcttcagctgactttaatttacttaagaaggaaggagattttctggcactgctataggacttgtttttgtctatttagtctctctaggttgttataataatataaatcttttaaatacctctaaaatgatttagtcaaaagtctcattgccattaagactgtcttatttattgagaatgctctgccaatattcagcttctataaaagttacttgggctgtctgtgtggttgactttcttttgcttgtcttctagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggtatgtgtcttttggattttacactgcttttctgtttctggaaagtttgctttttaatatttgtgtataatagcatgtacaaagataattttcatgtcttaggaattatttttagtgtattgttaatatttaatttttagaggattaagaatgcatttcagcagggtaatctagtggaaagaatgcagcctctgaaaatttgatgtagccctttcccgcttttattttttttatttattttttttaaacacaagtgtatcattgtatctctaggcaacaagaattagttgtctgtctgggttccatgattaagtgtcagtgggtaaaaacattctaaatggagttggatttctaaggatggtacccctctggcaaagataaaatgtaatgtcacagaatgtttaactctttgcagatctcagggatgcctgttctcaaaagtggagtcagaaggcttgttatttgtagcccaggtgctgccccagtaggagaatttggttttatgtgaagcactcttcctagttttcaaaaataggaagagtgaggccgggcgcggtggctcccatctgtaatcccagcactttgggaggccgaggcgggtggatcacgaggtcaggagatcgagaccattctggctaacacggtgaaaccccatctctactaaaaaagcacacaaaaaagctagcagggcgtggtggtgggcacctgtagtcccagctactcgggaggctgaggcaggagaatggcatgaacctgggaggcggagcttgcagtgagctgagatcgtgccactgcactccagcctgggcgacagagtgagactccatctcaaaaaaataggaagagtgagattccaactagtgttatgtgcccacctcaggtcacccaacacagattagtgattgtgttatgctagaaattgagctagctgtctaatttgttttaaaacactatctaatatgtaactggaaattaatagtattcttcttaagttttgtgagagatcatttagaaaaatttcctgagaggaacagactccccacagtggttaagacactgctgccacaggcaggagaagatggaggcctggattagggtggggcgttaggaatgggggaacatatttacaagctgctatgcgtgttctaatttttctacttgcaggacactggaattaatccctgattgagatttgttattaaaaccttgaagggaagaacatactatcaaagaaattgttgttaaagttatctctgagaaagatttagggagtagagatttggtaatttaaagttaagcggttggttctcttatgtgtttattagcactggaagcagtctccctgctattgtgtagactgggagtccttgggttgtgcttccttggattctttcgagctctgcttgataatcctcttttctgctgtgatccgtgtggcatgtatttaggggttgcatggatgagaaggtcctcaggtcaagtacagttctgttatagcgtactagttgggcattagtgacttgaatcaatcaaggaatgcaaataatgaagaataacagaagcctgtagaatattcattattggatttgttatattattcgcactttaaacacattgaatcgctgcaagtgaattttttattcacacaattttaagaatgttttgccaatgtaatcttttagttcttaattttttagttttaagcaacttagaggaagcatttagtagaaaaatgtctaatgtttactggtcaaactttttttctttctgaataaaattttccttgtccttatatttttcttatgctattttatagcacaggagtttagtagactgcttaaattaagttcagcttactatcttactagatgctgagtttttgaaacatctttcacctcttagggtttgggtagattatgtgtgctgagaaaccttgtagatcaatctaatgttggaagagtctaagaaactcttcattccccccaaccattgtataggacttttatgctgtcaaatataggtatttctgctttattaaaactccttatgccgaggcccatatataacatttatattaatcataaattgatattacagcaagattcaccatgttaattgcagactcccaataggtctttgaaaataattggtttacaaaatttgatttacatagcatttcatacagtacaaaacagggaatgtctctgtatgataccaacagatgaaccttagagtatgccttggacatttctttttgtagtttctccagaatttgttctttattccacttctcatgtctacattttttttttcttcaaaatttgcaggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatggtaaagtcttctaattgaaattaatgttacaattgattttgatttgtgtatgcattttatatgaatactagtctatatggagacattaaacagatttacattcttcggcctgctacacatataacaaatattttgggcttggttgacttgctattaattgtatcatgctatataaatttagatttatgcaccttctgacacctaatatactcagcggttttttttatggagcctaatagatgctgttacacattaggaaacacatttataacaatcaaatggtcttgactgtaagttagcaatctagtatctaactttcttgtttgtgctaacagcctcatcaaggcagtagccatgagttaaatgaatcattacattaagagctgaagtgttagtaccacagattagtagagagtgtcttttttttctttttctggaatggttcttaggtgactcattagcaaaaattacatttgagagacgtccatatttgtgatttaaatataaattaaggtaaagtacataaatgaagtggatatacttgagaatcagaataagattgttagagttgaatattagacctttgttttgtttaatgatgagattgcggagctacttgctagagactaggaagtagcattctcctattccaggtggattttttcctctcctggttaaaaacagatactttgttagctgagaaaaatcagaactcttcctggtaaacatacagctctatttttgatgctaaattctgtgattttagcatggatagatttaaaacacttttaactggcatcatcccagtttgttcatataccagagattataaactaccctttttctcccctccacagcacaaaatacagcttctaatttgtttttctgaaatctgtgtaggtcttttgaagaaatgcttctttattagaagtgttgcatgtgtgatttttgttttgttttgttttgtttttagctaactgtgtgtcaacagttgtagaattcttttattttttccagtatgttatgatctctaatttcttgttttggcaactctttattggcttatactgtatggcttgagggaaaattttctggtaatatcccacactttcttgtacttcctactaaagtatggaatgattaactagtggaggtatttctcagtctttttgtattaatagttataatttgccatgcattttttcgtgtatttggtccaaactctggttaagtgccttattcctaaaactacctagttcaatctacctgcttcaatatggtgtgtctaatagaactagttttaggttaatattacctggtttgggtttactccaggatttctctcttatcttgatttttgttctgcatttactgccttcctgttccagtatttcagttacaatctaactgctaggaacagattgacactgaaaatagatacagaatccatggtgatacataatgtagttcaagtttttaacttttcaagcgacatgtagctatttttctttacatttttgctatttctttttattataaattagcaaattatatatttatggagtacaaagtgatgttatgatttgtgaatataatgcggaatgattaaatcaaactaatatatccatcaccttaaataccctttttaatggtgggaacatttgaaatttacaatcttgccaattttgaaatgtacatatactattaactgtattcaccatgctgtacaatagataccaaaacaaaacaaaacaaaacaaaaacctaattcttcctgagactttgtacccttttaccaacattcccatattcccaccacctctagcctctggtaaccaccattctattctctacttctatgagtttgattgttttagattctatgtataagtgagaacaggcagtatgtgtctttctgtgcctggcttatttcgcttatcataatgtccaagttcatcagtgttgttggaattgacagaattacctttttaaaagctgaatagtgtttcattttaaagaatccacattttctttattcatccgttgttgatggacacttaggttgattctgtaacttggctattgtgaataatgctgcgatgaacacagggctgctgacatctgttctacgtattgatttaaaatattttagatatatatcctgaagtgggatggctggatctgtatttttactgtttctactagcagaaatgatctcatttgggcatttctaagcactttataatcaactcagttaattaagaggactgaattctcaataggaagtcattgtttaaaacacatgcactgaccgtacagtcactttttttttaaacaaaggtaattttgaaatctgcaattgaataatattcttgtattaatgaacttgcatagcctaacagtagtaatgttcatctggataacaggtttagggaacttgttttcagtgaggaggataaggacattctcaacttagcaaactctacagtaaagataaggtttatttattttattttttatttttattttttgactctcctctttagaccagggataagatttatttttattaaaattttgtggaagattttttcctttccagagtgtagttttatagtctttggtttttgtcgtgaagttttatattttgtccttatgtgttttgattccttttaaataattaatgggttcacagaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataagtatgtctttacttccccacatcttctgatatttttttttctaaactctttcttcatttcttcctgttttgatatttgcccaagattggtctaggttcttttaaaaatttttttgtttattccttatgatagaaatccccaaacatacatacatgaaatgatagaaattaaaataatgaaacacctatcacccaatcctagcagctttcatcattgagaagtagcagggtgagcctgtatgttatccttgcaaaagtaatatgtggagtatctgtgtatattgttcatcctttaggcataaatgggcaagcatttttatagcaaagaatgaagtgtttcaggcatacattgcttaaaaattgtggctaacaacctactagttattcacaatccctagaatgaaattgctgccgtaagagggtgactttttactttgtaagtaatttggcaattttatacaacaaagaacagtataattacagttacaggactcataaatgattcggggggagaaaatatttgccacatatgcataataggcataatgtacacagtgtacagaggccatcctcagatacataagaccagtaacctagtagaaaatggaaatggaaaatttacagaataaaaacaagccaatgaggatatttagaaaattattaatcaaataaattattttaaatctcattaatatagattatttgttttatggttagatagtatttccatagttacattgtaatttagttccactgtgggacatttaagattgtttccaatgtttttaccattatgagggttattaaaatgaacatccttacatgtaaatgtttttactaataaggcaatattagcttaatatattggtattttttagtgttgctacaaataacattaatgaagaaaaaactacctagacgttcttattgaaattcagaggaattggaggcagagaacacaggaaactatattccaaagcatgggaaacgtaacagcataaacgtggagatggaaatatggaggatgtggcctagtgtagttccagacatgggtgtgtcataatcaccaaggaggcttttaggtcttgagtaggatctcaggagatgtatttttaaagatgcttctcaagtgacaagcaactttaaaccagcatgtaggggccactgcttaaagactgtgaaggaatgcagttgggctgggctatagtggccttgaattctggactgaggtggtccatcccattgcccattggaatagtgttgaaagttgtgttctgaggcggtgaccttttagatgtggtaattcacttcaggggagttacccggtgatggatgatgtgcagaaaaaactggaaaggactagatgtgggagccaagtgttagaggttcactttattaatttagatgtatagagacctggaatggggagggtgacatttgatggaaagcagcatacagatgaaagacattaagaaagaagcagagctttgggtgtggagagggcatgctcagggatgttaaggatgcacagtagtggactgggagactaatagaactggtgagataaatggagagatagaaggtttgggaggaaattgttaaatttggttttagttgtgttgagtttgagatgagctattcaaatggaacagtccaggaggcttaggggaaggtttttcctagaggtacagatttgaatccttggggtggtagcaatactaaagctgcaggtagtatgaaaattccagaggaaaatggtaacaagtgagtactggtgttctggattttagagaacatccatagaagacagcaaaggagacagagaactaggcagactagagatttgcaatgtcctaaccttcctttgatttcccacatagctgggtactaagtgggtactcagaaataatcctttgttggcgtaagtttcattaccttgtgtgtgttgtagtactgtactctttgtctcttactgtctgggataatttctttgtaatttgatcatgttactacttgttctgtaaattaatagtcgctgtaccctcctgtcttttcctcccaaaatgcaacagctgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttctgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctctggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtgaaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgcccctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagaggtattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggattctgaactcttgtgtgtgaaatgttttctgaaatgtggaggtgctttaagcagttgataataacccatcagtatgttttcctgacacctggggacctgaagcaaggtggactgtaggtctgggagggtgaccagggcttatcaggaacagctaatacatggggagaagtaggaagtgaaagcccatctcatgaaccaggaggtccgcacagaagagtgttggagctctggaaaggcacagggcgttcaaccacagcaggacctcgaaggaaaggaagatgtcactaaaatggtgcaattttctgatgggtctactatcaaattattactggtcaaaactggactggtaatacggtaatggatatgttcttagaaatgcttcatgggcattttgttattgtgtgagcatcctagagtctgcttacacaaacctagatggtgtagcttactacgcacctaggctacgtgggatagcctattgctccttgactacaaacctgtacagcatgttactgtactatactgaatactataggcaattgtaacacaatggtaagtaattatgtatctaaacacaaaaggtacactagaaatgtggtataaaagttaaaaatgcatgaatggagcttgcagg

SEQ ID NO: 16037 - DNA, 30324 bp, Human
aatttttaattcaagcatttaaaatttggctttggttttcttttaatgtgataaaaaagtgggattttttggtaaatatataagtggatatatcaatatgtagatttcattataataatccctaggtttttctgaagcagcttattcaaaaagattttttcttttttttgagacggagtcttcctccgtggctcaggctggagtacagtggtgcgatctcggctcactacaacatccacctcctgggttcaagcgattcttctgcctcagcctcccgagtagctgggattacaggtgtgtgccaccacgtccggctaatttttgtatttttagtagagaccaggtttcaccaccttggccaggctggtcttgaagtactcctgacctcaagtgatcgcccacctcggcctcccaatattgaataattcaatattgaattattcaatattcaacatgcagttcaatgattcaatattaaatccccaattgcctagatatcttttgttgattctcccagcaaggcaaataattattgatggtaattttctcatgtacctcctgaagaagccttctctcccactcgcctttctgccactaaaatagatttaaaaacacaaaacaaaactggtcaaagccttgagttatgtgtgtatacgtggtgtgggggattccccaactggagtggactggggagtcctgcaggcttacccaagggaagactggacttctatgtggctggtttccacatcactgaaccccaactttctacagctgggtcggcctcttccttcctctttcacctgtcagctgcccggccgttgactaacagctaccctaatcgggccacccctcctccaggtctccaatcccagaggagttaccccagcaacctggcaatgctcatcaagtctcaacgcgtggtggctgtgccagagaattactacaacacctgcaaggctgtgcgggctcctggccgcaccctatcggccgggaagaacaagcgagggagttcctactccaggaccgtggggttctcccgcggctctgacagtccccaggagggagccccaaactcccggtgccagctgcagccgcctcgctttccgagaagctttcggaagcttttcgaagtcggagaagcaactgccccggggctcacctttgcgctgaagaggtgccgggagtctcggggaaaaggcaccgctgtacagaaaggaaacattgtaggggggttagccgaccggcaacatcgcgacgaacccggcgaccccacgccccaacaccctagcccgggaattcccccttcttcagacagatacccaccccgcaccctcttttaatccggggcaggaggtatccgtccctggggcacccgcccacctcccaccacggcgaggggcgctgcacagggggaaagggagggcttgcaccccaaccaagctgctttgtgcaacgctgtcacccgaaatccgccacggcccccacgcacgcccccggagtggggagcctcccacctctgagcgccagcgaggcggtgcgcgccgccctggactgcgggcgcctctccggagccgcgcgccgcgcgcacaggacggctgcagccgcgccgcgagccccagcctcttctcggccgccgccgccgccgccgcttccgcccctgtcacggcgtgacccggggtgggaggagccgacaggactagggatgggtagggtccccgccttcgctttagccgcagcgctcgctccgccctgcccatttccgccgctgcgcaaaccccggcgcttggggaagtgggtggagtctgtgcaacgaggtacggggcgggagtggagacggggcgccgggagagggggcgggaactgaggcggggcgcgggaaagaggcggggcgcgggaaagaggcggggcgcgggcggaggcggggcgcggagcgaagtggcggaggtggaagcggaggcgtacccgcccctggggacgtcattggtggcggaggcaatggccggcaaccagctgtaagcgaggtaggctcactcgggcgcggagggtgcgggtgagaaagggaacgatttgctaggagtgtatgcgcccgtgctagggctcccaggaattcttacaagcgtagacagcctagcaatcagccctgtgaagtggggttcagggcagaagcggaaactgggaataacgaggtcggacagtaaatgacctgaatccaatgtccaggatttaaagtgcttccaaagcactggtgtgttttaattatttttttttcttttttcttttagagacagggtctccctctgtcgcccatgctagcgtgcagtggcacaatcatagctcactgtaacctggaactcctgggctcaagtgatcttcccgccccagcctcctcagtaactgggactacaggctcgctgcaccacgcttggctaatttttcaaatttttttttatagaaacggactctcggttttttccccagcctggtgtattagtgatttttgggaaaaaataagtactgccaaatagtgagtgatccctggtgatgtgggaaactggggtgctgtaaatattctgtcttgctctgcggtggttacacaggtgtatgtatatgtaaaaaattcaccgagtcatactcttttaagatgtgtgcaccttaggaaagtttcttctcaattttatgaaatttaaaaacaaaactatagcagaagcttttgaaaaggtgagaatggagactagaacaacttgaggactttgtttgtgggcagaaattattgtgaaatttcccttccttaattcttgtaatgtgcactttttttgtattatagaaataaactttatttctctagaaatgatgtatacaagtggagtccatgctgagaaactgttagaacagctaagacgttgagcccaggagtttgagaccagcctgggtaacatagcaagaccctgtctctacaaaatatttaaaaattagccaggcatggtggtgcacccttatagtcccaggtactcaggaggttgaagtgagaggatcgcttgagccccagtgttggagacggaagtgtcattacaccactgcactccagcctgggggatagagagagaccctgtctcaaaaacaaacaactaagacatgattaagttatgtgcatgattttgttagacagttcaagtttgtgtgaaaggaatagagttgtgctactccaggctgctgtggaactctgataaagattatgcttctcttttaagtagagaactgctttatgaagccttgaatttaggttccagagtttctgaatgaaaatgagaaaactgcaacattcttttgcttttctgtacccaatataaatcagatactttctactgacctctcagaaaactcagagtcacctcctgataccatcagggtcttgcagaagccatttgtcaacaaatatttgctaagaagtgaattcatgttcccaggtaatgagagaaatgcctcctccctatatcctaagcatactgaggccaaatttggcaacaaaaggggaaatttgcctgaaatacatgcttttatgcaatgtttgctatttcacagattaatcattaaattagaaccaccaataatagcatgctagtataatccaaactagtttcactaatgatttaaagggaatgttagaataatggtgttatattgtccttaatattgcagagttgacattgaaaggaaaggcattttcctcatacattcagatggatctgcagttatggtctgtcagctgaagaatgagaagttcataatttagaaaggagaactctttctcatgaatggtttcagactgtagagcagccattctgactggctgagaagtgtagccgcaggccagaagccagaaactgacacttccagggaggggcaaagggaacaggaatttatgctgaggaaggtggccaaatatacatattcagtaagctgtaggatgactcatgaatatttatgaaaggaggaaagtacccatgagtaattgagcttcatgggtaccatgcacaaaaaatggcggtgttaccacaatcacaggatggagtttttggccctcttatatcaaaaggtgaagcagaggacagaaaaacccttactgtgcattctcagtagactggccagaaccattctgtggtctgtgatctcttatcaggcacaaaaggaggggcagcatcagggggttggttgatatcagtggtagaatcttttgaaagggctggtttcccttaagcccttatagaacaaagcctaattgtggttagcaagagaggaggtatagagttgtatctgacgctctatctactcttggcccagaactcagttttcaaggttactctggggtcccgttagccaagaaagtgtgtagtgagccaagatcgcaccactgcactccagcctgggcaacaagagcgaaactccatctcaaaaaaaaaaaaaagaaagaaagaaaaggaaagaaagtgtgccttcagtcagttgagaggctttgaattttattgttagtttacattgtacatgtcttttttcagtttccttagtgtgcatttcccatgcaaaaaaagaagctgtagaaaattatttgaaaatacaaatgtgtggagtagagataggatattgaactatggttcagtatctactttaatctgtttttgctgtctcctgaaaataacagaatttttttttaaggcataaagtactaggatagccaggacaggagagacaaaattagtaaaattttggaaaggcaaatggacaagtgggaaaggattttgcaacttcaaggaagctgaattctaaaccagcaatgagaaaagccattgagcagcccagtttgcaatacagaatccccaaatgctcaggattagcagcaccaggtacctccataaagtgtgagagtatggttgaaacaaggaggattgcttgaaatgctggttcagaacaggccaaatccccagatccttttctcaacttcttgcaaccaagtgtgtacatctcaccacaccagcaggctttggggatttattctctggaaagggtaaaacaaagagtgtctgtctagactgagaagatatgatacacagttgagcatgggagtatacaggaaacgtgaggattaattgaatacagcaaactggatgctgggaccctcgcccacttctcttcttttcttatatgagtatatgacagtggctccaacgacagaatccttaagacaggaattgggagatccatctatggaaagtctgactaccacaaggaaattaaagacattagccaggcatgagggtgtgcagctgcagtcccagatactttaaaggctgaggcgggaggatcacttgagcccagaagtttgaggctgtattgtgccactgcactacagcctgggtgacagagcgagaccctgcctcaaataaataaataaataaataaataaataaataaataaataaataaatctaggtttccaaatgaaatccactcacatcaccctacattataagccccacccacattctttgccttcattcattttatacctattcttttttttgtttttttcttaagacaaggtcttgatctgtagcccaggctggagtgcagtggcaccatcatagctcactgcagcctcgaactcctaggctcaagccatcctcctgcctcagcctcctgagtagctaagattacaggcatgcaccaccatgcctggccaattttaaaactgcttttgtagagatggagtctcactatgttgcccaagctagtctcaaactccaggcgtcaagccatcctcccactttggtcgcccaaagcactgggtgattgatagcaaaaaaaaaaaaaaaagagagaagaagttaaaaaaatgagaattaaggtaaatctttcagaaaatagtacaaaaacatgaagatatagaaaaatagaaaaaaatgagaaatttaccataccgggtcagaagattctagagacaaataataggggtcccagaaggagaaataaaaaaagcagagggatggccaggctcagtggcccacgcctggaatcccagcactttgggaagccgaggctggtgaatcacatgaggccaggagttcaagaccagcctggccaacatggtcaaatctcatctctattaaaaacacaaaaattagctggacctggtagtgcatgcctgtaatcccagctactcaggaggctgaggtgggcgtgattcttcactaaacctttagggtgcccaaccccctatggcccccacacttctaaccaagaatttgatacccagcagagctatgcatcaaggatgaggaatagtctaaccgtgttttatacatgcaaaatggaaaaacattctttttcttccttgtgctctttcaggaagctctggaggttaggcttcaccaatataagcgtggtcactaaaaaataacaacaaaaaaaagaggaagacatgaaataaagctggagattcagacaagaaggaaatctccagaatgatgatgaagagcgatcccagaaagctagctgtctaccaagattagagaataatcagggcagattccaggagagaattctccaagatgatattgatagtatagctgatgactggagagactgactgtgtactgataggaaattgggacaattggcagaatttagagttgaattaggagtaagtacaataatgcctacgtgatgaagcctacataaaaacccaagaggatggggtttggagagcctcctaatacctcaacaggtgaaggtcctgtagctaacacatctcttcaagtatattcttcgcagtatcctttataataaatgtgcaaagataactaagtatttctctgaggtttgtgagttgctctagcaaattaagcaaacccaaagtggagggtgtgggaaccccaacttgaagccagtggaggcctggacttgcaactggtgtctaagtgaggagggaaatcttagggactgagcccccaacatatagaatctgacactatctccaggtaggtaatgtcagaattaaatcagaagatacccaactggtgtccaatatttggtgtgctgggggaagaacccccacatttggtcacagaaatcttgtgtgttgatgattggggtgtgagagcagaggaaacactaatattaagatagaattcagtttatttaatgatctcttgtaatgtgtattaaggggtattattctaccaccagacgcactgaaagtaattttttgttatcacttcttattggatgttgaaatggcaaggtgcagtgactcacacttgtaatcccagtgctttgcgaggccaagacagaaggatcccttgagcccaggcgttctttgttgtctggacaacaaaatgagaaccatctctattaaaaaatatatatatacaaaaattaaccaggtgtggtggtgtgtacctgaagtcccagctacttgggaggctgaaatgggaggatcgcttgagcccaggaggttgaagcttgcagtaagccagggtctccagcctgggtgacagagcaagaccttgtctctgaaaaaaaaaaaaacaaggaaagaaagattagctgggcatgatggtgcacacctgcagtcccagctacttgggaggctgaggcagcagaattgcttgaacctgggaggcagaggttgcagtgagccaagatcacactactgtaccccaggctgggagacagagtgagactccatctcaaaaataaaaccaaaaataaaaaaagaaagaaatatttttaaaaagtcatactgctaagaataataggttttcatttagttcatcaatagaattccaatgaccttaaatgacaacattgcaaatattttccacgtaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagtaagaaatatttggtatacaatagagaaatgttctatcaaaaagtgactttgagatagaaataataaaagtacacattatttgactaacttttaggatgcacatttaattcttcacatttttgtgtctcccgagtcacagtgcatctgtggcatgatgtagtttaattggcagagtcttttcttcccacagtgtgtaaataatggtgtggcttacaaatgatgacatcttagatttataaaatatgttctttgatccctacggcacctatgtattggccctgaatatttatacctacaacaggtgctcaagcaatgtttatgcttacaattcttcatactgaaaatcagtggtgtctgactttgctttccaataggatgtgttcagatgttaaagaattatctctatggtgggagaaaagaagttgcgagaaattataaagtgagttaggatgttgtgcaatgtagtagtagtcttcatagcagcaataaatcatgggaccagtgctgagtaaagtggttgttagagacattccttgttctgggcagccacgcccatctccccaggagatgacatcatcatcatcatcatcatcataccagaaacactgggttatttctgtcatgtggatggccttagaagagccacatctccacagagggaattacaagaaactacaggagttacacttctcaggtttacttctgaggcttgagtacacgtttagagaacgtaccatgaaattaatgttgaaaaatccatggctccagaggctccatcacccccaaaatagtacatatttagagaattaataaagaattttcaaaacatccccaagaaaaaaaaattatttttaattactaatcaggaaagccctgggtgtaagtcagatttaccactgactgggtgtgtgtctgagcaagttacctgtttcttcatatgtaagctggagattataataattaatagtatctgcttattaaggttgttgggaatattaagtgagataatgaatgaaaagtgttcacctaccatacaattgtcctaaaacctttttttttttcctcttcaggctattaaagaagcatttagatactttccttaaaggcaagagtggactgagggtattttttcctctttgcggaaaagcggttgagatgaaatggtatgagcagataaacattaacagaattatcttgtcttaatgatgaattctttgggtgatttaacaggatgtgagttttaaaactccattttcaggaaatacacagaaattccttatttttctattagtgatgggtatataattggaaataatattctcaaacagtaagaaacaacagaaacaggtatgaagtctttctggattgagttttgaaattaaaaaatcagtttggagccaatggggggagaaaaaacagccttcccttttacattttctggatccttgtatgtggttcagtttttgtaggtggtttaggaatttagctaagttaatttttagatatttgaaatggtggtggacagagaaattcaaaatgaattacagctttttggcaggacaatgttcatagtccacagttcagctcaaccttcccctcccaccagggaacacaggagtttctgttatcgtgaatcattgttataaaaccagtgattaagaaagtatttcttgtgagtaattctctacaaagagaattcactttaacaagccacttttactatgagttaccctaaagtcacctcgacatcattctctatactgaactctcttgtaatgataatatacagatacaatcatacctgccaagatatgcatttatttataagcttgaatgttgagaactttgaccactgagcaggaaagaaaaaagaatgtatgaaaaggttagtaaatgcgccaggtgtggtggcctccgcctgtaatcccagcactttgggaggccaagacagaaggatctcttgagcccaggaatttgagaccagtctggacaacatagaccctgcctcaaaaaataaatttaaaataaaagattaataaatgtaaaatataataacctaaaaaatggtctattctgaatataaatatcggtgactaacgcagagtatgcatgcattttttgggagttgattttcaagtagagatgatagaatttttgcagccagcaaccaatcaactgtagctgagagcctttgttagagggctgctatgactttaagattcaagtgtggtcatgaaattgagaatatttaaactatattatgacatatattttaaccaattcattgagccagaagagatagttactttcaaaattaccctcaaaaaaaattaactctataaacagattgtcatgtgatgtcaccataaatggtaacaatgtagtacaaacaggttctgaggcaacattaggaaaatggtatgaaatagccaattaaatgtgattgttgaatatttggggtctaaagccatttgtaataaagacattacaaaaaatatcagaactggccaggtgcggtggctcacacctttaattaggtgagcggatcacttgaggtcaggagttcgagaccagcctggccaacatggtgaaaacccatctctactaaaaatacaaaaattagccaggcatggcagcgtacgcttgtaatcccaactacctgagaagctgaagcaggagaattgcttgaatccaggaggcggaggttgcaatgagcccatgcactccagcctaggtgacagagtgagactctgtctccaaaaaatatatatatatgtatatatacgtaaatacagttatttttatgtatatatatatatgaactgagctactgtaattacatgtaagaagttaagaagttatgatagtagatgatttttcatttatgtaactgatctatgtattgaggtctatacagacatgagatgtgaatagaaaaactgaccatgagctaaggccaaaaagcattaaaacaaaatgtttaagatatttaggtttaggtttttggttttttgagacagtcccactctgtcacccagggtggagtgcagtggcatgatcatagctcactgcaaccttgaactcctgggctcaagagatcctccctcccaacatgctgggataacaggcataagccaccacacttggtcttattttgtttttattacaggttgtagtaggctatgcttcatttttccatctgttgaatgggaaataaaaacacatacagccaatttgaataatgtttttgtttacattttataacttaaaaaatgtagggagaatttttaaactccctgtatgtttacagatatcctaagaaatacgaaagatgaaagacaagttatatgtttcattttacaactaaacagttcatgctctgcccacattgaaagtacgtactcttttgtagataaaaggtacagtcagtcctgctatacttgtttcaaaactgaattctaactcaattgatatattagggaaaaatttgagcatgaaataaatttcacatttgcttgtgtgtgatttcatctataagaagccttaggtaaaagcagaaaactgcacccagttgaactaaaccaggtatgaatagatggaatgcaccaacatcccccagctaccttagtgagcattaggtctttttcaccgtaaagtgccatattgtagtatttatctatttctcaaccatttaacatgtataaaactgttattattaggttcctgtttttgttttttaatgtggcactgaccaagtttttaaatgctgtgccctcactttccccaccagcctggggatttttagtgcgtgatttagcatagtgcagtgattttaggaaggcacttgttacattatagcagaactatgtttttatttcacttgacataaaatcataactgtgcctagatatttgtaccactggtactgttttctcttgagtccaagatcctgagactgaattctgttcattataaaacttaccaggactgtaatcccagcactttgggaggctgaggcaggcagatcatttgaggtcaggagttcgagaccagcctggccaacacggtgaaaccccgtctctactaaaaatacaaaaattagccgggtatggtggggcacacctgtaatcccagctactctggaggctgaggcaggagaattggttgaactcgggaggtggaggttgcagtgagctgagattgtgccactgtactccagcctggctgacagagtgagattctgtctcaaaaaaaaaaatttttttgaggaaaaaattttcctcttttcctcaaaattaccaggaaaagcccgggtgtggtggctcacgcctgtaatcccagcactttgggaggctgaggcaggtggatcacctgagttcgggagctcgagaccagcctggccaacatggtgaaaccccgtctctactaaaaatacaaaaattagccaggcatggtgacaggcacctgtaatcccagctactcaggaagctgagacaggagaatcgcttgaacccaggaggtggagattgcagtgagccgagattgtgccattgcactccatccagcctgggcaacaaagtgagactccgtctcaaaaataaataaataaataaataaaattaccaggacaatgctatttgtatatgataaaatatacaaatttttggatagtgtttattttaagcaaatggaaactacaagattagtatacaaatgagtgctaatgttctagacctgttcactttagtacagtagctactagccacatgtggctatttaaatgtaaactaaataaaatgtaaaattcagttcctcaatcacgaggaaccaatgtggctaatgcctattttattggacagcgacagatatagacattttcatcaatgcagaaaattttaatgggcagtgctgatttagagaaattgaaaagcatttcctctagtcaaatcaatttgtattaaatcagtattttgttatatatctataattacattccaactgtttcatacataaaaaaagatatatataattttccaaatttttattgtttcctgaattcatataagtcagtttttcagaatttttataaggtttgaaaataatatagatctgctttcctgcatgttctttgaaaccctatgaacctgaattcatataaattcctctaaattaaagaaaatatatgcttactctaatataaccctctatttagtcatttgaaaacataatttaagtgtaaatgtatgattttatgcaggtttgcagaccggggacacagtgtagttggtgtggaaatcagtgaacttgggatacaagaattttttacagagcagaatctttcttactcagaagaaccaatcaccgaaattcctggaaccaaagtatttaaggtttgttttgatttgggtaaataattgtatccatatccccacaaaagtttttctcagcgtgagtattatgaggataccattcatgtgtccgatggttcctatttagcacgcagattcactgtagatactatatagtataagaagcaagggcttaaaaatataggtgatagctacctaaataggtatagacatatgtatataaaagctgaggtcaaagcctctctgtactcaagcttttaggcttgttttatttttattaacacgcattttctgagaacccatcatgtgccagaccctgcctaagacattgaagagataaagataacacagcacacccccctcactcccacccctaaagaatctcttagtttaggagagaagagaaacagggacaaagctatttgtaatgcatggagctaagtgtaaagacacagggtattaagggaagagatgggagttacctgcccaacctggcggtgcttcctgaagcatggtgacagatagagctggaatcaggcagggcctgggtccatggtcttggacacctcgggaagatactacttaaatcacccatgaggcctcataggaagtgatttgaagggaagtagcctcctggcagagagacaggaggctatggcagtggtccaggaaagacatcatgaatccctgagcaaggagagtgatggggcatagagagtggttaggatggattaaagcaacatttacgatagacccgcaggattctgtgaccgaatgaggaccaaaggagcgatgagttcacatttctggctcagatgactggctggatggtcaagaataaatgagaagggcagaaagaatgaatctttttctagagatgatgagtttaagggacctgtggagtggtgaaggttttatgtctgaagcatggagtgaggtttgggctcaaaatgataggtttgggagtggtctttatgctgtgagcagaatgagccagtgtaaataaacaaacactacccaagtgggaacaagcagagagaatctggcagagactcaaaggcaggcagaggagtggggaagcttaaaagtggacaaaagtaaaagctcccggcatgtgctgttgcgaggctgttggcacagggaagctggaggtgggcaactaggaacggggcatcctatgtgattggtttggggagcatgtttgcctttctctggctgatcctaaattggaagaagtgtggtagtaaaaatcagggaagctggcagtcattgaccaagtcactgcagaggttgtgaagtggctaccttgtctggggtaaattccccaggttcgtcgtcttgtgccaggaaaatttaggacagagacacacatgaggagttcaggagtggaggtttaataggcaaaaaaaaaagagaaagagaaaagtaaaacagctctctctttagtgagagagaggggacttccgagaggaaaaaacctgccaggtgtagaagcgccggattttatagtgcagcctgaggagtcagtgtctgatttacatagggctcacagattggttcgatcaagtgtgatgtttacataacgtgctgggaaggctggtcgccccaccctaatcttattatgcaaatgaactcttcccttcactggcaccatgttgtctgcttcttactctacaggtggctgacagagaagggaagatagagccaccattttgaacatgattggcacaaactgccggcatctatgtctgcagctcgattttataggctgctctttgttagaaaggaaaaatgatttgaggctgcttttcattaagaggaaaaccttccgtatcctccctatctgccttagtaatttcttcttaactcctgaatcagttgtggggtcagagttgtattgtcatataggatctattgtccatctgtatattcagtgtctcacaaagtactcttttctaaatattgaaattaattgctcagctgggcatggtggctcatgcctgtaatcccagcactttgggtggccaaggtgggtggatcacttgaggtcaggagttcaggaccagcatggccaacatggcgaaaccccatctctactaaaaatgcaaaaattagctggctgtggtggtgcatacctataatcctagctactctggaggctgaggcaggagaatcgcttgaacctgggaggtggaggttgcagcgagccaagatcgcaccactgcactccagcctgggcaagagagtaagactctgtctcaaaaaaaaaaaaaaaaaattgttgctcagatcagtaggaagcttgatggtattttttatttcacatcttcctcccacctcattctcaaagcattaaagaatccaaggagtttactcagtccaaaaagggctagtcctgcttccaggcccctcttggagcagcagttccccgcccaggctgcacatttgaaatcatctctggatcttataaaaattcccaatccaaaggtcttaccccaggccaattatatcagaatctgtaggggtagggccctggcatccgtactgtttaaagctccccttgattccaatctgcaggcaaagttgagatccagctgttctcctgcctccaggcccacccatctctgggctgacccagtgatcccaggctggttgtcaaagacccttcctcctctacttgtaaacctgtgtggggacctcatttcagaataaaatctagcagtcttgtgtgctgacacacctttcctacactgcccttcaccccagctcccaggatcctaaagtctatgttatattgccccctcttggagtgtgcccccagtccacaccctagagtgtcaccctttcaaaagtcacctctttttttgttttattctcttgatttttgttgttgttgtttattttttaggattattttgctccaagtgtttgtttttgagacagggtcttactctcacacaggctggagggcagtggcacaatcacagctcactgcagccttgacctcccaggctcaagtgaccctcgcatgtcagcctcccaggtagctggaactacaggtgtgtgccaccacacccatctaattttttctgtagagttggagttttgccatgttgtccaggctggtctcatactcctgggctcaagcgatctgcctgcttcagcctcccaaagtgctggaattacaggtgtaagctgccacacctggccaaaagtcaccttttgtttagtctccctgatgctcccaggcaggcccctgctctgccttctgtgttcacatagttcgcaggcacagaaccacaacagagcaggccattctggattgtaatgttctctgtgcccacgcttctctgctctagtctgtcctcactgtggtcagagactgtgtcgaattcaaatctactgtcaagaacccaggatagatgtcttgtctattaggtactcagcaaataaatgctcattggctgaatgaatgagcaaaaatggaagaatcagcacaattgcacatttctggaataacttaaaatacctgacttttcagtaccaccctgcctgataattggttgacctgcagatttatctttagcagagtaaaaatgtcactctgctcgaggaaacattgttagaattttatagcaagctctgaagtgagtaacagccaactgatcttcaaggttgtcctctgtgatattcctctgagttggcccaaaagaacctcgcacaggttttaaaagaaaaaaataaggtgccaataaagtgcagtaaaattatttactttaattatgtttaattaacacattctttccctagaacttttgctttgcttggccctctttccttgactattcaagtacttactaagtaaaaaaaaaaaattttttttcattatttcattacagagttcttcggggaacatttcattgtactgttgcagtatttttgatcttcccaggtaggttgaatactacatctgcactttaaaaaatttgaatgcttgccaggcagtgcaggcatgggagtggaggtgtcttcctcactctcttcctcctgtgtaacatccacaaagcatttttttgaatgtctgttctgcagatatttttattacacactcgtctgcacactttaatgtgttttgtctttggttagctcccaaactatgggaaactgaggcagctagggaaaaagaaaggtgagtaagacagtgtcttctaccttgcacctgggcctgtaatagaaatgaatttcaagtagccaagggagataagagctcatctcctgaaagtccctgatacctgagccagaggctgggggcagagttgttgcacactgtcctttgttccttcttcatgtccccaaatcataacagagtggggaggctgctgccacaggctcctaaaaccatgaggggatggacagctctccacacccaggtccacacattcctctaggaggaaacgcagacgtgagatcctaataccttgacgattgttgaagtaccagcatgcaccatgggggacgctgctcatcttcttaaagatttgatttttctcccataaaatgttttttctctttctggtaggacaaatattggcaaatttgacatgatttgggatagaggagcattagttgccattaatccaggtgatcgcaaatggtaagtaatttttctttttttgtttagctgtcttaattttttagtatactatactttttctgggttctagaaaatcagcttagacttctatgagtttgaaataggttattatgtttggaatttataaaaacctaaatccaatactagctttgtctaaaaagtataggatttgactacagagacctgggtgtaaggctataaggcttgtggctcaatcactttcaagctgtgtggccttggtccaagtattcaacttctctaagctttggtttactcctgcaaaatgggaatatttctgtaatactaacacaatcatcaccacctccactaatattaccaggtaatacttactggtcacttgcctatgccaggtattgttcaaaatactttatgtgggctgggtatggtggatcatacatgtaatcccagcactgtgggaggccaaagcaggaggattacttgagcccaggagtttgagaccagtctgggcaacaaagcaagacgccacctctacaaaatatttttaaaattatccgaccgtggtggtatgtgcttgtagtcccagctacttgggaggctgaggcaggagggtgagcccagaagttcaaagctgcagtgagctatgatcgtaccactgcactccaacctgaatgacagagcaagaccttgtctgtaaaatatttaaaaaaaaaaaaaacaaaaaaatcaaaatatttcatgtggtttaacatttaattctgtaaggtataagctactattccattatacagatgaggaaactgaggtcaaagagattaagttacttgtccaaagttaagcagctggtatgtgacagagttgagattcaaaaccagagtgtttggctttgaagtccatacttgtggccgggtgtggtggctcacgcctgtaatcctagcactttgggaggccaaggtgggcggatcgcctgaggtcgggagttcgagaccagcctggccaacatggtgaaaccccatctctactaaaaatacaaaaatcagcccaatgtggtggcctgtaatcccagctactcaggaggctgtggcaggagaatcacttgaacccaggaggcagaggttgcagtgagccaagatggcgccattgcactccagcctggacgacaagagcgaccctccatttcaaaaaaatgaaataaaataaagtccacactcatgatccctttgttagactacctcaaaggatttttgtgggaattgaaagaaatgaaatatgtaggaaataccttcatctctaaagaactgtataaatgagagctgttattattgaagcattgttattgatgtttttgatgaccattcttattataccgagtcttgttagaaaataaaattaaaatatgagtgaggaagcatactgagtaaaatgtgaccacatctgtatactctttcaattaaaataatgtcatttatgtgcttacttggatatagcatggaaatactgaattacttagttgtatggagcagactcatcacttggccaaaaaggaggctgggcgcagtggctcacgcctgtaatcccagcactttaggaggctgaagtgggtggatcatgaggtcaggagttcgagaccagcctggccaacacagtgaaaccctatctctataaaaatacaaaaattagctgggcttggtggcgcacacctgtagccccagctacttgggaggctgaggcaggagaattgcttgaacccggcaggtggaggttgcagtgagccgagattgtgccacggcactccagcctgggcaacggagtgagatttcatctaaaaaaacaaacaaacaaccaaaaaaaaaaacaggttaggctccacatcagtgaaataagatttttatttttaaaaattgtttcatcagtaaggcttactgccaaacctaatctttttaaattagaccatgccgcatcttaattttcatgctcctgtttccctctttttctcactgctcctcctttatctcttttccagaactcccatcctccttgcatgcctaaaagtcgtgattccccaagggaccaccatcctcagccttatgctctcacccaaaaattgccaatatttgtcctaccagaaagaaaaaaaaattttatgagagaaaaatcaaatcttttttttcgagacggagtttcgctcttgttgcccaggctggagtgcaatggcactatctcggctcaccgcaacctctgcctgccaggttcaagcgaatctcctgcctcagcctcccaggtagctgggattataggcatgctccaccacacccggctaatttttttgtatttttagtagagacggggtttctccatgttggtcaggctggtctcgaactccggaccccagctgatccacccgcctcggccacccggtgctgggattagaggtgtaagccaccacgcctggctgaaaaatcaaatctttaaagatcaattctgttactttcattcagctattcaacaaatatttactaagttcctgtgatgttccaaatagatagtatgccagaggcggggcaagtaactgaacagattatacatggtattcgctctgacagtctttacatttccagctctgttctttctcccaaacatccacatcacatgtccagtgtctgctttgcacttcccatgtgacatcagtgtcctttaacaactcaaaatatcaccgagacctctgtctccgtgagacacatttgtatatgaaaccccatctgctaatgtctaaatttgtaggtgtttcccactccctgaagatgatcatccattccttagaggttagtccttctacaggctctggttggcatggtaaaatccaccaagcagtgggaagcaaactaaaagtcaccacgtgcagaccaagagcggacccagcactttgggaggctgaggtgggcagatcacctgaggtcagttatttccccagtgtctgatataatatatatttagcacctagtaagagcttaataaatgttgtttaaataaatgaatggaagaagtgaactgcactctgagcaagggcgatattagtttactatgtactggtagtatcttagggtttttttttgagatggagttccactcttgttgcccaggctggagtgcaatggcatgatctcggctcactgcaacccctgccttctgggttcaagtgattctcctgcctcagcctcccgagtagctgggattacagtagcgccaccacacccagctaattttgtatttttactagagacggggtttctccatgttggtcaggctggtctcgaactcccgacctcaggtgatctgcccacctcggcctcccaaagtgctgggattacagatgtaagtcaccgtgcccagccttatcttagtattttatatatgtgctggtacttagtatcttagttctttatctacatgctggtactcagtacttaccatgttagcacattatattggtgctttcgttaggactgggtgtcttctccttagattgtacgttgtcaagtactgatgtattttctgctgtgactctcgagttcttgcctaatgtaaaccagtagggcagacctcatttttctggactttttgagactggttgagagagaaaaacttcacattctaagaggaatgaagtctttcagtcctaggaaaccctaccaaaccagtctgacatccccctcatggggacagcaagtttcttctgaaaaatgagaatcagaaagtaacagtttctgttcaaaagtttgctttgatgtggttctttcacctacaaggaagagtgatccactggtgaattctcacagtttgtgaggtggttattagtcttatcctcatgttacaggtgaggaaactgaggtacagaaaggttaagaatttgtcaagcttacatagccagtcagtagaggagctggggtttgagcctgggcatctcatagagtctgcacttgcctccccaacttctggcagacctctggacatagatcacagtctagccaggctccgtagaaactggagtgccaagagcccaggctccttcctcagtgtggggaagggtgtccatctttgtccttggcctgtctctcatggcctctctaccaccctgcatgcgtctcctgtcctctccttatccctcagcttcctccatttttattcccacatagctgacttgccttcaacggtcagcctccttgctccaaccaccatacaatacaaaagctccaactttcagtaggaccacagctaattagcaattcctctttggtctcttaattcagtttccaagtcagtcatctgattggtcaactcatcgtctgtacctggtccagccctggcttctgctcagtctattgatgggtcctgttagcatcagcttcccactctgagccaatcagacctggctccctgaggcacctactcaaaggacagttccattgcactcatggtttatgccacacttgcagagctttaatttcatgccaccttttttttggcctgcttgttactctcatttctaactaaatagaggaaaaaaattgtgttttctcttacataaggcccctggaggggtcccagtcacccaggatatttgttaaattgcagcatcccaggccccatggcaaactaactgcatcggtctgtggggatggagctcaggcatcttttctttcaacaagcaccccagtgattttgacacccagcctggtctagaaaccactgtcctcaagcacacaggcatccaaggtcagcaggccctcgagtacctcatcaggccagaaggagtctctacccatccttatgtaatgtcttctgctctgatcagctctggaagcaggcctcgatttgattcccatctggaccaattcccagcttaggcaggggccataatttgctaaacccatttctcacttttaaaatgagaatcaacctcttgtgattattaggagaatttaaactcagtagtatcagcgaaagtaacttctggcttccttccctgccttttgtccctccagcctttgcctgtgtagagaaatgtaacaaataccttcttgtgttctttgtagctatgcagatacaatgttttccctcctgggaaagaagtttcagtatctcctgtgtgttctttcttatgatccaactaaacatccaggtaaagttgttggttttttttttttttcttttaccagttgcctagtttcttgatataaattctatgacatggataagaattattttctcctaatttatctcataggaagcatactgcatatatacatggagataattccagttttgactaatgggaactataagcatgtttttctcttctatattgtacatgattttcttgtattcctttcccattttgtttaccattcacaattcagactagagaagagcggggaaatggatgatcctgatacagaagagaaatctcatgagtcctattgggaagaaggaggaatgtggttggatattgcatatccgtatcacccaagtggtagtgatgtgttggacagatgccttcacatacacaagcacggggtgagaagtgaatatggggatgcagaagttgtgcaggaaaaactctaaattattgtccttttttaatttctgaagttttataatctatctattgcattcttttatttgttttgaatctgttgggggtatgttttctcctggactcattttaatgcattcaaacattgaaacttaacctttgtcatggctggagaaatacatagacttttaatttgtaagagtcacctttttgattttcaactgagctttttaacatgcttgttttgtaaatatttacatatgttagtattttggtttttttgttttgttttgtttttgagacacagtctcactctgtggcccaggctggagtgcagtggtttcatctcggctcactgcaacgtctgccttccgggttcaagtgattctcctgcctcagcctcccaagtagctgggattacagtgtatgccatcacacccagctaatttctgtatttttagtagagacaggatttcaccatgttggccaagctggtctggaactcctgacctcaggtgatccgccctcctcagcctcccaaagtgctgggattacaggcgtgagccaccgttcccagctagtattttgtttctgcttgaataaattggggtcttaaaaactcattaaaagatgagacctagtgtccctaattaaatcagagacaatcaaatggaaatagaaattaatagaggcagaagttagctctgctaatctgatttaaattccattaatgaacagaagccctaacaaagaacctttgggaagaaaatacagcaggccctgtctggaggtggagtctaaggatactgctcttagaagggggcggaagctcagcttccttatactctatatcctgcagcagagcgggaggggtgtataaaatgtgggtgagtgcaggagttggtagaaaatcagtatgctagaagatggttgaaacccccaaggaatctgctgatggaatccactctgatttcaatgagcctaagtcccttgaccggtttagctgtctcatctaagctaaagatggatatgatggggatgtaacattgccatcctctcagtaagtcaatttatttctttagtatgagatttgcaaaagaagaatgagaagaacatgccacatcatcacctatttggataatgaagttgtatgtagaacaagtacacctacgtcattggaaataaactcagaatttatttctcttttacctaggtccaccattttatgttccacatgctgaaattgaaaggttgtttggtaagtttgtggacttatgctgtaactttttaaacaaagtcaagttaactcttttgggcctggcgtgctggctcatgcctgtatttccagcactttgggaggccaaggtgggcagatcacctgaggccaggagttcgagaccagcctggccaacatggcgaaaccctgtctctacaaaaatacaaaaattaggccagtgtggtggcatgtgcctgtagtcccaactatttgagaggctgaggcatgggaattgcttgaacctgggaggcagagagtgtagtgagccaagattgtgcccctgcactccagcgtgggtaacagagtgagactccatctaaaaaaaaaaaacctattgtgaactattagtatattagtatctagagtatgtctataaaatttaaaagataaagaccattttattgaaagttgttttatcttagaaaaggaactaatctctgtaaatatgctctgtatatatgctatatgctctatgttaaaggtatttgaacttttctagagagatggtatatttttttttatttgtttatttttgagataggatcttgatctgtcacccaggctggagtacagaagtgcaatcacagctcactgcagcctcgacctccctgggcacaagtgatcctcccacctcagcctcccaagtttctgggaccagaggcatgcaccacaatgcttagctaatttttctatttttttgtagagatggggtttaaccacattgcccaggctggtctcgaactcctgggctcaagtgatcctcttgtcttggcctcccaaagtactgggattagaggcatgagccgccatgcccagtggtgtatttatttttactcttgggagttaaaagtgataataacaattcagagttcaggaaattttcccttagcattcctctgttttgattaaaaagaagagaaaaatgtttagtgtacactgtttttaaaataatttcaaggttttgtttgtttgttttgagatggagtttcgctcttgttgcctaggctagagcgcgatggtgcaatctcagctcactgcaacctccatctcccgggttcaagcgattctcctgcctcaacctcccaagtagctgggattacaggcatgtgccaccatacccagctcattttgtatttttagtagagacagagtttcaccatcttggccaggctggtcatgaactcctgacctcaagtgatccacctgcctcggcctcccaaagtgttgggattacaggtgtgagccaccgcacccagccaattttgagtatttttaaaagaatccctgatgtcattcttcatagtattttaacatgttactctttcttgtttcaggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcttttatgtaatatgtgtcttcactggggaatactgacttcctaaaatctcaagatggaagatataccacatgtaaattattttagagcaattaaattgttttcaggattttccaaaaatgcttcttgtttcattttattatttaagtaacagattatctgagcctctgtgccctgcacacagtggtttataaatgccttgccctgcctatgaagcaggcatgaatgctccagtatagacagtgttatcactagcagacaggacaaagtaagaaaggtacgtaataattaatctatttgggtgaatgtggaaagaaaaatacaaagaaatataaccaaagcttaaacagctatcactgggaagtcagagatttggctccataaagaatggtttagggaccacagaaggtggcccaaaagatgtacctatgagagagctcccagctgacgggattcattggcagcatgaagtgacaaatacaaatctaagccatggagatattagttcaagcaatttaccaagtcgcaactgtagtacatacctgtcattgttttattttaatacaagggagcaatttcaatgtgtgtttgtgtatacatgtatatgtttatgtcgcacctactccttattttttttttttattttgagacagggtctcactctgtcgcccaggctggagtacggtggtgtgattatagctcactgcggcctcaatttcctaggcttaagcaatccttctgcctcagcctcctgagtagacaggactgcaggtgtgtgccaccacacccagctaattttttttttttatttttagtagagacaaggtctcactatgttgcccagcacgatctcaaactcctggcctcaagtgatccccccacctcagcctcccaaagagctgctcagcctacacctactctttctgaaaggtgtttcagagaaagatttctactgagtgctttttaaaaaatcagttattggccgggcacagtggctcatgcctgtaaccccagcactctgggaggccgaggtgggcggatcacctgaggtcgggcattcgagaccagcctggccaacacggtgaaaccctgtctttactaaaaatacaaaaaattagccgggcatggttggcacatgtctgtaatcccagctactcgggaggctgagtcaggagaattgcttgaacccaggaggtggaggttgtggtgagccgagatcaagccattgcactccagcctgggcaacgagcaaaactgtctcaaaacaaaaacaacaacaacaaaattaaaattaaaaattatcatctttaatccctacagctctgactttccaatcacttcttatgtgatgtgctttttgccttataaaacattatatgacaaattcaccagtggctggtgggaattggacagaattctatttatgtgccttaagcatagtcattccgatttgcagaaaatagtcatgtcccagatttattacttatgtgtagctgtaatttgtgagctgaaaatatgcttgaaaatctgtgattcctgaacagtgggtattaatagaaatttatttcactattggtgttaactttcgacaacaggaggataatcgaggcagatatttagaaatgaaatatatcataaaatattaagttatttatatttaaatatgacaaataatcctttatgcattgaaaatttgggaagt

SEQ ID NO: 16038 - DNA, 166698 bp, Human
  misc_feature (1)...(166698): n = A,T,C or G
ccctccagactagctagttatttcttagtggatttccctgcctcctatctctttccagtcctatataccaccaccaaactaaccattgctatcatgattatgctcaaaaatggtcaatagtcccccagtgcctactacttaggcttcaaacattttaggctgagattgaaggcctctaccagccagggcctaaccttccttccatacctggcttccacagccctccaatccagctaaactcacagactgtccttcatacatgccatcctttattacctctccacttttgtccctgcccatcatcttgagggtttttcctccacaatccactcttaatgtctcatttccgcatgaagactcaactttcatgtccatcagaaagtgttctctaatccccagtctagaagcaaccttcctttcttctgaacatccatggaaatttgttcatacttcttttagaatgttttttacgacattcctagaactgtggttatttttatactcttcacatcttcctactatattatcaacctaaagacaggatttgtggctcatccactcttagactccataatactttatactccaataaaaaacagatgtagctaaggaaatactgtgctaatgtttgttgaagttagtgctaaaaaaaagtcatatgaatggatgcttggaacttccctgtgatcctgcacacattgattcttatggatatatattttttctgcatttctggaacacaaatgttctaaatgcatacatacttcatccatccatccattcattcattatttaatacaaacatattgaatgcccgccatatgcaaggtatccacaggatagggagggtgctggctctggctttatgcaatgtacgcactcattgatcaatgtttatgtcattttgtttcccttctttccagacaaagggaagcaaagactcactgcacctcattactgtcagcagagagcaatgtgtaattggaatgacctttgtataagtgctgacctatggggtcagaataagccttataatgtacagaaccaacttatgtgcaattttaacatcgacagagaatattggcctttaagaaattcatctcatatttattgtttggagattttactttcagaagatatcagttacatttcccctctttttttctcttttctgcaattattttcctggcattcattcaataaagagcttcaagtcacttttttagactgaaataaactttgatgaaaattgaaaatcaatgctttccttctaatgacgttaagagaaaagcctccaattttgcaattataatcaatatataaaggggaagtggccacaaatatgctgcacatcttaagaagccaagtgggtttggttactttaatttttaaataatcaggacatttaaaaagttgctgtttataaaatactttttaaaaatgtcatcacacgcactatgagtgcactcagtcttgatgtctcgctaaagcattagctgtctagctccttctcctcccagagcctttatcctcatattgggtctggggacacacatgccgtctcttgattcctaaggatccattacccatttctctgcacagatcttcgggtatccaacctatctgtgcctccttcagccaggagcctccggatctttccagacttctttgcaatactgcctcatgcactgaatccatttctcgcatagcctggcgcttggcaggcaggctggcgttccctggctctgccttccccatctccctgtcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcaggtaatcctgcagcggtcggggcccggcgaggcggggaggggtcggggtgcaggtgcggggggcgcctggcggcgggcgctggcaagttgagcccgatgggtggggtagggaagcggccgggacgctgcggctgtggcagcagcgcgaggggaataaaggcggcgcgggcgcgggggccggggcgcggcgacccgggcgcggggcgcgggcgcgggcggactcccatctgggtcagcggagcggcgcgccctgcccccgcctccccagctccggcgtcctggccgctcggaaggcggggtgcgggcaggagctgcccggggttggcgggcggccgcggcctccccaccccagcgccgccgcccgcccggccgctctaactttggggggtctcgtccaccgggctgtgagtcttccaggggggtgggggtgggagtcattgcgccggctctgaccagagccacctcgatcagaaagtgctggaaagaaacagacctggcttcccctctgcagaacctgacttgaggcgatgagtcacttctaaaaaatgcagaggcaactgagactgggggaacggctcggaaaaacggcacccgccgctggctctctgactgctttgggtagaggggtgttcgtggaagtagccgccgtatcatcacttttagggccaaaaatcaacctgcagatggccttttctttattctcatcagagtggtgttcgctgcaagttgtagcaatatttgaatggatgcattcttaaaaatgagtatgtatgggtgactgcatttaggaagttgaaccgggactaggtccaaacagccagagtggagatgaacacttggtaaaaacatctaggacctttggttttatagttatggaaatgcagaagcttctgggacttgagcactgtagtttactgagtactcctatttccttactgcttctgtagatttcattgaagctatgttccttagaattcttggtaaactatctaagcccacttagtgtaaaattacaacggtagagtgaactttagagaattggatttatagttactagagtctaattagactgcaagcctcttgaaagcaaggatgggttgtttggtagttcctacagcaccaaacagtatttggctcacagcatgtaatggatagacaataaaagtgtgtgaaatagttaattcagtaccttaagtgtagatggagcatgacttcttgaatatactgcatattttgcaaggaaaggcgacttctccatgaatcccgaaatttaaaaaattcttaataacattacaatcaaagtgtcatataaatacttcttaaggataaagagaaaaagaagttgactatgagaaatcaggaaggtgattatcaaggtggtctttgctagtaggaagtaagtttttgttccccatcgttaatgtgagaagtaatttaatttgttgatacagggtagggtttggtaaacctttgagttaagagctagatagtaaacatgtaggttttgcaggccatatggtctccttagcaactactcagttccacagttatagtttgaaagcagctaaagacaatacctaaaggaatggtatgtttgtgttttactttatttacagacattgaaccttgaacttttcaccagtaacaaaatattcttctgtttttttccaggcattaaaaaatgtaaaaactattcttagcttgagggaggagcagaaaacacaaaagtaagagagaagggaatggatttgtccttctagtagtagtttgctactcccactgattgattctgtgctagaatctggagaggagcctattgaaaggattaatgggccgcattctcttgagtgcctgttataccttggcagttaagttaaataccctccagaaaagcattaacttattttgagcattatggagttttgttttgttttgaatatttcctaacatctttatgcatgaggttttgttttgtttttaatttattatgtaacattttatatgtaaaaataatatgctaagtctaggtgagttatgaacattatattcaactgaacacctgtgaacccatcactaggtttataaactagggcttaagaactagatagttgtgaaaagatagctcatagaatgggaggaaatatttaggaatcatgtatctgataagggtcttgtatccacaacatataaagagttcttacaactcaataataaaaagaaaaataatccaatttaaaaatgggcaaaggatctgaatagctatctccaaagaagatatacaaatggccaataaacccatgaaaagatactcaacatcattattcatcagagaaatgcaaatcaaaaccacgatgggataccactttatactcactagcatggctataatcaaaaagtcagataataacaaatactggtgaggatgtggaggaattggaacctttgtacaccaccgatgggaatataagatggtgccctcactttggaaaagtttggcagttcttcaaattaaacataaagttaccatatgacctagcaattccattgtaaatatatgtccaagagaaattaaaacatatgctcacaaaaaaacctgtacacagatgttgacagcaacaccatttataataaccaagaggtggaaacaaaccaaatgactatcagttgatgagtggataaataaaaggtggtatatccatacagcgagatattatttggccataaaaaagagtggagtactgatacatgctacaacatcgatgaatcttgaaaacattatgctaagtgaaagaagccagtcaaaatatcacgtactgtatgatctattcatttgaaaatgtccagaccaaggaaatgtatacagctagaaagtagattttttgttgcttagggctgaaggggctggaggtgggttgagtagggaagtgatagataaaggtcacagggtttctttttgaggtgaaacatgaaaatatcctctaatcgactatagtgatagtcgcacgtatctgtgaatatactaaaaaccattgagttgtacacctttaatgggtgaattgtgtggtatgtgaattacatctcaataaaattgttaaagaaaataaacagaaaactaggggaaaaagtactagattgttagtatccagttgcatctttgtgtttttcctctgtgcctgctctcatgtccctcccaaccctgaattttgtgttaatcattccctggtttattgtaaaacagttttatcacatgtgtatgtattccaaaacaatagtgtttaggtttgtttttttggtttatgaaaaaaggtatttataatctcgcattctcttttgagatggagtctctctctgtcgtccaggctggaatggagtggcacagtctcagctcactacaacctccgcctctcaggttcaagagatgctcccgcctcagcctcctgagtagctgggattacaggcgctggccaccatgcctggctaatttttgcatttttagtagagaaggggtttcaccatgttgcccaggctggtctcaaactcctgacctcaggtaatctgccgttctcggcctcccaaagtactgggattacaggcctgagccaccgcacccagcctaatcttgcattcttaaaattcaacattaggtcattaagaattacccacattgggctgggcgtggtggctcacgcctgtaatcccaacattttgggaggccgaggcgggcgcatcacgaggtcaggagatcgagaccatcctggctaacgtggtgaaaccccatctctactaaaaaatacaaaaaattagccgggcgtggtggcgggcacctatagtgccagctactcgggaggccgaggcaggagaatggcgtgaacccgggaggcggggcttgcagtgagccgagatcgcgccactgcactccagcctgggcgacagagcgagactccatatcaaaaaaaaaaaaaaaaaaaaaaagaattacccacgttgttgcatgtaggtatgtaatatttcttggcaaatattccatgatttatttcaccattcttgttgacaggcatttgggttggttcccatgttttgctattacaaagaatgctgctttgaagactttttttccatgtgtcttggcacacatgtgcaagagttcttcactgtgaatgtgccatgtattttaatgggaaaaaaaaaaaaagaaaacctgattctcctttgacttacacattgatggcatgtaaccacttactcatttccccaaaccaagataaaatgattagatctgacattctgacttctcatcctatttacattctagttgtaaaagtatttcccaacgttttaagaagtgtggaaaatctaaaatttcacaactcaatttcacagcagagccttttaacccggtcactcacggacatcttcatctccttatatcacctgggtttaggatgagagggaggacaactttattattacatcaaaggaacattactttaatcaaagtacatgaatagttactaaacctcattaaaagttgcctcgtattgtatatcctgcggagtggtctagtatttccgatgtgatttagttaggtaagtctgataacaatgagccttgggcagatctagatctgtcgttgagttaggcagtgagttttgccattcattcaggatatttctccttgaacttagaaggaggaaagcaccttaaagtcagaacaaaccattatgaggaattttaaaattacttttactattttaagatatatataaaatttacgattttaaacttttttttttttttgagacagagtcttgctctgtcgcccaggctggagtgcagtggcacgatctcctctcactgcaagctctgcctcctgggttcaggccattctcctgcctcagcctcccaagtagctgggactacaggtgcccaccaccacgcccggctaattttttgtatttttagtagagacgggatttcaccgtgttagccaggatggtctcaatctcctgacctcatgatctgcccacctcagcctcccaaagtgctggaattacatgcgtgagccaccgtgcccggtccgattttaaacatttttaagcatactattcagtggcattaagctcattctcactgttgtgcaaccattattattgtccatctccagaactttttcatcatctgaaactgaaactttgtacccactaaatataactctggattctcctcttccacaatccatggcaaccaccattctactttctgtccctgaatgtgcctattctaagtaccttatacaatatttgtccttttgctacatgagctttgtttgtttgtttttgagacagtctcgctttgtcacccaggctggagtgcagtggcaccatctcggctcgctgcaacctccgcctcccaggttcaagtgattctcgtgcctcagccttcccagtgctgggattacaggcgcttgccaccccacccagctaatttttatacttttagtagagacagggttttgtcatgttggccaggctggtcttgaactcctgacctcaggtaatgcacctgcctaggtctcccaaagtgctgggattatagggatgagccaccacgcccggcctacatgagcttttatatccaggggaattccatcttgttttgtttctgtctttagtagacacttttcccactttaggaaaataatggcttctttcactgagaaattatgtgaagggattgtttccctttcagtatacagccctatacagaaagggacataggacattgtctgaaaccagaagaagaaattatgactattatgaatggggtcttcatctgccctgtctagttaattaggcatctaataatcctggcttctcattgaacacttagccacctgcagaaggtgcactagcccctaattcttaaaatttcacatttacctgatacatggaggaagtaaataacctttgatgttcctgttagccctcagcttttcagaatgtaaaggccattctgcaatatagaagtctgatctaaaatctcttttgttttgatgggaaggggtattctgagaggctgaaggagggttccaagaggctgaacatagaagggaggtaacctaaatggcagttctgaagaggaagatggttcctggggaagttagatgctggagacaccaaagacagacctgtagtggccgggcatggtggctcacgcctctaatcccagcactttgggaggccaaggcgggtgatcacaaggtcaggagattgagaccatgctggctaacacggtgaaaccccatctctattaaaaatacaaaaaaaaaaaattagctgggcatggtggcacgtgcctgtagtcccagctacttgggaggctgaggcaggagaatcgcttgaacccgggaggcggaggttgcagtgagccaagatcatgccactgcattccagtgtgggcaacagaatgagactccatctcaaaacacacacacacatacacacacaaaacagacctgtagtacatagacagctttgttgtcctattattatgcacagtttaatgagaaaataacctctgttactttgcatcattccatttggagatccagagaaattctgggatccattggttgacttactccccctatgttgagtgactgctatatccctagcatctggggatgcaaaaatgaagatcagtgaaggaagatagaatgaatagaagatgacacttaagctgtaaacataagtcacaaaggatctattcggatgattgtcatcatttcctactttgtttctatttagttttagtcagagaagaatcactggattcttggccgggcacagtggctcatgcctctaatcccagcactttgggaggctgaggcgggcagatcacaaggtcaggagatcaagaccatcctagctaacatggtgaaaccccgtctgtactaaaaatacaaaaaaaattagccaggcgtggtggcaggtgcctgtagtcccagctactcgggaggctgaggcaggagaatggcgtgaacccaggaggcagagcttgcagtgagccgagatcgcgccattgcattccagcctgggcaacagagtgagactccgtctcaaaaaaaaaaaaaaaagaatcactggattcttatgaaaatgaattattttatcctaaggcaacaagaacagttaaattggaccacactaagaaaatgagatgatcagatttttcagaaccaggtaaaataggcttccaagtgttgcatgtatagttcagtctggttatagtgtgatatactggagttggaggcatccatttgtaatcttagcttcgaagctgctgtggtctgaatgtttatgtcctcccaaaattcttatgttgaaatcctcactgccattgtgatggtattaggagtggaaggccttgggaggtgaataggtcatggggtagagcactcatgaatggattagtgcccttatgaaagagaaccaagggagaccctttgctcctttcgccaagtaaggacacagcaagaaagtgccatctatgagccagaaagtgggccttgatctgcattgatcttggacttcccaacctccagaactgtgagaaataaatttctattgtttataagctatccagtctgtggtgttttgttacagcagcctgaaagaaactaacatagtaacctgtgtattacccaaactgtgcaagtgatagatcaatatgatataagtgtgatctttccatcgaatgtatactgtcctggtattgctactcacccctctccagtggcaggaaaaccaaatgtctggcctaatgagttaggttgattgatggacagtttcaactgattggttacttgacatgaggtaggctaaatgcagatagtctatctctcggcagtcatgctagaagctgtggctagagattttcagggtacaatgcagatccacaattatttaggcaattttttttaagtttacatttttatttctcctccatttgaatttcttctctgtttcttagtactcctctctgtgttcaaagttctcactgtagacaacccttcactccccctccttccatcttgcttcagaacagcctctctcttccttaggaattcactcccctcaatgcctctttctgaatggaaggtggacaattatcaattgaaagtcttcagtaattgaaaattttaaaaagagacttgttaatagtgtgagtctctatataatatataattggggatggaactcatttttatgcttcttattttggttcagcaatctttaaactgtgtgcatttactatatgcaaaggtttgccaaaggtacatgtgcacaggtgctttgagaatataaaggtccaaatcctcctcttccatatgtgcttttttcctaagactaatcttgatgagaatggacctgtaatggagacgcaagttctctttcccatctgcttttccataatcaccttcctcttgctttccttgtgaaaagcgtatgtctaccccattttcctaatccattttactaaatggtttatgtctaacccattttagtaaattgctttgcccaaggatgtaaaactctaggggatggggaggacaaaaaagggggaaatttctgagtataaatttcgtttcaggggtgagaaagcaaatgactgtaatgcctgagcagagacccttttgcaaatcatgtgttttctaaatctatcttaaaaaacaaaaagtgaaggccagtctaatcaaatagtaaaccgatattaaaggataaactctaaaaaagaatgaaattttgactctcatacaaataaaaaatagacattttcaaacttatttaaaaaatgagagagccagaaaggttttgcagtcagttcaaaggagatcatttataagaatgctggaatgaatttgcttaatacatgtaaaactggcttcttccacaatgggagagggaaggtgattggacttctacagcataaagtttatttgcatgtctgtatgacttgctttactatcagttttctgcaagttaacttatatctctacagggttgtaaaatagcttagtcaaacacaatgaatgactgagatgacccagatgaataagtattagggtactcatgaaatttgtcttctcaatttttccttacattgacaattaaaataagttttgatatttcactaccatgtgatgttggagttcaaaaaattaagtgacatttctataacaaaattcctcccatttccatctcctcattatgtttcccagcattacattgataaaaacaaaaaataagaattaaattgatgctcaacattgacccattttatttatttttattttattattattattttttattgagatggagtcttgctctgtcacccaggctggagtgcagtggcacgatcttggctcactgcaacctctgcctcctgggtttaagtgattctcatgcatcagcctcctggctagctgggactacaggcgcgagccaccatgcccggctaattttttgtacttttagtagagatggggttttaccatgttggccaggctggtctcaaactcctgacctcaggtgatccgcctgccttggcctcccaaagtgcggggattactggcgtgagccacagcgcccagccacctggactcattttaataagtatacacatccacatatccataaagttatggaaagtaaaagtgttcaaaagagagagatttccaataaagttgctttttatttacttttagtaattatttgtcaaaatttgtaatatttgtgttgttttctaagtcacatcctactaatagtaacaatggtatcagaatagctttttttaaaaaatgttttgaccattgaattagaatttaaatttaaataatgtttttgatgcagaaaagtatggtaggctaatgagtaaaataggctaaagcataaaatatgtaaaattaggataaacttctgtagggcaagaagcgtggaaatataagttcaaggagaaaatggaattatgcaaaatttgtgactattaaagaccagcctgttccagtattcttttaaaatgagtaagaatgaatttcactggacatataagatagttttatatggccatatttacacagtgttggaagttacattctttgcaactattcacattttggtgacagttgctatatgccaatctaaaaatgtgcaagaggcttttacaaaattcttttagggtatatacaagtaaaaaaattgaagactcctgttgtagctcaccctgctgctattttctgaccaaaaaccaagggtcagtaattgtggcaaaacctttctagctcagtattggtaaatgaaccaattcattaattgacatagttctagtgactccttgttttactggatgtccctaaggaagccattcaagaattaaaggtcttggccaggcatggtggctcacgcctgtaatccccaccactttgagaggccgaggtgggtggatcacgaggtcaggcgttcgagaccagcctggccaacatagtaaaactctatctctattaaaaatacaaaaaatggctgggtgcggtggctcatgcctgtaatcccagcactttgggaggccaaggcgggcagatcacgaggtcaggagatggagaccatcctggctaacacggtgaaaccccgtctctactgaaaatacaaaaaaatagctgggcgtggtggcgagtgcctgtagtcccagctactcgggaggctgaggcaggagaatggtgtgaacccaggaggccgagcttgcagtgagcccagatggcgccactgcactccagcctgggtgacagagcaagactccatctcaaaaaaaaaaaaaaaatttagctggacttggtggcacgcacctgtaatcccagttacttgggaggctgaggcaggagaattgcttgaacctgggaggtggaggttgcagtgagccaagatcgcgccactgcactccagcctgggtgacagtgtgagactccatctcaaaaaaaaaaaaaaaaaaattaaaagtctaagtacttatgacacgtctcaaaagaggataacagccattacattttatttatttctttgtaggcagttatatctttactttattcatcgttattgttctcctctttggaggcactcaccagaaggtattgtatgagtgtatatgtaaaacagacagacagcactacagtattccccacttatccatgggggatacgttctaagaccccctgttgatgcctgaaagcatggatagtaccaaatcctacatagaccacgttttttcctatacatagctaccgtgataaagtttaatatataaggccgggtgtagtggggcacgcctataaccccagcactttgggaggccgaggcgggtggatcacctgaggtcaggattcgagatcagcctggccaacatggtgaaaccccaactctactaaaaatacaaaaattagccaggtgtggtatagacgcttgttaatcccagccactcgggaggctgaggcaggagaatcgtgtgaacccaggaggcaaaggttgcagtgagctgagattgcaccactgcattccagcctgggcgacagagtgagaccccatctcaaaatttaaaaaagtttaatgtataaattaggcatagtaagagattaacaataataactaataataaactagaacttcattgcaatataccataataaaggttatgtgaatgtggagtctctctctctctctctctctctctctctctcaaaatatcttattgtactgtgctcacctatatttggaccattgttgaccatgggtaactgaaactacagaaagtgaaactgggcaaagggcaactactctatttggatctgtaaatgtgtagctttcaccaagtttggaagtttttggtcatgatttcttcttttgttttgtttatttattatttttatttttatttaaagcacaaaagcataatgttttgtttttttgaaacagggtctcactctgtcactcaggctggaaggcagtgacacaatcttggctcgctacagcctcgacctcctgggctcaagtgatcctcctgtctcagcttcccaagtagctgggactataggctcaggccaccacactcagctaatttttaagttttttgtagaggcggggtctacctatgttgcccaggctggtcgtgaactcctgggctcaagcgatctccctaccccagcctctgaaagtgctgggattacaggtgtgagcgaccgcgcccagcctgagcagtggtttatatctacttcagtttgcaaagcctttgggaccgtcccacacatacacagttcagggacttgtgctggttcatacacagagccagggcatccccttctttagctctcgtctctctgggattctcgccacacacctctaccccaagatccctttttcctgttcttctggaaagactagatttcttttaaagtttaaggtgcttatgctgctgtagagttctccaagacttggggccatcctcaggacagagtagcgagaggaataaaataccaggaattctccccatactctgtggaccacaaggtcccctgttcccctacttttctgtcagtaagcccagatttctttttttttttttttgaggcagtctcactctgtcgcccaggctggagtgcaagggtgcaatctcggctcactgcaacctccgcctcctggattcaagcaattctcctgcctcagcctcctgcatagctgggattacaggcccatgccaccacgcctggctaatttttgtatttttagtagagacaaggtttcaccatattggtcaggttggtctggaactcctgacttcatgatgtgcctgcctcggcctcccaaagtgctgggattacaggtgtgagcaacctcgccctgcccaggtttctttagaaaaaaagtttcaggtgcctgtgctgctgcttactgttctgccacacagttctgtgactacggccacgcttgggagagaaaaatgcaaacaaaacccaaaacctgggcttgcctcacactcttctattagccagggccccctttccagttcctctggccaaaaagaggagcttctgttggagtgtttgctacctgcacccccacccaattctgatttaaggtcgaccctgaagaaaaaaatgagaaaaaaaccagcattttactcccaaatgggttcccttttcaattttgattcttctcaattcatgtactattgttttgtcttttggaatcagatagttgccttttgtattttgaacacagtttggagagaggctgaagtgggcttcttccttcttgagtgtccctggtagccccttcctctttttgaagctttctcttgtttcctttttctcctctgtttcttccacaccattcttttctttccactttacccactttctctgtttccccttttactttgggctcccaggttcaaagagcaaaaaaaggaagaacctgtagttttttagtggtcaacagcatgagttgaaacccctgattgattgtgttgaagtaataaattgaagctgggtgtggtggctcatgtctgtaatcccagcacttcgggagaccgagtcaggaggaccgcttgagcccaggagctcaaggttgcagtgagctatgattgtgccactgcactccagcctgggcagctgagtgagaacctgtcttgaaaaaaaaaaaaaatggccaggcgcattgcctcacgcctgtaatcccagcacttttggaggccaaggcaggtggatcacttgaggtcaggagttcaagaccaacctggccaacatggtgaaaccccgtctttaccaaaaaatataaaaatttagctgagtgtggtgatgcacgcctgtaatcccagcaactcaggaggctgaggcaggagaatcccttgaacctgggaggtggaggttgcagtcagctgagatcctgccactgcactccagcctaggtgacagagcaagactcggtctcaaaaaaaaaaaaaaaaaaaaaaaatcaaagtcaagtgtgaaagtagacccaggaagctagagacacatgaagaagcaaaagggggctggaggaatgcttgggccaaactgatcacctggctattccatcacacttggatttgttggtaatttctattcataaaactggcccaacacttaagaactgatctttagggcttttcttttttcattttcttttaagagagttgctgaatcttttatttaattgcatataattacaatgaatgctggtaaattttgagattacaaggaatttcaacaaaccttattactcgttatctaagtccattagtattgctataaaggatacctgagactcatttacaaagattagaggtttgtttggctgacagttctgcaggctgtacaagaaacatctgtttctggtaaaggcctcaggctgcttccatttgtggcaagagttgaagggaagctggaatgtgcagattacacggcgagagaagaagcaggaggagaggagaggtgccaggctcattttttccttgccactctacagctcacaaatggatgccagcctctttttaacaaccagctctcctgggaacgaatagagcaagaattcactcttgtgagaatggcaccaagccattcatgagggatctgccctcatgacccaaacaccttccacctcccacctcccattaggctctacctggggatcagatttcaacataagttttgcagggggtcaaacaaaccagaccatagcactcatcattccagagagacaaggcattcttcacattgaaatgacagaatttgataaagtaaaacattcctagtcatgagaagtaactgactatatgaaatgatagcctcctttttttttttttttttttgagacggagtctcactctgtcgccacactggagtgcagtggcatgatctctactcactgcaagctctgcctcctgggttcatgccattctcctgcctcagcctcccgagtagctcgagtagcttggactgcaggcgcccgccaccatgcccagctaattttttgtatttttaatagagacggggtttcaccatgttagccaggatggtcttgatctcctgaccttgtgatccgccagcctcggcctccccaagtgctgggattacaggcgtgagcaaccacgctcagccctatgatgatagcctcttatgctttcagtccatggtgcttttgatatccccctgcttgcagtctgcggtgattttgcagtgtgcttgttctgtggcctggtttgagaagtgtggtgtgtgaggctgggcgtggtggctcacgcctgtaatcccagcactttaggaggctgaggcaggcgagtcacctgaggtcaggcattcgagaccagcctggccaacatggtgaaaccccatctctactaaaaatacaaaaattcaccaggtgtggtggcaggcacctataatcccagctactcgggaggctggggcagaagaatcacctgcgcccaggaagcggatgttgcggtgagccgagatcacgccactgcactccagcctgggtgacagagtgagactctgtctcaaaaaaaaaggaagtgtggtgtgtgagatgttaccatcattgtgtctggaagatagaggaggtagtaacacttaccatgataattcagggattgagcactcactgggtacagagcacagtgatgagtgctgtggaccattcagagggaaattataataatgacatgtaggcatcactttgtagttgcaaagttcacttcatggtctcctttcaccttcccaagaatcctgaggcatgtattattattgggtagataatacttatgacatatttccagaaggcccctgagctttaggtccctactcgtaactgccaactgtaggcacttcaaatgcagatcctctaactctgaactcctctgacctgggcacctccgctccctaactctattttgattggcaccaccttccctgaagcaaaacatctaagatatcctagcttctccctttccctccaaacctccaaccatttaatcttttctcaaatcttgcctaatctaaacttcccttagatcttcttcaacccgctgtcactttattcccaactcccctcccggccctgactaccaccccttctaactactcatcagtcccttgtttctcatgctctgttagatagctcctggcgcataatgaatgttccatcaatatttactcgtcattcatgcttccatgcgtttgcatatggaggcataggcggtgggatgcctttacttatttttcttcttctgaataccatactctcatctttgagacttaatttggttcttatcataactttggtagcctctctacttcccagggctcagttgcatgtctacctttcttgagctgcctgtcccacatgctcccaccacatccctgcacacctctgttacagtaattctcaaagtgtgggcccttgtactctgaagagtgcttcttaaaaaggcagattcctgggaatacccagaactactgcatcagtattgctgagagtggggcccaggagcctgcatttaagaaggctcacctctcccccagtgattcttacgcagatgaaaaagagtggtgagaatcaatgttttattctctcacctgccttggcctgtacaactagttccaggagtggggagtatggccacttggagcagtatctgggtaggtttcaccaccacttctgaccactgggagatgagaacagcaaagttactcagatttaatttttttttttttttgagacggagtccagagctggagtgcagtggcatgatctcggctcactgcaaggtctgccttccaggttcacgccattttcctgcctcaacctcccgagtagctgggactacaggtgaccgccaccacgcctggtcaacttttttgtatttttttgtagagatggggtttcactgtgttagccaggatggtcttgatctcctgacctcgtgatctgcccgcttcggcctcccaaagtgctgggactacaggcgtgagccaccatgcctggccagatttaatggtttttaactgtatctttacaaagaggcacaatcctttttcatttgtttgtttttaaaccttttttgagttataattttatatgccataaaattgacccaatttaaatgtcctaacctactttctgtctctatagattagcctttcctggatatttcttataaatggaatcatacaatacacagtcttcttgtctgactttcatttagtgtaatgcttttgaagttcacttgttttgttttgtagcatgtatcagtatttcactcttttttatggctgaataatactccattataatacatatgccatattttgcttaggcattcacaggttaatggacatttggattgtttccattttttggctattatgaacagtgctgctatgacatttgtgcacaagtctgtgtgtgaacatatatttttatttctcttgagtaaaatagagtggaatgactggttcatatggcaaatatgtgcttaacttctgaagaaacttccaaacagtttaaaccaactgtcccattttccatattcaccagcaatgtctgagggttccaattccttcatattctcaccagcactttttattatctgtcttttaggttataaccatactagtgtgtgtgaagtggtatctgattggagtcttgatttgcattttcctaatgattactgatgttgagccctttcacatgtgctcttggccatttgcctgtcttctctgggaagatgtctatttagatattttgctgactattaaactggcatatttgccttcttattgagtgtaaaagtttttttatatattctggatacaaggggagtaacacatttacttgatggagggagaatggttcacgaccctcctgcccagtctgtagtggcctggccagcaggttctccatggctcttcttttctcagtgccagcgtgtggcccttaggggactcctagaagcagttctttgaactctacctcctccatggtgtaaacaagcgcaaaggggcaacgtggggacacagaaatagaaagagcttcctcaactgcataggtgcttagaaagggctatagaggggcctggggaatgagctcctcttcagtgaagggtttctatctcgtgtttagctaagcgagcttccactccatgacaggggagtagtatatggtttatcctggccctggtcagcattcagagtcctttattttatggctctgccttactcagccccatcaccccaagtcagtgcacagagccaggattcgagatgtacttagccttccccatggcctcagttctcactgggctccctcctgcctcagtagcccagttccctgtggcccagtgccatggacagctggccagcccccagtggctgaactgtctactcctcaaggagattgtgccttgaggacgcagtctgtgtctcatccacctgtgtagccccaagccagtaccgaatgtagctcaaaacacctttgcagacaattttcttaagccactgaatgaggaagaaggaatgagttcgtatattggaaataggaaaactgagactcagacagattaagtagtctgtctactagaagactcaagacctccagaatcacgtgggttgtcagtgaaggggctggatctcaaattaagattctctaatccccagagttctttttccactacattaagttatgagtcctagccttttatcttcagacatttcaacttagaggacaaatgcttaaactacgaggcagatcagagatggttctgaggggtgatacctccagagtggagggggcaaatgggatggtgaggtaattgtacatgtggtttagatggaaatgtcagggagtaagtatttcttatttcaacttagaggaggaatatttatatataaggcaaattagggatggttctgaggggtgaaaccaccacagtggagggggcaaatgggatggcgaggaaattgtatatgtggtttcgatagtcgatggagatgtcagggagtaaagacctctccagagattactctgatttgtgagacactgcaagatctcttggaggagctgggatttgaggattgaaaattaacagtgctaggaagaaccttagaggcagcagaatcatggcataggagagggatagggtaggacacgtttgggacttggggagttgtccctgtggcatgtgggtatctcaggagcatggggaattgtagctagagagctggggtgagatctttctgaaggtcaagctgaagcatttttctcctgcagtgagacctgattagaggccctagaggagtcagttggctaaccaggatctcatacatgttttctccagtttcatgaaacattgagagtgttctttttcttatataactttctggtctcagctattctgattacaccatctcaaaaatcagagactcttgaaacatctttgcaataaaaagaaaatggtgctttttgtttgctgtttggcgagaagctggctccagaaatgctctataggagagtaagcaaaagatacgaaggcgggcaccttggcaacgtgaatgtatctcttagttaaacagcttcctggcttgactgagcagggtttgctttcagccccctcacactacagtagggcaggaaatgttttttaatcagccttagttttctagatatgagcattgtgcctagtagacagtgggaactgactgattgagtgaatgaaacaaacatattcaatgagccagttaaaaaatgaatgaatgaatactgtgatggtttgtttctcctatacataccattacccaattagtaatagtgaatcacagggttacttctcccagtgcttggtagtttcctgggaaataaaagaaagtcactgatacggttactgtaaagagaatttaacaattggccagacgcagtggctcacgtctgtaatcccagcactttgggagaccaaggcaggtggatcacatgaggtcaggagttcgagaccaccctggccaacatggcgaaaccctgtctctgctaaaaatacaaacattagcctggcatggtggagggcgcctgtaattccagctacttgggaggctgaggcaggagaatcacttgaacccaggaggcggagattgcagtgagccaagattgtgccattgcactccagcttgggtgacagagtgagactctgtctcaaaaaaaaaaaaaaagagtttaacaatctaggacagtctgatttgatggtagtttaccaaatattttaaattttgatggacttacagagaaattagtccattgtaactttattttttgcagagagttcacatataaaccagttgcccagcctcactatgagaaaaggtttgaaagtctccagtttcctgtcacttcaagtctatttccttttttttttctttatttcttcttaaaaaaaacactttaaaaaatgggatacatgtgcagaacatgcaggttcgttacataggtatacttgtgtcatggtagtttgctgcacctattgacccgtcctccaagttcctcccctcagtccccatcccccaataggccctggtgtgtgttgtttctctctttgtgtccatgtattctcaatgttcagcccctacctatgagtgagaacatggggtatttggttttctgttcctgtgttagtttgctgaggatgatggcttctagtttcttccatgtccctgcaaaggacatgatctcattcctttttacggctgcatagtattccatggtgtatatgtaccacattttctttatccagtctatcattgatgggcatttgggttggttccatgtctttgttattgtaaatagtgctgcaataaacatatgtatgcatgtgtctttatagcagaatgatttataatcctttgggtctatacccagtaatgggattgctgggtcaaatggtatttctggttctagatccttgaggaatcgccatactgtcttccgcagtggttgaactaatttaccttcccaccaacagcgtaaaagtgttcctgtttctccacagcctcaccagcatctattgtttcctgactttttaataatcaccattctgactagcatgagatggtatctcattgtggttttgattagcttttctctgatgatcagtgatgttgagcttttttcttatgtttcttggccacgtaaatgtcttcttttgagaaaagtctatttcctatttaatcttagattcatgatcttcagaagcccttggatctgggtctctcttgcagaattggaagagaaacactcactaccattatttctgtatttttggcctagtgaggagaactttcagctagcaatcaggaaacctgaaagacccacctcttttattaacatgaaaatgttatccaagtagcattatctcttacttgttttgtgaactcgttgtgaggaatttacaaaaccctttagacaatgtggagttttaacacaatttgaaatcctgaagaaaaaggagccatggaagagacccaaaggcttacattagagggagcaagtgtgctctttcaagtcatgggagggagccactgtggttccaagtaggaaaaactaatctagcatcttcttttaaatgaaaatttctcctatgaaaatctggctttcagcctgatctggaatggtgccagtgagtgggcaggcaaagaaaagacagtgagtggtagctaattaattagtcaatcaaaaagtatttatagttctctaggtatagggcaccatgctggactcagtgggagatgcaaagaagagtaagacccaacctcagcccctgaaaagcttgcagccggtctccttgggaggcgaggtgtacaggtgctgacaggaaagaaagcacaaggcaggtttttaattgggccgtatgtctcacagatgcaaaataggtaatccaggcacataggttgttattctaggcttatcaccattgacattgcgccatggagtgtcaacattcagagcatctgtgaaagctgcttttataactggttagagtgagctagttaagggcttaacagacccttcaccaatgagcacaagatgggttgggtgaagaaaatatgagggatgaaggagtgctgctagtttccaaaaatgaccccaaagagattgggccttcatcctttgctgtttagaagcaaaagagtcattgtaaaaatgttcagagggaaaatatgtgtaaatatgttcagagggaaaaataacgaattacataccacaattttcattttatggtaaccgcacatacacgtagacttgagaaaactcttttaaacatgttggaggaataagtacatgggcagaggaaaatgaaatgttggggacaaaaataaggctatactgacctgaagttttctgttagtcatttccattgaccagatcttctagatgactgcttgacatttcaaatataactattcccactgacagcaaaatgagatgggatgacttaatagctgcagcgaacgttcattatgaccatgttccagactttctctacctttatacttaatggcaaccctgtgtatagtatacctcctggctcagatgcaaatagtcataactgtgttaacactggatatcgatcacagaaaaactgtgatataacactattgggaggacaagacaaaaggcaatacgcatgcaggtggtagtgaggactgggcaagcaaaaagtaaacccgtgtatttttggtggcaactcagtagataatgccccaaactgaagaaaaccaaataatacacagagatagagtcatgttatttagacataagggggaagggagggtgtgattatcaaagaaacagttaaaattattgaaaatggttagcacttatgacacagaatggaagagggtagaactattgattctttaaattatgtgcatgtctagctttgataaaaataaaaattagcctggatgccatggctcatgcctataatccctttattttgggaaactgaaatgggagaattgcttgagcccaagagttcaagaccagcttggacaacatacagagacactgtccctgcaaaaaatgaatttaaaaaattaaccagatgtagtggcatgcactgtaatcctagttactagggaggatctttggtgggaggctcccttgagaccaggaggtggaggctgcagtgagctgtgattgtgccactgcactccagcctgagaaacagtgagactctgtctcaaaacaaaaaacaaacaaccttgaaaagtgaggggaaaattcagataagaaaaaaaaaaatgacccaaaaggaggatgggtgcacttctcattataatgaaactcaaaagagaatacaaaaaaattaattcaaaacaaggaattaacattaatctcaagtacagttttttaaaactgatttttttttttttttttctgagacagggtctcattttttcactcaggctggagtgcagtggggtgaacacggctcactgcagcctcgacctcccaggctcaagagatcctcctgcctcagtcctccaaatagctgggattgtaggcgtgtgccaccacacccagctaatttttccattttatgtagagatgggtttcgctgtgttgcccaggctggtctagaactcttgggatccagcgatccacccgcctctgcctcccaaagtgctaggattacaggcatgagccactggccccggctcctaaaacaaattgtgaaaaggagaaagttgtgcgatgttatgttccttcctcttttttccccacacacactcacactctggtcaggtgtttgtgtatatcctttgacctttccttgccatcggcttctacttaaataggatgactagagaagatctggggggacaagtttgagctgtgtcatctaacccagtctcttcattctccagctgtgaatctggcttctctttgttcttcactgggttcttagaatatcttctttcctgccatcttgctgtatccccctattctgctggcctcctgaagcaaattccttggtctatccccctggctctgactcattccttaccctgaccttgctgtctgtatttgctttgactaccctatgagtttcctcaacctaattcttaattcctggctgccacctccttgtcaaaacttggctaaatccactttggaatgctaaggcggatgggactgcctgggaagaatttggagaatctgcagctctgctctttcctcattcttgagagccaggctagtggctgagggtatatcgggagacagacagggagagagacagagagagtttggagagaaggcggcatgatcatccgatcatcttgggccccatcagtctccttgggaatgctaacatgtctcctggtatagtctttcttttatttattcttcagtttatcttagaaactgttctgaaagttttaaacccagagacatctctccaacttccttgcatgagctgtattttgaccgccttaggggctgtggcaggatttcagtcttgcttgtggtgattttacatggagtgacatctgagtcgcttttcgactgcattccacaccaatctgtccagccctgcagtttgtgggctgactcctgttgtctttcaacatacggagcactatgagatagtgcgagtttgggtcttgtcagggagtctgattaagccacagtcagagacggcagtcctaagtgtgaaatgtaacaggccttctcaagacagcttcatctgtgagctgctggaggtggctggtgccattctgttgggaatagaggcttgctaacaaagcaaacattttttttttctatcgcaggctaggtctatggtggtaacatttggcaagttgagtaacagggaacatagataactgtgaacagatgggcaactattaaaagatttgaggggctttcatcatttctcaaatggccttcacccacctacaggatacccagctcccttgcaagaggattacgtaaaggattcaattacatttctctttcctttttttttccttcaattgcgatggaagcacaagctctgacgtgaagaggaaaagaatagatgagaaatttctaattttgaatccccttaggattagatgctgatttcagctgtgcagagaacactgccccatattttgcaagagtaactgctgccagtttcaggagagatgactttccaaaatagacagtaaactccgccctccatagctgatgaccatctgacattcagacagaattacagagctatacaagttttgataagtataaccttgcttttgaaaaatggcagtggcacgtcatcactgtgtttaagctcaaaactgacggactacaaaacacataagagaaataaatgtattgcctggtccccagcagaaacataaaatatttatccatctgagagcaattaaatttatttacccctgctttaggacagcagtgtctctgattcagaagcatgctgttcctcttttgctcagagtgatgcttggaaggttcttaagagggagaagaattccaggcactgattaagaggaggcttgttgtcgtctcttaaggagcagcagcctgattttgccaaaagcaaccataagttgatatggccggggttaaggtggctataagctagatctcaggaacctgaacaaattagattgggtttcattcctcagaggttgccttaaagacatataaattctagggccaataatcttaatataagtttataattttagtcggtacttaccctatgcacactcatttaattttctgtttggaagcaggaagcatggataccctgccccctcgccatttttttttttcctagacggagtcttgctctgtcacccaggctggagtgcagtggcgtgatctcagctcactgcaacctccacctcctgggttcaagcaattctcctgcctcagtctcccaagtagttaggattacaggtgcccgccaccatgcctggctaacttttttatttttattattttattttatttatttatttttgagacagagtctcactctgtcgccaggctggagtgcagtggcacaatctcggctcactgcaacctctgcctcctgggctcaagtgattctactgcttcagcctcccaagtagctgggattacaggcgtgtgccatcaagcccagctaatttttgtatttttagtagagacggggtttcaccatgtaggccaggctggtctcgaactcctgacttcgtgatccgcctgcctcagcctcccaaagtgctgggattacaggcgtgagccaccgcacccggtcaccctgccccatttttatccccagtcctctaatcagctttaatccctatttatcccagccaagagtactgggtaactgaagatccctgtctctacaaaccaccccacctaagactaaattttgcttaaacataaccagaagccttacaaaaggaaaataaccatttgtcatattttaaattaaaaccctacattcagaataattataatttaaaataattcagcaacagaaacaccaaaacaaaccaatcagtaataagtggaaaacaattagctcttagaggtgatggcctctttgcctgctaaatgatgctcagagtcataaactcagttctcctgggcagggttgtttggttttatgtaattgagtaaacaaggattatcggtaggtttagtctcccctggagaattatactttaacagaaggaattattggaaatagtgaaaatacgctcccaccattagcagaagaagagctggcaatattaatttttccatatatgttttgtgggcttttaaaaagttaagtgctgtacatagattgtgtcatataacaaggaagcatccacacaggcacttggaagcagtataaagggagtgaatatttgtgtattacctattgggcttgtaataatcactaatggaatagaaaataagctcaatataatgccaatttttttttgttccaagttttaggttcttttgaatttcacgtatttttctgatatttagaaatactctgtaggtaaataaaagacgcatgcacacacatttatagcagcacaattcgcaatagcaaagatacggaaccaacgttaagtctccatcaaccaatgaatggataaagaaaatgtggtatatatgcactatgaaatactaatcagtcaaagaaaggaacaaaataatgtcatttacactaacttggatggagctggaggccatgttattctaagtgaagtagctcaggaatggaaaaccaaatatcatatgttcctcacttataagtgggagctaagctatgaggacgcaaaggcataagaatgatataacggactttggggacttggggaaaggtgggagggggatgagggacaaaagactacacattgggtacagtgtacactgctcagatgatgggtgtatccaaacctcagaaatcaccactaaagaacttatccatgtaaccaaaaaccacttgtacccacccccaaaactactgagattaaaaagcaacaataatacatacaatttcatggttaaaaaataaaaataaagccatccccagtgattgtgtcttcctcctcgctgttgttgagactgatggtgttggtttactcatcctccctgatgctcacgcagcctccatttgtgcctgtgcttttctagaatggccaacatgcagggactggtggaaagactggaacgagctgtcagccgcctggagtcgctgtctgcagagtcccacaggccccctgggaactgcggggaagtcaatggtgtcattgcaggtagggtcacaaactgttgtcattcctggtcttcttgtgggttacttcattttgtttccataatttcactctcaaggaacatttctattatccttcagcttccctactccttccatcgtatgtgaccataacattaaccagaggcaagcaatccctgaaaaagagaaaggaagaaaacctttcaacccacaatccacaacaattatcagtatctgtgccttttagagacagggtctcgctctatcacccaggctggagtgcagtggtgcaatcatagctcacagtgacctcaaactcctgggctcaaggcatctccctgcctcggcctcccgaagtgctgggattacaggtgtgagccactgtgcccagcctcagtgcctcttaagagcatattcatctttctttcatttagtgttcatactgctgtcccgcactcaatgactaaatatgttatctacataattatcaaaaaagaaactaatgttcttgattagaatgtaaattggaaggaattatcattctgtagattttcattttaaaaagaacaaatcactaaatttaggaactaaagttttgaaggaagctggtcttatgcaaaggcaaatatgactttgatgtaacataactacgtcacggtgttttacctttgcctattcctaaccaactatgctttttttttttttttttttttgagttggagtctcactctgttgcccaggctggagtgcagtgatatgatctgggctcactacaacctctgcttcccagattcaagcgattctcttgcctcagcctcccgggtagctgggactacaggcgcccgccaccacgcccagctaattttttgtatttttaatagagacggggtttcaccatgttagccaagatggtctcaatctcctgacctcgtgatccgcctgcctcgtcctcccaaagtgctgggattataggcgtgaaccaccatacctggccaaccaaatatgcttttaaaactatatcctaataccatactgtaaaacattttttaattatatcatcaaaaataaaaagttggctacttcccaaaaagggtaccacatatggcaagctctccaagttatctacaataatttttccaattccttcttgactaagggacaaataaaaattacaaataatttacttaataatttttttaacaaataaaaataaaggacaaccaattaaatttgaatttcagataaagaacacttttttggggggtataaggatgtcccaaatactgcatgggctatactgcgtgttatgcacctacagcaaacatttattcattgcttctctgaaattcaaattgaaccaggcaatctgcatttaatatggcaactctgttcttgtcacatgggcacttcctccttatctgacccatactgaatcctgtcaggtttttttgggctgagaaaagccgtggggaagaagggacttcagaaaaagctttcaccaggaaagacctacattggtgcttctagaatttcaggcgaatttggacccgtgcctgtattacataccatgggacaaaaattactgtgtgagcacaaatgtgctggctggtttatttcccccctgaacataatgaaaattaaaatgctttgaatgaattgaaagggggtgttgttttaaggaaggctgccaggagcctgtaagtttttttccgcaccaactgagacacatctatgatttcattttaagcctctttttgttaactgtatacaattggtatatgattcaataaaccttatttgtaagaaaatattttcaccctctcttcagtaactttgtttcattatactgttggcatcagatgattaaagacatttctgtaaactactgaccacaaatgtgaagcctgtgaatacacaaaacaaagttaaaatctaactaccgggagactatatagtattattgagtaaagaaaaaaaaaatctcaataatttgaacctcacttactcaaagaggtactagattgaacttggtacattgtaaaaaaaagattttttctaggaaaattaataggctaagtagaattagagggtatgtaattaaattatttaaattatttaagtgtttaaacaaatattttctcatataacaaatcgttccaaaccagtttattaaagcaaagctcttctaaaacaacttagcccgtaatttactatcctacttgaaatgaagtaggataattagtaaattgtctgaatgatatccatccttaaaacattttactaatcctaaacaacaccatttccatttcttcttaattagtaagttttgacaattttataaattctatttttaacaaatccgccgaacaaccttttaccttacatgtaaacatcattacgacaatgttataacaaaagttattttttttttaattttaaaagaaacttgaaaatgtttaaaatcgggatggacgcagtggctcacgcctgtaatccagcactttgggaggccgcggcgagccgatcacgaggtcaggagatcaagaccatcctggctaacacggtgaaactccgtctctactaaaaatgaaaaaaattagctgggcgtggtggcgggcgcctgtagtcccagctactcgggaggctgaggcaggaaaatggcgtgaacccgggaggcggagcttgcagtgagccgagatcgcgccactgcactccagcctgggcgacacagagcaagactccgtctcaaaaaaaagagaaacttttagaaggaacataatcccttacaaatgcataataggcatagatcaaaggaccactctattatgatactggtattatgatgtgctttagaaggtgagtgtttttttcctctggtgataatcacttaagttgcgctcaacagttgaagtatttttgcgtttttataatgcgacaaacactgtgctaggtgcaagaaaattgaagatgaattatacacagtcctaatgctccagaatctttggtctcaatgcattactattcatggccccaaattctttgattaagggatgctcaaaggatgcagtttggagagaaagacaggtctgcccgcaggaggtgtgaacagagttgaacgatgaaaggaaattggaaaatattcccttttatcattgtaccttctgctatgtagaggactctgtcacttttctgaaactttctcccactttaaatactcagcagagatccccgctcgggcctcttccatagcaacaaacaggtttatctgtctccaaacggatccataaggagcctttgggcttgtgtcctttttatgttccagaagttgttatatactgtgctgtgaactttaagataactcagcttcaacgtctagcttcaacatcctgctcggaagttagaacatacctgcagagagtgtaaataacttgtttccatcaccctttgggcctgtggaaatgggtaattgggaaaaagagaaaaagaaagacactctcctaatagttttgtgagcatagagaaaaggaatcctagattttggttagagttttcatagtttctcagtattgtatttctcaatattagggacatgaaatcagggacttagattttttttctgttaattaaaaggcagggaaggaaatgcagagcacacctgttgggcagttgccacttgagctttgccagtaatttggcagctctgaacccaacaggtatgggctcagcagtcaatttcattcccactatggttgtccccccaccccctggggagtgaagaaggaagaaaatgagtgaaatcagctttcttttcctccttgcccagagttcattattaccttctgattgtcctgggtaatcttggtaactgtttgtaaggtcattatagcacctgagcaggtggctatggaagaagggccactggctttggatgactcggctgggttcaggttttggatctgccttttgtttggtctgtaactctggccctgtcaggtgctgtgtttgcagccatttcctcatctgtgatggtgctacctacctccctgggtccggagggaatgaaatgaaattatgtagcgtctttactcaggaggatgaaaaataggaaaacagtgttttcctgagctgttgagaaatgtttaataaacattgatggagatccgggcatggtggctcacgcctgtaatcccagtaccttgggaggccaaggtgggccgatcacttgagcccaggagttggaaactagcctgaccaatatggtgagaccctgtctctacaaaaactacaaaaattaacagagcacggtggcacgcatctatggcctcagctacttgggagcctgaggctggagaatcacttgaacctgggaggaggaggttgcagtgagccaagatcacgccactgcactccagcctgggtgacagtgagaccctgtctcaaaaaacaaacaaacaaacaaacaaaaaaaccaaacacattgattgagtgaaggaatgacttagcaaatgaattggtgagaatgaaattgatgatattaaacttccatattgcctatggcaagacagtcccaggttttcttttttttttttttttcttgagatggagtcttgctctgtcactcaggctggagtgcagtggcgcgatctcgactcactgagatcacctccacctcccagtttcaagagattctcctgcctcagcctcctgagtagctgggattaaagatgcctaccaccacacctggctaatttttgtatttttagtagagacgggtttcaccatgttgtccaggctggtcttaaactcctgacctcaggtgatctgcctgcctcggactcccaaagtgctaggattacaggtgtgagccaccgtgcccggctagtcccaggttttcattcaacggccagggaataacaaactgctcctttccccaaggtgtggcaccctccgtggaagcctttgacaagctgatggacagtatggtggccgagtttttaaagaacagtaggatccttgctggggacgtggagacccatgtaagtactttcctcccctgttctcagtagagagtttaaacttaccagcccagcctctgacaacgctaacagcctgaggagatctttatttatttatttagtttttactctggctaggcagatggtggctaaaacattcatttacccatttattcatttaattgttcctgcaaggcctatggatagagtattgtccagcactgctctggaagctaggagcatggggatgaacaagataggctacatcctgttctcacagaacttccactttagtctgggaaacagatgatatatacaaatatataaatgaattcaggtagttttaagtacgaaaagaataagaaagcagagtcatgatttagagtgctggaaacagggctattgcttgagataggaaggtgtatctgaggtgacactgagcagagatctgatggagagaggtagtgagctgtggagtgatgtggggaagacagttccagacagagggaacagcaagagcgaaggctcagagcaagcttggtgtgttcccagcagaacagaaggcctgggaaaagataagggagaggggtaacaagggctcagagtacaacatgctcttctagtcacagtgagggactcggctctccttcccactgtgatgggaagccacccggggtcaccgggcagaggactcagggcgatttgatttatgcttttaaaaaggtcccctggctgagctgactcagtcaccagccacccttcttctttctgtaaaatgcggcctgaggatatcacctcatatccattgggatggctactatccaaagaacaggaattaacaagtactggttaggatggggagaaactggagcctctacgcactgttgatgggaatgtaaaatgatgcaggcactgtggaaaacagtgtgttggctcctcaaaaaaaaaaaaaaatggaactactgtagatccaacaatttcacttctatgtatatcccccaaatttaaaagcagcatctccaagagacacccatgttcatagcagcattattcacaatagccacgaggtggaagcaacccaagtgtgcattgacagatacactaaatgtggtctgtacatacaatggaatattattcagccttgaaaaggaaggaaatgctgttacatgctgtagtatggatgaaccttgaggacattatgctaagtgaaataagccagacacaaaaagacaaatactgtatgattccatttattggcagtgcctagggcggtcaaatttgtggagacaaagtagaatggtgtttgccagaggctggagggaggagagaataggaaattgttcaatgagtacagagtttcagttttccaagattaagaagttctggagattgtacaactatgtgaatatacttaacactattaagctgtacactgaaaatggttaagatggtaaattttatgttaagtatatcttactataattttgaacaaagtacagcctgaggaaaagcaaaaacacagaatttgataatctctgggttggaagagaactttaaaggtacctaagctagcctgccagttttagacacttttcatattttaaaaaatattagcatcatctccggggttagtcattgtttgcattcatttagtgaaaatcgaatgtgatagccaaaccaattaaaaacatgaaaagaaatgtatcactgggttcttctttttctttggcctttgtttctcactaaggattgaattccaaatctgtctacctatagatttctcagcaatgacagaatcctggcaaaaccattttcagtatagattcacagaaaatctgattcttgaataaagttgtggtttggggcttttcgcatattctcactcataggtgggaattgaacaatgagatcacatggacacaggaaggggaatatcacactctggggactgtggtgggatggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaagttaaaaaaagtataaagggattctctttttgctcccctcccaattagacatcatatgcaacacccaacaccagtctcccaggggatccagtgactccggttatgccagaggctccaagactgtaattaaataggtgcttatctcatcacattgcaatgtatttgtttgccacatctaagaaaaacaaagatacttctccatttctgttgaagtaccccttggtgaaagagacaagccttgatatatacgagttctggaaaaacctgggcactaagatgcatccacgtcaaatgtatcccacagcactattgttactactctagtctgtttttttcctcagtgtttttgtttacaagaaaccttgtatgcagcaagagagtggctgagcctcttgtattctgaggcgtgataactcctgaacgctaacatacacaaaggaatattatctgcaatacactgaaaaagatgcttgagtgattgatgaacattttctgtcttgaacactatgacagtaatcattgtatcattatggttactattcattaatgccaacattaggcttctgaggtacacagtacattataactcattaggagtatctcaaaaattctagatagaagctttttacaagagaataatgagacctataaataagtatatttaactttgcattttttaaaaaagtaagatttgtatgctgtcttcaaattgcacagtaaacagtccctttaagttctttttagaacagagtgagttataaagtgtagcttggttaatattaagtttttcatctcttcattcatcaggctgtaaacaggatgactcagatgaaggaatattctcagcaatgaatatgtaatgcttaagaaaatttatgttctccctagtttttaaaaaatagaggaaaggaaggaaaagaatagaagacagaaggaagaaaggcaagcaagaaagagagaaagaaagaaacacttgtcatctgaaagtttagactccagctctacaacacaaagaaaagtacaggcagctatagtccatctgcccatgacgttaatactttgaacatgccgtttattttttctctcgcttacagaaccatgtgtcattggcattaagcttgcagctgttgcctctcacatcagccagaagtgggggttgaactttattccaagaacacacctgttgcctaggaaaaaagccctcacatacctgattgtacaggatggaaatttgagagtgacacaaatgtgcatcatattaaatcctgtgcctgtgcttaaaagtcatttcacagataccagtaaggaataagggcagccaagctatgatttaacgtctgtctcgatgtgttggctgctggttgggcttaatttactgaacactcaatagcctattgacagaacagaccacaaaaaaggggatctaatagctacaattaggaatctctgctgaacctaagagcataacaggtttagaaaagattagaacttgtaaagccttcttgtgtgcagcctaaaccaaagggcttatttaaactactcttcaacccaagaaacttgacacagcttgcaccccttttaaaaaagaatagataattttatgcataattgcatacatgcatgattttataatagatattgggtaaatagagttctcaatgtcaaagaagcagatcctctagaaactgggcctatataatacctagcccttggttggacatcatttatccataaatagatttatgtgactttgggtttttttttttttttcgagacagagtcttgctctgttgcccaggcttgagtgcagtggcgtgatctgagctcactgcaacctccacctcccgggttcaagcgattctcctgtctcagcctcccaagtacctgggattacagccgcacgccactacgtctggctaatttttgtatttttcgtagagacggggttttaccatgttggccaggctggtcttgaactcctgacctcgtgatccacccgcctcagcctcccaaagtgctgggattataggcgtgagccactgcacccggccattaggggttattttttaacaaagttatcctattgttaggattcatggcggaactgatctcaggtctatttctaattgatgtgacaaataggaagcaactgcaaatcatagcttttcctaacccaagtcttttttagagatttctagaacttacattttaaatgtttgtaggaatctggaatctttatttcctgttcttgattgaaatggacttaaaaaactgctgttaccacatgctctcactaataagtgggagctaaacattgagaacacgtggtcacaaagaaggggacaatagacagtgggccaactggagggtggagggcagaagaagggtgaggatcagaaagtacctgtcaggtgctatgcttattacctgggcaatgaaataatctgtacaccaaacctccgcgacacaaaatttacctacataacaaacctgtatgtgtacccctgaacctaaactagaagtttaaaaaaagatatcgttaaaaaaaataatttttattaattatttaaaatgaaagaaccacaatttgaacaaaagggcaataaaattcaactaaacgtaacacacataaggcatactatgattaaatcacatgctgtataatgttctgtccttgagttctttgacttctataaaggatgaacatgatcagaaaattattacagcctcacttttgatgggtcatagtcactatgctagatattcctagtctttaccatttatttaaatcatctacaaaatagcttgctcactttgtgccatgctgttcagttaatgagttcaaagagtggcaaaatgagaagtctctcttcctctgactcacactggcagattgtattaatatttggatttagagtggccctgcttttgacagcatgaccttgagctagtcccttcatctgctccttaacgaggcaggatgacataatttctcagggcctctgtctctcaatagcccatgcacctgactcatcagttctctcagcctgaaagcatgagggagctattcggtttccaaatgaagagcttgcaatagggtggcctcatcaccattataaagagcatcttcagccatgccagggaagatgccctgagaaacaagcagaaggaaccatgtcagaaaaaggatacacagagcactaaagacaaaacatctttccactctcctgtggtatagatgaacatcagcctccttcatctgaaaggacccggaggcctctaccagtctgtgctttctggtcctacgagttgtcacatcttcctttacatgaatcttatctctgaaacatataataaccttatctctggaataaataatacagaatatctgcatgtttattttacggatggtatcttgtattctttcaattcttttgattcttgaaaatatttatggatcacctgtactcattttaaaagtgaccatttacatgtttggtgctttagaatctgtgtctatccaggatccccatcccaaaaaatcttatcagaagcaccactgtgaggctgactcagcaaaccagcccattccatgtcgttctcctcacctccccactctgccttcagccaacttgctcttcccatgaacttccagttttctgttcactgttttaatttgaacattaatttttattaccactagatgtggaatatcttggcaattgcaagcccgaagaatctgtatgtctttcagtttcaccaaatggcagagatccaaaaaatgacttgcatcaagaattctgcctctaggtttcatccaggctttaaatggggcatcttctttcttactggcttagccattaatgatagccagaatttttagagaaggaagcatttaaaagtcatctattccagttatccacccctccacccccttgcttgcttgcttgcttttcttctttttcttgcttctttcttcccttcctttcttctccctcttttctttcttttcctttctttccatttattttcatccttctttccttccctacttccttctctccttttgttttttccctctttttgtcttcctcccttccttccgtctccctttcctttgcttttattttcttttacttccttccttcccttctttttcctccctccctccctccctctctcccccctccctccctctctcccttccatccgtccatctatctgtctttctatcttctacagagaaggaaactgcaaattagagaggctaggtgatgtgcgtggtgtgttaaagatctcagcaatgcagtggcagagccaggaatctagtctccagagtctctgtctgtcaccttggcaggcacctactttaacctgcagtaggatggcctcatcaccattgtaaaaagcatcttcagccatgccagggaaaacaccatgagaagcaaacagaaggaaccatgtcagaaaaaggatttacagaacaccgaagataaaacatcttctcttcttgctctctccttgtggtatagacaaacatctgactccttcgtctaaaaggactgtaggcctccacgtttctgtgctttcaggtcctacaagttgtcatggcagctgtgtctcccaccacccttgtggtaattggctgactggtgagaagcaagaccgcactgacctgcctccttcctcactccctctttctagaagaggaggataggtctccatgaccaggcttaggcccagggcagaggagagggtggaaggctactgtgcctcttagtgaccaggagaatgctgcctccaggacagaactctgtccctctaggtcttcatttctgcgcctttgcactggcgtgggctcggcctgatcattactatgctgttggcaccaaatttgcagaattcagaaaagtcacagatagatcagcctctgttaccgtgtcttcccaagaacgtggagaagttttattctcagcgtagaacacatagtttgctaccaaacatgctttgattcacagcccatctcctgctaaatctcaggccttcattggacatccctgtgactccttttttacttaaagtttgtttctagagcatacaatcctcatctatctcactaaacatcctaatttcacaaacacacttagagctttggggaccggccagtaagaaactggacttggaatcaaaaccagacttcgaagggccaccaggcctgaccaaccacaggattgcccatttactctaccaatgaaaaaaatcaccaagataccttgctgaaacaacgagtcagattccatgagtctctaaggttaagatgataagatgatacctgccctttttctttttcctggacagcaaatatgctttctgccaaactcttgcttcaatgtttttctttctgcttttttagtaatttaatttcttttctttttttttctctttttttctttctttttttttttgagacagagtctcactctgttgcctaggctggagtgcagtggtgcaatctcagatcactgcaacctccgcctcccaggttcaagcaattggcctgccttagcctcctgagtagctgggactatagacccgcaccaccaagcccggctaatttttgtgtttttagtagagacggggtttcactctgttggccaggctggtctcgaattcctgacctcaagtgatccacctgcctcggcctcccaaagtgctgggattacaggcgtgagccactgcacctggcctgatttaattttttgagtaaatgtttgcatgggttaaaaaattgaagccaggaaaagcaccacgtgtactttgtgtagtaacgtgtactaatgtacgtgttcatcccatttccctccatacccctgaaggtgatgactttttaagtttcttatgtatccttccagtgtttgtttttgaaaatacatttattcttattttccttttattactaaacggtcacttcattatgtacactgcttcacaccttgttttcttcacttaacaatatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggctatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatatccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgtcacattagtgggtgcagcgcaccagcatggcacatgtatacatatgtaactaacctgcacaatgtgcacatgtaccctaaaacttagagtataataaaaaaaaaaaaaaaaaaaaaagaagtttacggataaaaaaaaaaaaaaacaaaaaaaaaacaatatattctagagatcttttctgtcagtccatctagagcttcttcactgttttttacggcttcaaaatactcctctgtgtagtttatcacagtttatttgaccagatccctgttgctggacattgggttgtttctaatcttttgttacagtgcataagcatgtattttctatatatacaagtatatctgaggataaattctccaaaatgggattccagggtgtatcagtcagggtcctggaaggatactcatggatagatcctgtgagtctctaaggttaagatgactaaactcttaatcttggcatggttaaactaaggaatctttctttctttctttctttccttccttccttccttccttccttccttccttccctccttccttccttcctttcttgatagagtctcactctgtcacccaggctggagcacagtcatgcgatttcggtcactgcaacctctgcctcctaggttcaagtgattctcctgcctcagcctcccaaataactgggattataggtgcgtgccacccttccagctaatttgttttttcttttgtgtttttagtagagacaaggttttaccatgttggccaggctggtcttgaactcctgacttcaagtggtccacccgccttggcctcccaaagtgctgggattataagcatgagccaccgcgcctggcccaaacaagggaatttgaggagagtttaataaagggactatttcgaaagctgtgagcaggcagtcaggaaacaagaaatcataaagtacccaggactgccaatcacaggaatcactgctaccccaaggtttggagaggaagagagagggaggcgggtatcagaaccttccgcagagagacacggccatgcaatggagaccagcaggaagaaccaggggaataaaggccaccttctgcttgtctcccttgctccagtctcctctcaagccttccactgactgaacccagtgagaatccaggagccaaggagcctgtggatgctgatgccatctatgtcaggggtccccatccctgttaggaaccaggctgcagagcaggaggtgagtggcaggcaggtgagcggccaaagcttcatctgtacttagagccactccccatcccttgcattactacctgagctctgccttctgtcagatcagtggcggcattagattctcagaggagcataaaccctatggtgaactgcgcattcgagggatctaggttttgtgctccttatgagaatctaatgccttatgatctgtcactgtctcccatcacccccagatgggactgtctagttacaggaaaataagctcagggctcccacagattctacattgtggtgagttgtataattatttcattatatattacaatataataatagaaataaagtgcacaataagtgtaatgcacttgagtcatccccaaaccatcctcctgctctgtctgtggaaaaattgtcttccatgaaattgacccttggtgccaaaaaggttggggaccactggtctagtggttggcctggagcacagagcagggtgcagcagggtagagagtgggtctagagcagcagaacagggataggcgggatgctgggtgaagggaagggcattgtgcttttgagatctgttgtaaattgccttccatggggatatgcctgttatactttcatcagcaatggatgagtgtgtctgtttccccaaactcacctacagagggggatgtcagtggagttttgccaatctgatgggtgacaaacagtatttctgtgtcgttttcaatttgtatttttcttatgatgagtgaggttgagcactttttcatatgtttaagggtcacaggctgggcgtggtggctcatgcctgtaatctcagcactttgggaggctgaggcgggaggatcatgaggtcaaaagatcaagaccagtctggccaacacggtgaaaccctgtctctactaaaaatacaaaaattagctgggcatggtggcacatgcctgtaatcccagctactcaggaggctgaggcaggagaatagcttgaatctgggaggtggagtttgcagtgaacagagatcacgccactgcactcggtccaacctgggcaacagagcacgactccgtctcaaagaaaaaagggtcacatatcacttttgctgtgagttgtttatgcatttctttagtccataggcgggagcaagaaagtcattggtttattattgatttgtagagaactttacatgttggggatattagcctctgtctgtggtgagagatacaaatatttttccccattgtcactatggcattatgactagattataacattgctggccaggcgtggtggctcaggcctgtaatcccagtgctttgggaggccaaggtgggcggatcacaaggtcaggagttcaagaccagcttggccaacatggtgaaaccccgtctctactaaaaatacaaaaattagctgggcgtggaggtgggtgcctgtaatcccagctactcgggaggctgaggcaggagaattgccccaacccaggaggtggaggttgcagtgggccgagatcgtgccactgcactccaacctgggcgaaagaacgagattccatctcgaaaaacaaacaaaaaaagaattgcttatgttggtttttttgtttgcttgtttgaccatccagaagtgtttttttttttttttttttttttgagacggaatctttgtctgttgcccaggctggagtgcagtggcacgatcctggctcactgcaagctctgcctctcaggttcatgccattctcctgtctcagcctcctgagtagctgggactacaggcgcccacaaccacgtccagctaatttttttgtatttttagtagagacggggtttcacagtgttagccaggatggtctcaatctcctgaccttgtgatccgcccacctcggcctcccaaagtgctgggattataggtgtgagccaccgcacccggcccagaagtttttttatgtagtagaatttattataaacatatcttttttttttatggcttctagaatgtgagttgtcatttaaaaggctttttctgccgggcgcggtggctcacgcctataatcccagcactttgggaggccaaggtgggcagatgacgatgtcaggagttcaagaccagcctgaccaacatggtgaaaccccgtctctactaaaaacacaaaaattagccgggcgtggtagtgcacacctgtaatcccagctacttgggaggctggggcaggagaatcgcttgaacccaggagccggaggttgcaatgaatcaagattgtgccattgcactccagcctgggctacagagcgagactctgtcttaaaaaaataaagagagagagaaaaaagagagagagaaaaaaaaggctttttcttctaacactttcatggctttatttttgacacataaatttgatccacatttgagtttatcttggtgaatgacgttaaggcatggatccaactgttttttttttttccagataggttcctgcagttcccatcactatcattaatcagtccatttcccccatggatcgaaatgctgcctttatcacatgctaaacacctgtatatcttcaggtctgtttttggactttctgttcattccattgtgctgttcatgtctcagttccaactgctttagtcactgaggatttagagcagcagtagtcaacctttttggcaccagggaccgatttcctggaaaacagtttttctgtggaccggggagagggattgcactttatttctattgttattatatactcatcagaagatagaatcagtgagagccctgagcttattttcctgcaactagacggtcccatttaggggtaatgggagacagtgacagatcatcaggcattatattctcgtaaggagcacacaacctagatccctcgcgtgcagtgttcacaatagggttcatgctcctatgagaatctaatgccattgctgatctcacaggtggtggagctcgggcggtaatgcaagcgatggggagtggctataaatatagacgaagctccagtcacttgcttgctggcttgctcactgctcacctcctgctgtgcaccccacttcctaacaggccatggaccagtaccagtctgtgtgtcctgggggttggggacccctgattcagagtatgtttcatgtgtaatagagttaattccccccatgggtcttcctatccagagttctcctggatggtcttgcttgtctttgcctttttatttaaaatcagcttgtctgtttccagaagaaaaatgttggagtttttattggaatcggttaaaattataagttagtattaaaatgttcacatgtgtgtgatgttgagtcttcctctccaaaaccaggatatgtctctccattgattcaagtccacttttgtatccttcaggagtaggattaagtttttctgcagagttttggcatgattcttgagtttattttggaggacaggggctgttatttttagtaaatgggctaattttgtctgtgtatttttgaattggttgttcgtatatgtgaaagctgctgatttctgtgtgttaatttgtgtctggctacctttctgaagttcacttttgttgttgtttattggagcttttcagttgattattcagcactttttcagtatatagttatttgcaagtagtaattactgacctcttcctttttatacctttcatgtctttttatttactattacctttaagacagtattttaaaaatgttgacagaggcttatcttttagcaggaatgtcagcccattaagtatgatgcttgttttgggctgaaaacaaactgtgtgtgtgtgtgtgtgtgtgtgtgtgtgtgtgtgtgtggtcattttaatgttcaattctgtatctcccatttttttattatactttaagttctagggtacatgtgcacaacgtgcaggtttgttacatatgtactcatgtgccgtgttggtttgctgcacccattaactcgtcatttatattacgtatttctcctaatgctatccctcccacatccccccaccccatgacaggccctagtgtgtgatgttccccgccctgtgtccaagtgttctgtttgttcagttcccacctatgagtgagaacatgcaatgtttagttttctgtccttgcaatagtttgctcagaatgatggtttccagcttcatccgtgtcgctacaaaggacatgaactcatccttttttatggctgcatagtattccatggtgtctcccatttttaagcaagaagattgttgaatttttttcaaaggtctttttcagcatctatagatgctaaaaatataacttttcttcttagatcttttaataaattacattaatatattagtatttcttcatattgagtcattcttatattttaggaggctatttagttatatcgaagtgaccattctaaactttatctcatgtttctttcaagatgtttaaggaatttcacagtggcaaagagaaatacgaaattttctgagttatgtaaactaatttgttcaaggaaaacatgctgcctttgaaaaatccttatgtactttcaagctttattattaatatattattaaatatcaagtgcattttaaaatactttttaaatcttaagaccattgtatgtacacagtacataggcttatttcagatcctctgtccaaatgaaaacaaaattgtcgtttttactttgagacagggtctcactcctttcgcccaggctggagtgcagtagcaagatcaaggctcactgcagcctcaacttcctggggtcaggtgattctcccacctcagcctcctgaatagctgggactacaggtgcacaccaccacgctcagctaatttttcatatttttagtagagacagcgtttcaccatgttgctcaggctggtcttgaactcctaggctcaagcaatcctcccaccttggccccccaaagtgttgggattacaggagcgagccacggtgcctggccttaaaaatatacatttcctatcatagattcatagttaaactacagccaacagatttgaaatgtgtaactgttgaaaacaaaagttcaaagtaactttaaaatgcatttttttctgttatgtacgtaacctacacttttcaaatttaaaattaaaaaaaaaacagcaacaataacgtgtaggaattgtaatgaactcttgttgcgttcacttctttgcataactcgttattgcctgtacaaacaaattaagcaggaagaggaagaacctccacaatgacattagcctttcctggcctgttttcagtagttggtactttaggggcaattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttgaccatgaacttagtgtgcagctgtggatggggttcttaattctctgggtctttgaatctgcacatgatgatgttcgccgccaggaaacctgtggagcacctgccctgattcttcctttctgttctgtgttcgctgacataagcaaaacggaacagacaacatgtgcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccaagtggggggaattgcttgaggccaggagttcaagaccagcctaagcaatatagtgagaccccatcactattttttttttttgagacagaatatcactctttcacccaggctggagtgcagtggcagcatcttggcttactgcaacctcttcctcctgggttcaagcgatcctcgtgcctcagcctcccgagtagctggaactacagatgtgcgccaccatgccaggctaatttttctgcgtttagtagagatggagtttcaccatgttgaccaggctggtctcaaactcctgacctcaagtaatccaccgcctcgacctcccaaagtgctgggattacaggcatgagccactggccccggctggccccatcactattaaaaaaataaaactcttgagagtaaccagcaactttcttcctaacattttctcctcaaaaataccctttcattagctgagcatggtggcacgcacctgtagccctggcttctcgggagactgaagcgggaggatcattttagcccaggagttctaggctgcagtgggccactatcacggtattgcactccagcctgggtgacagaggaggctctgtcctaaaaaaagaagaaaaaaatatgcttttagaggattgtttccaatgtcctgaattaatcatgttactgaatactgcagaatatatgttctttgtcttgcctcttgccttgacgcctcttttccctacttgccgtctttctaaaactgtgcccataattggaaatttgttgttgttttctatctagacttcgagataactctgttgtttgcctggaggctgcttcagcaatacttttgtacaaaaggaatgacctctttacatactgatttcgtttagcttatcttgttatttctattcatgcacccattcccacaaaacacacagacacacacacacacacacacgtgcgcacgtgcactccctccactcatctatgaattcctcatgatattgtattggctacatgtaagaaaaaacagtctcagtcaaatgtatgggcacactggctgaagcatcactctgattctagggaatgtgtttgcagatttattatattactatgcataaagcaagtacaaaatatgttttccaaccttcagtatttttttccttttctggttgtctttacattgtggtttaacactgttagttttaaaacatgccagattttacatacacacacatatgttataacatattacacaccaagtctttttcatgtatcaaatataagatgttttagtgatgtaaaagagaactcacatgtgtttgcaatacaaatcctttcccttttagaaaacccttttaaaaaaatattttaaatagtgaggtacttggaatgctgatacttgactttcaattgctttagttaaaacaaattcatatacaggtaaagtagcatgatttataactttgggcccacctgttgagagttggggtttattacaaggttccagaattatgctcttttcttccagccctgtctctgtctagcactgtgcccataatagctagtaagtgttttctaaatacataagtgaaaacaagtatttaaatggatgaatcaaattattaaggaagaatggaatcaatggacagatgaatttactgtggcggacagcttgaatcaagccaaacctagaccagtagttaaaaaacaaatcatcagctaggcgtggtggctcacgcctgtaatcccagcattttgggaggccgaggcaggcagatcacgaggtcaagagatagagaccatcctggccaacatggtgaaacttggtttctactaaaaatacaaaaattaactgggtgtggtggcatgctaggacctgtagacccagctactcgagaggctggggcaggagaatcgcttgattccggaaggcagaggttgcagtgagccgagatcgcgccactgcactccagcctggcgacagagcaagactctgtctcaaaaaaaaaaaaaaaaaaagtcatcatggcccaggttttaagtcatgaaattagcaagtgaaatattgagaaacatagactattatcaacacctgtgaaaagaaggggaaaaatacgtagactattagattgccatgtctctgtagatttttgtttctctctctccacacacacacacacacacacacacacacacacacacacaacacgagtcctgattttatcacagctgtgacagtttatccagtacccgcctcattcccttcattctcgttgctcttttgtagttgaggaaagtgagccattgaaagactggggctctgaggcaatataagaaagtgagactaagatacataagtaacctgaaaattcaccaatatattgacttataatcactgacaatagaaacacctttagctccacctgagacaagatatttatgtgaaccttactgtaagtattttatcttattatttatctatttggagacagagccttactccgccacccaggctggagtgcagtggcacaatctcagctcactgcaacctccacctcccaggttcaagcaattctcctgcctcagcctcctaagtagctgagattacaggcatgtgccaccacacccagctagtttttgtatttttagtagagagggggtttcaccacgttggccaggctggtcttgaactcctgacctcaggtgatccacccatctcggcctccgaaagtgcttggattgtaggcgtgagccaccacgcctggcctctataaatattttaaactgaaggtcaggttaagaaatagaatttcgtttggttttccagtttggattgggttgtggcatgttgcttccccctcaattgttttcaaaatgatagcgatcgggcaagaaatgactttggagtctgaaagggtaagttgggaaattaaacttttggtggggactttactgtgtatttctaataatcaaatctccctggtttcaagagtctttgaccgtatttatatcattgtaaacatctggatggaaagtgaaaaattcagttgattatctcaatatatacaaatacaggcagtcccaaacttctcagtgagatcccctctccccaaagctcatttgtaaattatttcttagaaacttggaagacattctcccatagacatttcccatagaccatgggtggttgggctcccatggaaagatatcgaacagcaccgccgcacgtgctgtgcacagaggctgcagctcgaaaactattcactaacggtttgtaccatgagataagtacagaaattatgcgttacactttgaaaacttgtatagcagtgcaacagaggaattgtctgctaaatctagtaattgaaataacttagacttgtactatacttcgtatttcagtttttttaatttcatttttctagtactgcatttttacttattttacaaaggtatcagtctgtgatagatgagacattatgaagaaaaaccttccctataggttactgagcagtacttacataatgcaaaatactaaaacatttattttaccatgcttttagttaaatgagacaagaaaacaataacatgaaatgaaaaatagtcatctgttatgaatgctgacacctaggggaatgtgagtttaattagagaaagtcaaagacataaatagggatttctatgtgtattttcagctgactttgggtctgattcctttctactttagataccaaacaagatttttcttttttctttatatgagtatatagttatgctgctttggtgcttagcaaccattattggggttaccttggaattcacgagtgggacaaaaagacaggaaaagagattttctgaggataaccgagtaggaattgaaagaaagaagagtagggaggtggcatatgcacttaagagagatttgtcttgttaaaaataaattctggagggatattcattgaattactgacggtggtcacccttgtggggtgggattattgagtgtttttacagtttaaacatccatgtcttttgaactttttacaacaagcatgtgttgctgttatcatcagaagaggggaaaaggaatatttggtgctagaataaaaatgcttggaatcaagatactgcctgaaaggcagttcatctagcagcaaaaaacaaagtaaagagaaaatgtgggcatcagctggtgtgaccaatcctgcacagcttggctgcagggcaccctagtggtcaggggtcccagctgcctgggaatccacggggaatgaggaaccagtgtttagcaagcacctttcatggttgagcggtcatagtgagttctcaatgcaggtgagttaatattgggtggacctggttcatgaatgaccaaatctggttcttagctttttaatttaagaggcagagtctccctctgtcacccaggctggagtgtggtggcatgatcatagttcactgcagcctcaaactcctgggctcaagagatcctcccacctcagtctcccaagtaactgcgaccacaggcagctaattaaaaaaaaaaaaaaaaaagtttgtagagacagggggatctcactatgtttcccatactggtattgaactcctggtctcaagcagtcctcccaccatggcctcccaaaatactggcattagagatttgagccatcgtgactggcccttagctaaattttacagtcactagagattaactttcttttcttgccttattttcgttttccatattagtaagagaggcaattttttaaaaggggaaggaaaactagtatttgtggagggtctgctaggtatcaggccctgggcacagctatcaacaaacattacttccttaatcattaggagaactttgtttttctgagacggagtcttgctctgtcgctcaggctggagtgcagtggcgtgatcttggctcactgcaacctccaccacctgggttcaagcaattgtcctgccccagcctccggcgtagctgggattacaggcactcgccatcatgcctggctaacttttgtatttttgaagagactgggtttcaccatgttggccaggctggtcttgaacttctgacctcaggtgatccacctgccttagcctcccaaagtgctgggattacaggcttgagctaccacacctggccaagagtttttaatgtatctttcgaggtaatgaaaccatgcctcagaaaggttgggtaagttgggaatggctatgtgtgtagtaaggggtagagttgaattcgatcccaggcctatctgaagttcatgcttgtggtttctctactacatcacactgctttacagtaatttcagtccttcattattaagcagtaattactgagcttctgttgtaacaaaggcccttctatataggcacctactggcttagtcctctggaatatatcttctatgtggggccacaaggcatgtatacatgcatgaaagcttggataagaatatgacttaaataacacaaaatgaaaggataatgccgtaatgcttagtgtcacagtggattctaatataaggagtaccttgttgtctctgatttttctgagcggccttagtagccaagtgtcctttatttgtgaaaacccaagattcatcaaccatgaaggatttgctggttctctaagtcaaaagatttggcttaaatatgttgataaagtgcttcagattccttaagtgatagaaaaacaagttagagaatttggagaggagccaatctgccaagtggtttgtggctatacagtgattgaatttgaaaatgcagtttattcaggagaatggttttgttcagaatataaacttctaacaatattcatgcctgtcagaaaagcaaatggatttgaacatgcaatggtgttttctttcttttcctattcccatactgttttaaattctttccagtctttgatcttttaaaatataaattgcaataataaattatttagaagagttcagtgttgggctttttaagttacaatgattggtcttacattatagattttgcagacttttctgcacatactgtttctgtaacctgcttatttaacttagaccatgtcttctgggtctctttccatgtcaatgagttgaagtctacattatctttttttttttttgagacaaagtcactctgttgcccaggctggactgcaggggtgcgatctcagctcactgcaacctccgtttcccaggttcaagagattctcctgcctcagccttccgaggacctgggattacagacacccaccaccacgccaggctaatttttgtatgtttagtaaagacagggtttcactatgttggccaggctggtctcgaactcctgacctcaagtgatccacccgccttgggctcccaaagtgttgggattacaggcgtgagccacagcgcccggcctacgtcatcatttttaatgactgtatagtatttcttcacgtgttacaccgtaattgattcaaacaatcaaaattatatgtagatgaagtaatgtatgtatgagaatttagggcttggactaaggtgacacaagtgaacattgcagggtgtgacctaaagagagagcacctcttaaattccataccatgggctccttgctagctctaccctggtcctatccctgcaaggatggttatctagtagtatttataatcatttaaaaaattagtgtcatttgacttgttttcagttttgaccctattgtaaaccaaattgcagttaaaagccttgtgcaattattttattattattattttttttttgagacacagtttcattcttgttgcccaggctggagtgcaatggtgccatctcagctcactgcaacctccgcctcttgggttcaagtgattctcgtgcctcagcctcccagctagctgggattacaggtgcccaccaccatgcttggctaattttttgtattttttagtagaggcggggtttcgccatgttgaccaggctggtctgaaactcctgacctcaggtgatccacccacctcggcctcccaaagtgttgggattacaagcatgagccaccatgcccggccaattattttatagttatataattattttctcaaggaaaattcctacaattagaaattcctggccaatggcaagtggtccctaatatttattgccaaattattctcccacatatatgttgtactgattcatactctcacagtgtcttaaatgctttaggctatttggtgataattatgaactaggaaaataagagttttagggaaatggtgcatgatttgaatgcacattaatattcatgacattgattgtttaaaaatactttgccgtctgctgaacaagcaggaaaataaaaacaacccacagaaatcatcctttttgcaaaagaaaaccatttatcagttctaccttttttttttttttaagactgggtcttgctctgtcacccaggctggagtgcagtggcacgatctcggctcactgcaagctccgcctcccaggttcacgccattctcctgcctcagcctcccgagtagctgggactacaggcgcccaccaccacagccggcaaatttttggtatttttagtagagacggggtttcaccattttagccaggatggtctctatctcctgacctcatgatccgcctgtctcggcccccaaagtgctggaaatacaggcgtgagccaccacgcccggctccaattctgcctttgatctatttgatgtaccaagaaatttgtttaaattgcctctttggggttggatatgacatattttggatggggttggtggggcattgaggtcaccttaactgaaaccagtaatgcagctgaaatgtatgatagaagattctaggtctggatgtagaaaagacacattggagctgtttcttattgtcagagctgtgcactgatgtaaatacttttgtgagctggaggttgccagggcaacagtcctattaatgaagaataaacctcatttattatcagtgccagaataattattttttaaataaatgtacccagtggtctaacactgacattctcaatctacctactcatctttccttcccagattgcaaaactatttagccttattcaataagcatgcctcctttctccgccaatgagagtaaaatcattgaaaaaaatcagtaaaatgtaagggcattaaaaatgctaatttttaacaattacctaatataaaattattgcccttttgatttgtgctttggctaaggtagagcctgaaatcaactgtgatttggttggtatttgagcaggccagagtctttaaattaacttgtctttacgatttaatggaatattgccaacatattcgttaagtaagtggagtgtgacattactgcttccttcctcccatcagactgtaaatttagactccgttttattgtgcacacatggacacttcagaaaggcagctgtggctgagttgtagcctttattaaatctcttgtcttgaggagcccgagaattgtgttaagggagacagtggttccaaatgactgaggaccaagcagggtacgttctggattttagaggaaaggaaatcttctatccaaaaaaaaaaaataataataataacatttcccttttcattttcttttttgtgaaaatgtttcttgtgttttgtcaagctgagcaaatgggaaaacttaccttttcaaccatgggtcatatcaacaaacctcctgtccaggttgggtgtttgctgtctgctccacacagttcacaccttatcacttgttactcacatgcactaatgattctgtgttcctgtcttgtttcccctgatttatatctaatttagcatctcagcacatagtaggtattcagaaaatactttttttttttttgagacagagtctcgctctgtcacccaggctggagtgcagtggtgtgatctctggtcactgcaacttccgcctcccgggttcaagcgattctcctgcctcagcctctcgagtagctgggattacaggaacccgccaccacgctcagctaatttttgtatttttagtagagacggggtttctccatattgaccaggctgctctcaaactcctgaccgcaggtgatccaccagcctcagcatccctaagtgctgggattacaggcgtgagccaccacgccctgcccagaaaatactttttgattataaaattgtgtaataagtttctgtttcactcaggtcttttcaatagatttttttctgataatgaaaaaaaatgtttgacataggaaaaatagacaatccatatttgaaaaagagaacaaaaaccattcagaatcccactacttgaaggtaacttccactgataccatggcatgtttatttcataaggacattatttgaaagtctaaaaaacccaatcattgtacagtctgttttctccttgatacgatagaatcacaacgtaatctgtgctgactgtgtgtgtagggcaagtggcacctgccaagccctagcagggtataggtatttcagatgagatattaaaatgccgactaatgatgggaccagtcacagaccaagaaaagctggcccttctgtctcaccatggcaatttcagattcaaccacaaatagcaggcaatctgatttctcatttcttaactcttcgcgttagactgtgttactgacaaaacagattttaccctcagaataagttttcgcacaagcagacgtatatgtttctttgtcgatggcacttctggcttacttctttgtgccacttcctaatggcacactgggaagagagtaatttcccaaacttatcaggcaaaataggaaaaagtccatgggaacccaacaagtcatagcaaagaaacattccgtacttctttattttattcttggctatgacagcacaaagggggcagtttggatgttggtttaatgccccactccatctctatgacacctccaaccatccccaaataaatatgctaaaaataacaataataagcacaaagaataaaatcgtatgtagttagtataagcatctttagaggactttgctatttttcataagcagaagcaatccaagtaaaacagcgcacttatcagagagtttcttagtgacttcccatatcacagtttcactgtcctttcccccagataactgtctctgagcccctctcacataagtatttatcacactcaccctcacctcacccgtagtctccctacatatgtcagttcatggggagatgaactggaatggaagttccataacattgcctgaataagtcctttctagttttaaaaaaaagtggaggagggggccacatattttaactcacaggactgatagcaaaagttgggaagatacagggatgttatggtttctccatcaactacttataaatcaacattggttgggtttaacttttaataatttatactccgttcaaatcctcaccatgttgttccattcattcttccatctgctcagcagatcttgagcacctgttgtgtggcaggcaatgggcagggtggaaactgagatttgaaggtgaggtgggactttgaagtagagacttggaagaatgctagagggagcagactaggacaaaaccaatgatggcatggaacactactgatgactttgtagaacttctctattgaggtctagatggtgtagactaaggaactgcctttttcctgcctttccattattgatttgttgcatgattggtatcacttggaactgtgtatcgggaaaagacaaatgcctatgaaatccatctgcgtcttgtttttgaggatggtcatatgccccatctgttgttctttgagccctcaccagtaaagtcagctcccgtaattaattttcagtcacgttgccttgaccacagtgaacggaatccttatcaaacggttaatacatgtaagttgtctgctatatgcaaaaccccatgctaggctcagcagaggatacagaagaagggaacaggaaatcttggctctttagggatggagagtgtcattgaggaagcagtgaagacactattcccacaaagttaacccacagtggtaattagtacgggattagggagagggcagtaggctcaggtcagtagacccaactctaatcctacatttgtccaccaatcttgggaaattcactaacctctccaggtcttgattgcttttttggagaggcggagacctgtctctgggtaaataaatatatttattgtcccagggctctttctctttttattcttttttttttttttttttccttgcccaggctggattgccatggcgtgatcacggctcactgcagcctcagcctcctgggctcaagcaaccctcccacctcagcctcccacctcagcctcccacctcagcctcccgagtagctggaaccacaggcaggtgccaccatgcctggctaattttttaatttttatagagacagggttttaccatgttgcccaggctggtctcaaactcctgggctgaagagatccacccacctcagcttcccaaagtactgggattacgggcatgagccactgcgtccggctcagggctccttcaagcagatccctgggatgcatgggagaccaccgtgactggagcagagggtacttggagaggagtcgtggccgtgacgctagaagatgagggtccagttgtacagggctttggaggccaggcaaaattctagactcatccaagccttttataagaaatgagagctcttgaagtgattataaaaacataagtgtccaggcgctggctgagtagggatgtgatgaggcattctgtcctcggcctgcagcctctgctcccaaacaccattagcacatttttaccctggggtcttgttttctttcctttcactcttcttttgtaatctcccattatcatggctgccctgtgctcagcagagaggcaaagtgctcatgtggcttctttataaatacttttgggtggtgatagttcccatgactggcttaactctgctcacttgtcttcttccattaggtaagtggtagtagctctgaagtcagtcttgctgatatgtttcaaaagaacattggcttgacgcaattatatccagctctcatgatctgcattgttttcattttcttttgccaaacttttccgttttctatgcttcaagtctctctctgggcaataaaagagaacttggaaagaatcaggatttaggaattcttgcttcagctttgacacttgggcagagagctttattttttctagacattcatcccgtcacttaaaaaaaatgcaaggattgaacgaaatgagccccttcggatggtatgagtgcatggttttgttacagtaggttgttagtcagacatgagcagggcaggagagcccccgctccaggaatgtcaggccaccatcaagtgatggtccagaggttgttaactgtctcgctaaaataataattggtctcagctggcaccaaggaacggcaatctcccaataaataggaaaaacctgaaactagtgataaggccctgataagatctaagcttataaggagactcaagcatgagcactaagaggcaaaatggtggagtttaactggtatatgaccttcctctaggaatgctctactggtaaggaaaaaaaaaaatgcctcaagcgagcatgcgcacaacttaaattacacactgtgtgtggtccctcccaagggctggcaggtgtgcatatggacagcccaccccgagggaagaatcaggagaagagatacagacccaggaagaatgctaacatgtagaaccccaaatcaaagggcagatcacacacttgaaactctcaagtcacccgcttggccctcttccaagtgtactttacctcctttcattcctgctctaaacttttttttttttttgagacagagtctcgctctgtcgcccaggctggagtgcagtggtgcaatctcagctcactgcactctccgcctcccgggttcatgctgttctcctgcctcagcctcccaagcagctgggactacaggcgcccaccaccatgcccggctaattttttgtatttttagtagagatggggtttcaccatattagccagaatggtcttgatctcctgaccttgtgatctgccctcctcggcctcccaaagtgctgggattacaggcgtgagccaccgcgcccagcctaaactttttaataaactttccctcctgctctcaaacttgcctcagtgtctctctctgcctgtgcccctcggttgaattctttcttatgaggaagcaagaactgtgtggttgctgctgacttgtacagatttgctgctgctaacagttttgtagtggatggcctctgagctgttttgttaattcatctgctaatgaaaatggaatagaaacgaaagacagaatatatgaggtatcatttaggccagtggttttgaaagtgcagtgtccagacttgaagcatcagcctcacctgagaacttgtagaaatgcgaattctcgggccaacccaaatctaccgaatcagaaactccggagatgcgactcaacaatcagttttaagaaagcctccagttgattctgatggacacacagaaccactgattcaagccttctgcgaggtgcataatatgtcaactcagatatctttcttattctgaaaagatacagaaacggggttggtgcttatgttcatgtttacaaaatcaagcatcttcagtcttgttttaagcaaaatcatgaaatgggtgaaatttgtctttagcattctattacctctttttggggctcatttcttgtctcaatttcatctgtcaggttcttctttacctcttcattggcagaaactctagggacttttcctttagggtagagtagaggaccctaaacaacaaatctgaaaacacagtgtctctaattatgaaaaacagggcatcagtagaccaactggggaggtatgtgaggatggcattggcagtagggcctgcaaattgcactgagtacacagatgcccattcttccatctttagaggaagaggggccccttccctttgctgtctggttctcaagaagagggctgatgcagtttcagaaggatctggaaatgcctttagcacaagcatccagggtggatgcttttgccatcttccaagtattgcctgtggcctttccccccgttgtgcctgttcattttgccatccacatgggactttgcagcctgtagtgcttccagtgaaacaatgcaaagctttgatgagtatccagaaatcaactgggcttccctagggagccagctgtctttcctgaggggattagatggaaataagtcatatttcactagtgtctgctggctcccaaggatggttttaaactgatttctgaaattcattcccctgttcttcatcctaagaccacacggcaatagatgttccaccagcctatctgagaaccccggttgctggtgtgataactgataaagttcaaacagaatgcacagacttgactttgtcaaaattatccctttcctctctgcacacacatgctcacaggcagatagatgcacatgttcacccacaaaggttgcccaggctttctgagccctgcacacatgtgatggacaaactcagcaaaacccctcgattatttgtcgttactgaaaacccctacgtttggctttttctttcacagtgttttgaactgcctgagtgagccaaattctccctttgaagttaccagactcagcaggttcggtaaaattgctcctaaataggatgctgtctggttgaagggactcatggaactttccagaaggaagaagcaagaggatcggaagttggaatgaaagtcctttgacatgtcgaccgataaggttaaaaacgaatgtagattagagtctgctaattatgcccagagttccaggaagctgaaagaagtacacagtcaaattctcagaaaggttttgtctacataagcaaaatggaagggagagttgaagcagatatctcaatattgggccattctccaccccaacctcaacttctattgttcccatgaaacaccatttggaggaagagactaattaatgaaattggccatctttgctcatcagacctgccagaaaattgctctattagcaacaggctaaatgttgttactagagaaagtaaaaaggctaatgatcatgctcatcttgggataactacaaaaatattgttaatgccacctctgagctacaattttaactgcagaagtcagaccatctgaattactgtttccacagcaactacaattcagtcggctctgcaaggcttgtcatagatgaggacgttacctctatattatcgttgctggggaaaagtgcacttattttatttatagccaagctgtgcaaagttgtattttgtagtcttttatttggaaatgtggtcattagagaccgacaaaagtccttctgaatcactgaaatatatgttttgatacaaggaaaaatactgcatagctcagagcttcccattcataatgtcataatggcctccagggcagtgagatttgaaagccctctattcttccctaatgaatattcaaaatttgagatcttgagcagtatatcccagcaatcaggctaccaggataaagagaaagaagatggtgtactccaaaatggctttgagaaaaacatacactaatttaaacagtcaagagacttatatctgttgtgttaatgatgattgaatttgtgattttaaatgtaaatagtctacaaatcttggtttgatttcaagcattttcttctcagtgggaaaaaatacccttggatgagaagtgacaaggaatgttagaaacaagaataaggtgttcgttcatttcatttatgttttggaacatttgtcagatgccaaaacgttaatacgaagtggtttgacaaaaactagtcattttccagttaacacatgtaccttacagaaaattatctgatattgacacggggatgaaattaacctaatcctcctgttattttgttgttttggtatctgtttttgaaaatgtattaagctagttcttgcctatttactagagaagtcagtcacatccaagattgcagagagatagaaactgcccataaacagatgtggagctaaaaagaaggagattaaaaatgaaattatgtatagaagaatataaactcatgaccaaataaaaccgaatcacagaatttttccctccccacaaaggagcaaaaaaaaaaaaaaagaaagaattaaagaaaaacacctcactagtagtaagcaaacaaaaaacccataacctaaagcaatacattttagtaactggtggctgagtggcttttgatttctaaccctgtccccaaaacgccttaaagacattccttaggggaaacgaaatcaggaaaggagaatatgaagcaagaaaaaaacaccatggactgcttctgtttatagatgtaaagccctcatgtctaggttttgaatcagagaaatgatctaaagtcggaagggaccactccatccgaatggcatgtgttccaagaatggggagtgaatcctggtttggggcatttagcaaattcccagaagaatgagcagcacttgaagacacaaataaagactggacatcacctcagccaaattcttcctctccctgttctagcaggccttaaagaatagagagcagaaagcatttagcccccagattctggcttgaaagggcaaagaagctgatctccaatatgatggcaaggaatcacccacattttatcagaaaaattaaaatatgtgcaagatggaaagagccaatgtggcagctacaagtaatgtgtcagaaaggaggctagcatgcaaagtagaaagacaggggcttacccttgaagaaaatagtatttaaggaacagaaacaggttcctcaataagaagataacttgtactcttagaatttaacaagattataaaaagtatttttaaaatagcctaaagacaaggtgataaaacaagaatgaaatgaaaaaggaaatttaaagtctgacaaatcaagaattaaatacattaatgcaaaaaagatatgtaaattagaaatgataacatatatgagacctgttgaaaatttgtttactaacaatagaaaaagtattcttataatcacagagaatgcagataacaaacaaggagattaaagacagagagactctaaaagatattaagacattcaaatattctacactatgaggataataattgggtccctgaatagagactctaacaaaaggaacagaagagacactgaaagatgtgataaaatttcccagaaatgaagaaaggactaaacctattccaggaaatatactatggaatgttcaaaacgcaaacatatcttagtgaagctattaaacctcaaggataaagaaataattcttgagatatcaaatcagaataagtcaatttcctacaagggagaaaaaaatcaagctagtctcagatgtcaccattgccacatctggggccacgctctctgaaaatggagagagaaagtgacccaaggatattatatcccatcaagatcttgttaaaatataaagacaacagggagacgtgcttcaacctgaaagaactaaaaaacaactgagagcttgttgaagaaaatacacaataatgaatgcctggccagttaaaaaaaaataaaattaactcagaaacggagaagttatgatgagaatcattaggtttgcataaatgcagaactaatacttaacaactgtgtacactaatactacagattgaatattattgctatcagtttggagaaaataaaaataataactaaaaaccatggaagatagggatcagagatggaaaaagtgtaagtacttatgttctcatctttcccagcaagaagtcagtcaatactatctagaattataacatgtcattttagagtgcaaatacataattatcccagtctcaacattttataatcttttttttaaccttagaatgatcttttaggacataaaaactattatggtgcagaaacttttctttgaagtttaacagttctttttcatttacatctctacgattcaatcataactaaaatgtatgctttttaagtctctctgcatatattcttaaaaggaggttacaatgatgttcatttaatgattatttctaggttgtgaggcattattttaaaactctaatctttgctgggtgtggtggctcatgcctgtaatcccagcactttgggagaccaagacaggaggatcgcttgagcacaagagtttgagaccagcctggacaacatagcaagaacttacctctactaaaaaatttaaaagttagccgagtgtggtggtgtgcgcctgtggccccaactactcaggaggctgaggcaggaggattgcttgagcccaagagttggaggcttccgtgaaccaagattgcaccactgcactgcagcctgggtgacagagtgagaccatgtctctaaaacaaacagacaaaaaaagaaaaacaaacaaaacaacaaaaaaaaaaaccctgtaatctttgaaacctttttttttttctttttttgagacgtagtctccctctgtcacccagtctgaagtctgaagcgcagtagcacaatctcggctcactgcagcctctgccacccaagttcacatgattctcctgcctcagcctcccaaatagctgggactacaggcatgcaccaccatgcatgggtaatttttgtgtttttagtagagacagggtttcaccatgttggccaatctggtcttgaactgctgacctcaggtgatccacccactttggcctcccaaagtgctgagattacaggcatgagccgccatgccttgcctaatctttgaaactttctgcatttaaaaaaaaactattccaagtcagtatgctttatcttacaagaataactgcatgaattttcttaaaaactagaaaaaaatgccaaaatggttaatcctgggtgatctggatattttttcttggtacacttctgtaatttttttaatttaaaaaattaacaaggccaggcgtggtggctcacacctgtgatcccagcactttgggaggccaaggtgggcggatcatgaggtcaggagatcgagaccatcctggcgaacactgtgaaaccccgtctctactaaaaatacaaaaaaattagccaggcgtggtggcgggcgcctgtagtcccagctactcggggggctgaggcaggagaatggcatgaacctggggggcggagcttgcagtgagctgagatcgcaccattgcactccagcctgggcaacagggcgagactccgtctcaaaaaaaaaaaaaaaaaaaaaaaaaaaaaaattaacataacaaaaaaagaaaaaagaaccaaaaaaacccacaaaaattaacaaattagttgaatgagtcaagggtgaaggtaagagaatatgtgtttgaggccattcctgcttacacgtctccttgtggggtgttgagtccaggtggggccccctctaccagggcccaaatggcactgacatctctcctgggcccatcttaatgattagaagccactggctttcagtgagcatatctaaatggtgatggcttaagggacaattctctttcctctagaaggtgtagaatagaatgtgggcacagtgtgaaagagggtaagagagagacaggctttgaaaacaagtgcactttggggctcaaacattttttaacagctttattgaaatataattcacatgtcataatattcatctttttgaagtgtatgattcagtatattcaccaagttttgaaaccatcatcactatttcccgaacattttcaccacccccaaaagaaaccccatacccattagcagttcactccccattcctccctcccagcagccccagcacccactgctctgtagtggtttctgtctctatagatttgcttctcctggacattttatataaatgggatcatacaaatgtactcttttgcgactgacttcattcactcagcgtaatgttttcaagggtcacctatgtcgtagcaggtgtcagtaccttgtctctttttcatgctgaataatattctgtggtatggatatatcacattttgtttattggttcatgagttgatggatattcgggttgttcccatgttttggttattatatgatgctgttacgaacattcatttacaagtttttgtgtgaagatatattttcatttttcttgggtatatacctacgggtggaattgccagattatatggtaacaatttttaggagtcaaacattgaaactgccatcttcctctttgttcccaggcagaaatggtgcacagtgctttccaggcccagcgggctttccttctgatggcctctcagtaccaacaaccccacgaggtaagagagtgtcctgagagggaaggtgtcccagggtatgcgcagtgtaagatggaaaacaaggaggcaacagaagcatttattatagtcgacctcctaaaaatgagacttacagcacgtgtatgttctgtctctaatctggatcatggtatagaacaattcttctctctcctaatctcattaatagtagacaagttttttttttttaagtatgccatttgcgaaaaaaaaaagaaagaaaaaaagcaatgtgtcttcttactactaatatatcattatggccaaattcttactgtaacaaatggacattaccagtttaaaaggtgagttgacttgtgtgatctttatactagtctcacaatctttttataatcaaggaaatgtttataactaatttttagctcagattttgagctgctttgttaccaaagactgttcacatctatgatcatctctaacctccatgtatggattttattagctcctatttcctaagtagcgtagatgggctaaattggtggttaagtgttttgtgtttatgggtcgtctacggagcttcattgcagtttctggttcatcaggcctggattgtgtcccaagattctgctttttaataagctcctgggtgatgcccatgctgctgatcctcattctcaaaacaccaaaattggaaagagttttcatgactctataagaacttaggtatagtccatctcgcctttctcttccaccataaatatgaatgaacttttcttaggttaaagatatttagaggtgttagaggatctgatgctaactgcaacaatattaccaatgtagtaattttaacaacttttaatctattgtaaaattaccaagtaaggcccatggtaaattttaatacagaaggaatcaaattgtgagaacagatgttaagagcaaattaatggttggcggaggtccgtctcattccccaggccctgaaaatttccgattctctaaaccaaagcgtgatcaccacctgcccaaactactgacattgtatcatgcaaataactgcattccctctaccaagggttcataataacaacttttgacaatgctgattgtgtcacgaatgaaattattcattaaaaagtagtggcactaccagcatactttgttttatcagaaaaaaataaaaattgttattttggctaaatattctgcatccgaagtttaagaacatttatataaataaaaaataaattgagcatatgttatgacacaatagcttaaatgtaataactcactttgaattatgaaacaaactcctgaaattgaaaattttgagctaagaatcctgggaatccagaactttgaccttcaggggatgacactcagctccataaagaggcaagaccagagacctgagaccctccctggaacggacattcccagccatgcttgtgcagtagaatcacctgcaaaattttaaaaaataccagtacctgggtcccaacccaagggactgtgacttcattggtctgaggagtggcctgtgctttgagatttctatgggcttcacgggtgattctgactttcaaccagagctgtcagcccccacccaagatggatatatcacctccctccacgtgaaaggagttagctcacagcctaggtaggaggctctgtagagatgaaaatattccgtgttccaccatggatgcattttcctccttgctcttctcaatctctgctttgcagaagagcaaaatgaaactgggaaatcacaaagcgatgtgttgtagattcagccttagcctgccttttctgtgaagtgggaggagaggtggtccaattgagattctcaggtagaagaagaactgtgactttcctcactgggttaccactccatcccttccctaagcctcagaacaagaggcctctccaatggctttgcaggccttagacaaaaaagccactcactaaatattgaatgaaaatgtaagtgaatgaacaatggatgaatgcattgggtctgtggcattccagcatgagccatagtcagggacactgtgtggcctagcatgtggctgtgcagattcttgggtcatatctacagtttccctttcttactctactgcattcttttttttcttttctttctttaaagatgggttcttgctcttgctctgtcaccaaggctagagtgcagtggtgcaatcctaactcattgtagtctcaaattcatggcctcaagtgatcctcccacctcagcctcctgagttgttattacaggcatgaaccgctgtgcctggctctattgaattcttgataaaggggagggaaactggttcccagggaggcatgcactggaaacgtctggcagcacttaccacagtgctccatgtgcaataaggcctggaccaggaccaggaaaatgcagagcaggcttatgatgcctacctcccttcctggcccttctctctacttccctttcctctttattcagaacaccgtcctactacttccacctgacagaaaagcagacctgagtgatcaccacgtgttgttcagaacccctgtccactccagtggggatggtacaggctcaagaggctgaagaagagacccagaaccagcagaaaagacctgaagtttattggggacttgcatacaggggagagagtccagtagcagagggctggacaggagaactacaaccacttgcgaaaggcgtgtaatttatatagcattttcatgtaacatcctccctctaacaacctccacctggtaaccttcatttaacctaaaacaaaaggcctccctcccccatatggccagtgttccacagcgttccctgggaagccccaggggctcaaatgttcctcatagaagagcaatggatctccaggttggccactcccagattccttagttgcagactctgaacacacattcaggtggatctgccgtacaagatcactctcagggtatgctcaagtcattgctgtcaactgcgtctgtcatacacaatcgccacagtggtgaaaacagtctatggccagaccttgatccacccagtatgcattctagaagatgcatcttaaagatcagtatcataatgcagatcgtattttctcataggaacaattattataaccatttgtgtcttactgtcctccttctttcaggaggaagagaattaactgctgtaatttcagctctcagtgacatacaacagtgattctccaactttagcgtgcatgacagttccctggagggttgtcagaactcagactgctgggccccacttacagagcttccaattcagtaggtcttggttgagtcccaagactctgcggttctaaaatgttcccaggtgatgtgatactcctcgtccagagaccacactttggatcctgtgctgtatggatggctctcactgttacaattgaagctcagatttatttcaggtgcttcagaatttcatttccaacggtctctagaccactgcttctcaaacttcagtattcatttgaatcatctggagatcttgttaaagtgcagagtctgattcagttggtctcaagtggggtgcaagagtctgtagttctaacaggctccccggcgatgctggtgccgctgatttctcactacacattgagcagcaagactttagtcattgccatccacaatcccaacaagcacagaatcccttggtagtcaaatctcgaattcatattctcttctcctaccatttctgtagcaaagtaggccgtgttatgctgcagtaacaaacatctctaaaatcttagtgatggacaactgcagaggtttatttcttgtgcgcactatatagctatctgttgcaagtcagcttagtatctagtagatgagttactaaataatgactcatataattatttacttagtgttgtaacagggctctgagagaaaagagtatagaattaatctttaataggagttttgggcattggggagggaagatctttcagggctggagaaccttccagggagtcccttggatcctgctaatgaatgcaagtgaccactcttgctgccacagcataaggcaaaactaaaccaacatgagtggtcggttgtggctcacgtcagccttgtgagaccctgagagagaacctagctctgccttggcccagaattctgatctacagaaactgtgagatgataaatggatattgttttaagccactgagtttgtggtaatttgtaacacagcaatagaaaactaatagggattctctcaattcccttgttgctgaactctaaggtaatgaatttttaaaaactttttgtgggtacatagtaggcatatgtatttatggggttcatgaaatgattcgatacaggcatgctatacataataaccacatcacggggaatggggtatccatcccctcaaatatttatcctttgtgttgcaagcaacccaattatactcttaacgtttgtttgtttttttgggacggaatcttgctctgtcacccaggctggagtgcagtggcgctaccttggctcacggcaacttcagcctcctagcttcaagcaattctcctgcctcagcctcctgagtagctgggattataggcacacgccaccacaccaagctaatttttctattttttagaagagatgaggtttcactatgttggtcaggctggtcttgaactcctgaactcgtgatccgcccgcctcggcctcccaaagtgctggaattacaggcatgagccacagcacccggcctactcttcgttattttaaaatgtgcaattattattgactacagtcaccctgttatgctatcaaatagtaggccttattcattctttctaactactattttcttacccattaaccatccccacctccccgcctcagctcccccactacccttcccagcctttggtaaccatccttctactctgtatgtcaatgatttcaattattttaatttttagatcccataaataagtgagaacatgcaatgtttgcctttctgtgcctggcttatttcacgtaacataacaatctccagttctatccatgttgaatttttttttttaataagaccacaggccatagaccacaatgtgcccttcagttcctccaccttcacccttccatctatcctggcagaagccggataaaggattcattgacagccctgattgacaatggtgacccccaatttcaaatttcctttctcactttggcaatgaggaaacaggtctcttgcattctctaatactaggacatttcaacatttcagccttgacccacagaaaaaaggatattttactttaccacccagtttcacaaaacagtattcttaccatgtgcgctgcattctgacatttttcttctagtctatgctgtgctgtggtcatcacccactgaactgatcttaagatgcactagtggtcacaccttgcagttcagaagcacctttctcattgatttattacatgctcatgacacaaaacacattataaaatatttgcaaagcatctcagcttttcttgtctccccttgttgtattttacataaataacctttgagcaaaagaatggcccagttcttacagcacttcttatagtctagaatttgtcaagcccatcctcttccagttgatggaaggattctcacatggaaaatggccaagaagcccccaccctggcttgctcaactattcatttacttttacagcaggtgagcatagaggaagtatgttatttctagttctcaaacgtaaaaaacaatattcagtgatacattaataatccagccccaggatgtagacctggacccattcctttattcactgtccagagtcctttttgcagaccctacatgtaagagccacactacacgtcatttataagagttgtatgtcaaaataaaattgtagaaagtgttgagttgacatgaacaagtgttttttggcctgaggccacctcacctcacctcacctgggagagatgagaaaacaagagtgttaacaattttaaccatgggtgactccaaaactctcgcccgagctgcagaggtaaccttttgtaaaccacgcatctgatgccttgatgggcaccaccccaaggaagactatcattcggggaattcctgggaggtctcccactgatgtcccaccagtctaaccctgagtagtttgcaggagcagaagagaagcacccggagggtggagaactatagctgaggggccataagtacagcaggctttctgctgccttcacactttccctattttctccagcatttctcgtgctgctaagacctgacagtgaaatgatctctgtgtgtgtgtgtgtctgtgtgtgtctgtgtgtgtgtgtgtgtctgtgtgtgtgtgtatttgcatggaatcaatatgtacctgcacatagagaaaaaattaatcttaagtttttcaacttcagggaagatgatttatggtcattggctgcctggtaggttttattctatctaggaagtctgagttctgtattcctccataagggggagagagagagacagagagcgcgtttctactatcctccctctcgttttcttgtctttatttgaacttgtactttaaagggaaatagtgccttcctgtgcataaagcaggcatctaaaactgattctctttcctttcattgtttatacaatctgaaaaattagatggagaaggaaggttagtgaaccttcttggccgttcctccatctctgagtgaatgcacatgcccagcacagtcctccgctcagcactttctccataaggattttctaaggcatggagcagtcatcaaatttgttaataatttgttcacattaaactaagcaaaaaagcctagcggcagtgatcttaggacttaagctaattatttagatgcatgagagatccagattattagtgggcataaatatgttcaggattttaataaaacatattaatttgtgagggttgtcaagagcagaaactttggacttgggcctacttggatttgaatttcacattttctactcattagctctgctaatccaaatgcgagaaaaacgaattcatctatgtcttctaagtttgagaatcttctatctttttctcggtatctactggagaattaacttggtaatccactgacccactctaaccaaaccaacttgtcaagttacccacttgggggaaggcagttaaactttctaagcccgtgttttcttgtctttaaaatagggataacaaataattcctatctcaaagggttattgtgaggattaaatgagaaaaagcaggcgagggtcatgtgactgactagaaaagttcattattagtcagtgttgtctgactgctttagcaaaaagtccccaaatctcaaaggcttaacagaggagattttttttcttgttcacataaggtctgctccagtgtttttggttgccattcttccacatggtagttcagggtccaggcttcttccatcttggggcacccaactcctctaattcctcagccattgaattggaaaagagaatgcaggaaggttttatgggctgggcttggaaatggcctatgtcacctcaccttcattcagtcttctggtcattcctagctgcaaaggagactggggaatttaacccacctctatgcctggaaggaagaagtaacagatttggtgagcatttggccagtccaccagagtgagtcacttggtttggctaaaatgagctctttctctgtggaaatgtattgtctttccaaaaactcatagggattttccagactaataccccatttctctagctgtccagggaaagacaagaaagactttgaaatctaacagctgaatttttattgcacttgggtataaatagatgtatctatgtatgtatgcgatatttcaaaatttcttttaactacagtgagtttatactttttccctataaaatgttttaccataacgataaggtgtcaagttattgtccagtattttaaaatgccaaacaaagtaatcatgtgactgatctcagagcataccttgggtaaattacttggtgctagtggcaggtctagaaattgcaaaggaaaagcaaacgaaggaacacagagccaaactcccaagtgtttcttaagtccatgcccagaaaatgtcatagcattgctcaatcagaattgctgaatcttcctgaaagatttggccatgattagtgctgctaagttctgttgtcaagggccatatgacagataacataatgcaataaagtaattctggccctaatgtaaaatgaaatgtctattttgaaatattgctatgaagttgggtttttcttaatacaaaggcatgaagaaaatattctgttgagtaactactgttaattatatgtgcacagcaaggatttttaatgggtttttaaatatcggtttcattgatcttggaagtagaaaaaagctacaagagaagtaaaaggtaaaaaagttaggccgggcacggtggctcaagcctgtaatcccagcactttgggagtccgaggcgggcggatcgcgaggtcaggagatcgagaccatcctggctaacacagtgaaacccgtctctactaaaaatacaaaaatttagccaggcatagtggcgggtgcctgtagtcccagctactcaggaggctgaggcaggagaatggcatgaacccgggaggtggagcttgcagtgagccgagattgcgccactgcactccagcctgggcaacagagccagactccgtctcaaaaaaaaaaaaaaggtttcattctttgtatcacgcttagttatgtttcagtttagccatttagccgtggtatttcccagtggtctggattgacagtttcaggaaggagtagcaccttagaatctaaaccagtgactcactttatgagcttttccaaattacctcgatagtctcacttcataaatatgcgtaagtttctgctctgttaatagtgctgaatgggttggctctcttcactaccaacacaaaagcacccaaaggcaatatatgcttttaatttctggagaagtgtattagtttaagttcaactaaaatatctgcttaaatataatttatgtagtataggtaaaaaccaattgcattctgatacttacaagattgcttttatgtaaacagcagctttctgagtagcagaaggtggagaagtgaggcaaaaagaaggcttttttccttttcctatgagccttccaatggcaagagaattaccttggtaattacatggtggctagcatgtgacggctactgcccgtgctggatgtagatgctggttaacacacaataaaacaccaaggaaggaaggagaggcaggggtttgtgtgatatcatcagggtttgcttgagttgacagcctgaagctacccagtcagggctgaatcccaacaggaaagctaatcattagtttatcaggatgcagagagggaggtaatcagaaaagagagtaattctgtcattcttctgcccagactgtttgctttagcaacataaagctgtgggtgagcctgtgagctgtgactatgagttggtagctttataggtatttagaaacccaggactgtggaggcagaagggatttgctaagatcctgtcctgttggaacatcactcatggtgacctttttttttttttaatctgataaggcacattagctcatctctctttgtataagacatgaattagataatgaatggctgcccaaaggaagtgaggtggttatcacaccctggggattcaagagattatctgaggggtaaaggttaataaagaaggataatatcctttgtttgatcaactgttccatactaagttcgttagaattccagactgccttgatggcaaatgctacataaatgataaaactgtgtatgtactaatatttgactagggaattttttattctccatttagttaaatattgaggtcactttgtgtttttaataaaataattatcaacgatctatcattttacactgtgaagctcaatatttgcttgcttagccaccatcaatctgatataaaaagtgtaagagttgcaagtttttctctcatgacctgaatcaaaaagtaatttagaaagaggtcactgtgtcattcaacaaatctttttaaaagccaaacatattttgaccttttatttggatttgctacttgttaattgtttcagcagccttaacttagatcctctttgcagaacatagcttctgtcatctgtacaaagctgtatatgtgaaaattgaaggcaaggagaaggtaattccagctggcattccagtcgggatctgctgtcataaattacttagcagagggcatggttcgttactttttatggtcatgttctatatttgtatgtgctggggggtggatcacatgacaaaaccatcatttgatattagtgtttatgtgcaccaaccagtgagggctcgattgaagcttcactgtgcagtacttttaatttgtatatttagctcttaattgaaaatgcaggcacttccataagtactaaaactacaaataatctaaataaattttatataattgtctttaggagaagacaaactgctgtaaaccaagctaattgaaatacactctgccttccagagatttgaaaacaaaattttgaactagctagtcaacattgccagaataataaagaccaaagtttaccattttccattttttagcccctcccctgattagctgatgtctgtttatttaagaggaaagacatttttcaaactaatcaagacagaggaaaaaaacagtctttttttttttttttttttttttgttctattctccaaatccgttcccctagtgcagcttcatgcttaagtttatagtggcaaacacctcgaaaatgtccttcttgtttgatatttttttcccataactaaacaggaaaaaaaaaatgggcatgtcaggttttggttcatccactgctttgagaactagtgtttccatatctggaatcgtttgttagataaatttgcctgtaagtagttgcttcagatctttgtcaggccttgttcatcttacatactgcagccctctttaatttcctcaactccattaatttatttttcaggcttttctttcactaagtatttatcgcatgcctactctatagtagtcagagcacttagcacgtctgcatctattatttcatttgtatgagaacatactttggaaaataaggtcgggatgatgttatttgaacttcctcagcacctatgtagtagtctctgtcaaacaacaagtaacttctgaaataactgttattttagaaacacttctactgttatttttttgtgcatattttccatcccctcaacaagatttgcagagcctcagggatctttagagttgatatctctttgcttttctgacatattgtggtcttcacaatattttttattagatgccaagtttgatgagaagagaggctcgggttccgagtcacttgttttgtttgaggaataaaagctaggttcggccaggcacagtaactcacacctgcaatcccagcactttgggaggccgaggcgggcggatcacaaggtcaggagtttgagaccagcctgaccaacatagtgaaaccccgtctctactaaaaatacaaaaattagctggatgtggtgacgtgcgcctgtaatcccagctactcaggaggctgaggcaggagaatcacttgaacctgggaggcggaggttgcagtgagctgagatcgcaccactgcacttcagcctgcgcagcagagcaagactccatctcaaaaaaaaaaaaaaagaaagaaaagctaggttcatggattacagtggttcagggaagggaactgagtgaaggagggacattgtcgtttggtgatgctgttatcttttactgaaaaggaacttgatatttggaggtgtatttggtaaggacttagttatcaattgacagcataactggtaacatgtaagtcctggatcagccttgaaagagtattccttatgggaaatgggaagattagagaagaacaagcgagatagtgttggtgaggcatttcatttcaaaggtttgtttctcttacacccccttttactaaatgaatgccttggaagggaccacggaatggttcatttctagatgtgtggcgctaacgatgagaaatgacggcaaccagatttgggtgacagatgtcgctcaagccttcaatgattatagaatataggttctgggaagaatgtgctgattaaattcacatgggctgtggagatccagctggcctgatatttaaatgctgctgaaaaatgttccaattagatggattcttccctgtgcagagttttcatgtaaattgtggaaaacggtactttcttcaggcaatgaaattgttgtgaatgtccaatgtcagtcctctgaagatggtaattatgcagcttgaactacagaaactgcagcgcagaagaacttcagggtttatcctgtctctgtgcagatggaatctctatatagaataatgaccaacacatcacacaaattggatttaaatgacttgaacaacaggagtcccatcattttctttggctgaatatcctatagttgaatgtgtacaggattcctcttggatagtcataattggattatatttcccatacgagcagggttgtaatttgaagcttcatattttaccagcttgacagcaaattaagcacagacaggacaaactatacatcatacaaaccaagatacaactaaaatctttctgattatttaaaatgggaaaatgtggctccatgtcctgtaaagtggttaaaatacagtgtttacgttgattataagagttgctaatgaattctaactgcagtacagctcataaaaaagtctatatcataacttacctatctgaagctgatgatggatggccatagtaaataatcatcaataataattttatttgactctttagaatttgaaatgtcttttcatagaaaagcactggaccacccatatttttaaaatgttttttgtgattaagtgagagctcttgtcttttcctctcttgacagcatttctctggcctggacagatatgttcaaaatcattctgtaattctctaataccacgcttgagattggattatctttttcagaagtaacaatcaaagaatcacagcattctgaggctgtacccaggagtgcactggggagggctcccttggcactggtcttttcattcaacttttctttgttctgccatctcccaaggcttaaatgggaaaaggagaaagacgagaacaacgggaagtatgtgaggagagaggatagagaaagataatcctatccctgtggcttgtcagttagaatgagggagggagttgtgagctgatcatgtggctatgcaccttagaactttttcccacaatacttctctgaactgctttggtcttattttcttacttctttttttttttttttttttttttttgagatggaatctcgctctgctgcccaggctggagtgcagtggcgcaatctcggctcactgcaacctctgcctctcgggttcaagtgatcctcctgcctcagcctcccgagtagctgggactacaggtgtgtagccactcccagctaattttttgtatttttagtagagacggggtttcaccatgttggccagaatggtctcaatctcctgacctcaggtgatctgcccggcctttcggcctcccaaagtgctgggattacaggcgtgagccaccgtgcccggccttattttcttctttctttctccatcttttgcagcctccaaggcagggaagctgaagtgtaggtgttaattagtagcaaggcagtaatgaaaagagtgtaactgtgagatgcagggctgcctgcgctgttacagcatgtcatccggccactttcatttccttgacttatttttgcacctttattttgagtcaggttaccctaaacttagttgtttcctttacattgactatctgtgtccagtgctcataacgagtgctcaacaggagacaaaatgaataaaccatccaaaaccagccagaccccagatatttaagatgattaagatcttttcccaagatcacttattaaatgagtctctgaaaacctcctcttgtctttctgtctgtggaaagtcaaccctaattactttttacagtaagagaaactcaaggagtctggaagagggtttcctccccatatttaggggatgcacagaggagattcatacttaacaagatcatcattgaaacctccccataattatgtcctgacctatcgattgcttgtgaaaaaactattgttcccatgtatataaggaatagcatagatctttgtgattaattttgggggaagatctatttttcttgaaaagaaactgtgatttaaatgtaatcctgtcatttaggttgtttcatgtaactgttagtttcttcttaatgattacaatttttaactttgcttctgttctttgtttagttgttcaggtatgtcctaaacagagttttaacttatataattactaactttacttcttgcattttccacttttcatatatatgaaatatatataatatatataaatatattaattatatatcattaataataattatgtataatatataaaattttatgttgcttgggtcataaacatttactcttttagataggctgtatctattgcaatcctataatgacccctcggttgctttttttccttgagacaaggtcttgctctgttacccaagctggagtgcagtagcgtgatcttagctaactgcaaccaccgcctcccaggctcaaatgatcctcccgcctcagcctctcgagtagctgggaccacagacgtgcaccactacacctacttttttttttttttttttttgtatttttagtagagacagggtctcactaggttggccaggctggtctcaaactcctgagcttaagcaatccacccgcctcagcctctcaaagtgctgagattacaggcgtgagtcaccgcactgggcctctcaattactttttattcagaatacttttttaatctgataacattataaatatcccttttcgtgttgttgtgacctcctaccttccctaggaccttatctaatcaatcatttccttctttctctccctactggatccttctgtttagtctacaagccaaatgagttttctctgtttaaaaaaaccaaaccaaacaaaacaaaaacaacttccttcactgcctaaaatgtctctgtcctcctctttactgccagccttcttaggaacactctgtcctccctgatgtcatgtcctcacttccctgtcactttttaatctcctgtcctctgtctttcctccttatcatttgaccaaaaaagactttcccagtgccctgcttgcttcttaattgtcctcattccattcagcctccttgaagaatttttactgctgaccatcaccctcctcaaagtttttccttctcttgggtaataacactatgctttctgtctgttttacttcatttcttgctctgacttctcttcttccctctatcccttaagtgtacatattcctttaagattcattctatgtcatcagaagaggactttctcaaacctggtctctcccctgtcagtttcatccgttcccatggtggggtccgtcactcatctgctggtggtgcccactgtacgtctccagctgaaggctcttgctccacggccctgggcatgggtgtcctccaggagctcaaatgcagtgcgtctgtaccacacacacacctgtacgtgtgtgtacacacacgtctgtaccacacacacctcctccaaatgctgggctccctcattctttctcccagttgatggaacctcaagccacactgtctcttgaaccagaactcctaagtccttgtgacccctcctttcctccacccctcacatccagctgatctctgagtcctgatgatgccctaaccaggagaatctatgggatgtgaaaacttcacttcattcccatttgctctaatttggaaaggaagggaggatgagagtgaagaagaggagaagggaggacggaagtaaaaatgaaagaaggaaaagaggcaaggaggaaggaaaaaaggagggaaaaaaggaaggggtagaagagagaaaggaagaagagaaaaagatctgctttttaattttttttttttttttttttttgagacagagtctcactttgtcgcccaggctagagtgcagtggcacgatctcggctcactgccagctccgcctgccgggttcacgccattctcctgcctcagcctcccgagtagctgggactacagtcacccgccaccacacccggctaattttttgtatttttttttagtagacatggggtttcaccatgttagccaggatgatctcgatctcctgacctcgtgatccacccacctcggcctcccaaagtgctgggattacaggtgtgagccaccgcgcccagcttaatttttttaatataagggtattacaagcttgctttttaaaaatctgtgaaatgaagaaaagagaagaaaaacaatcccaccactctctgacagacactacagtatggcctcttcaaccagtctctgtctcaaagcttccgctcctccagcctgtcttccattcttatcatcgtaactgttgctacaaaacaaaccaaacaagcagaaaacaaagcaaatcaggaatgctgccataatccgttgcctatgcaatcagttccagactacagaggatgacagtcaaggccctttgcaacttatttcagcctctgagtcctctcctccaaaacttctcccccacagcaaatccattatcccaatcacattggacaacacaagtgctatgaacatgtataatgtgactatgcaagggcccaaaatgtccatccttctcttcctaatctgtatatttttcattttaacaggtgtagtgtattccataatttgattagctaggcttggagacaccaagaactgctttctctaaagctcaaaggccaacgagggcaaaagataaacctaaacctggtatattgtaataagggcattgtaataagtattgagctgttggggggccctaggtagcagtcctgaacactgcatagggattggggagttggagaagaggtcacaaggaaggggccccttgaactgggacttgcaagagaagcaggattcatgcatgagaaattgcgcctgacaaatggaagcgcctgaagtgtctttgctctggtattcacacaaacagattcaatctcagtccattctcccccaccccatctgccaagatgacttggtgctaaatgtggtttttttgggttttttttttttttttttgagacagagtttgctctttttgcccaggctggagtgcaatggcacaatctcggctcactgcaacctccgcctcctgatttcaagtgattctcctgcctcagcctcctgcctgagtagctgggattacaggtgcacaccaccacacctggctaattttgtattttttttttttttttttttttttttagtagagacagggtttcaccgtgttggccaggctggtctagaactcctgacctcaggtgacctcggcttctcaaagtgctgggattacaggtgtgagccactgcacccagcataaatatgtatgttttttaaacaagattgttgaattttattttttaatccagtcaattactttctaattctttttaataagcaagtttaggctgttcacatgtgctttttgatatgttatttgtcctgaagcccaagtaaatgtatgtttattgtagtcgttcttgctttttcttttaatttctgtggtttttatggcagattttaaactctatctctttctgaacttggccaaaggataaccttaagtaggctgatgttaacattttaacaataatatattccagaaaaaccattttaactgcttctatttatttcaattaactaagtaaacttggattcttttctaggaaacaaaaaaaatcttttgttcatcttcagctgttcattatttgtaattattatctgagatcctttttgagattctgctaatacctgatagttccaagaatttacttgctaatttactaaccatttccattatattctattaatctttgcataacattctgattcatttgtttctcaagtatgtccttataaatctctgtctagttttgtttcctacagtggcaaaatggatacatttctatgtgacacacttttcatatttttaattggtcaatttttctaagtctgaaaatatccttctctgccttcaaagagcaaaatgaccctgggcaagtaccttctcttggccttgtcatagcttttccaccccatcctcccctcctccaaagtctaaggagagaaatctaattagtattccatgtcattaaataccagctctctttacctgtgatcactttaaagctttgccttggcctttctatttctttaaggtgacagacatgcatatgtaggggagttcgggcatgggaagtcacccaccactgagtgagtggctttctctggattctcatgatgttcgtgccaaaattctatttcagttcaataaattttctgttatctctgttcctaattttatactcatcacgatcctttcctttctgtccttcaaagcttgagcttccttattctgttttgtaggtgtattcgtcagctagggctgctggaacaaaataacacaaagttagtggcttaaacaacagaagcctattctttcatagttctggaggttagaagtcaaggcgtaggctgggcgcggtggctcacgcctgtaatcccagcacatgatctggccgaggtgggagatcgagaccatcctggccaacatggtgaaaccccgtctctactaaaaatacaaaaaattagccgggcatggtggcgtgcgcctgtagtcccagctactcgggaggctgaggcaggagaatcgcttgaacctgggaggcagaagttgcagtaagccgagatcgcgccactgcactgcagcctggtgagagagcgagactccatctcaaaaaaaaaaaaaaaaaaaaaaaaaaaaaaaagtctaggcatgggcaaggccacgctccctcagatggcccaagggaagaatctcttctgagactccctcctgacttcttgagggttgctggtaatctggtgtttcgtggcttgtaaatgcatcatactccgtctttatgttcacgtggtttctccctgtgtgtctgtctctgtgtctacatttcccctttccatagggacacctagtcgtacaggaccaggggccctccctactgcagtacgacctcatcttaaccaattacatctgcaacaaccctatttccaaataaggtcacattctgaagtacttagggtaaggacatcatcatatgaattagtggggggacaccactcagcccgtaacactagatttgtcaggcattgttctattgttattatctgtgtaatgcaggcgtcatttgggccagttgtttagcgtgtcctggcttacgccatcacatattcctctgtaccaataactgcttcttctctctctctctttggaagctttcatcgtgagcccattcagacctgctcaggtggagagttccaggcccatttgcccctttaagttgcaaaagtgtgttttcataggagtcaggctgccagttggtggggtttcatttattcgatttctttattgtttatgaagcctatcatactgtgtttgttgtgtcttgttttcttattttctaaaatcttacagataacaatacaaggagggattaccatctgtaaaactccttcccaaaagtgcagggtacatagatagcattcagcaattttcttgatttcttttttttcctccattgttttcctgtctaatttttgtggacagtcatatgaaaatctcggtgacttcctgagacttcacgtgcacacgtagaactgacgtaaaaatgaaggagcggcattggtgtgcatttggtcacactccagggagacatacccagattagaccaactcctcagggtgcagacaaggtgacgtcaaaggacacagttggactgggattcattcttacaatgggataaggcagggcttaggcccctgtgagaaagaaccaagtactggttcctaaaggaaaggtatgaaagacgggaatgtaaaccctcatggagccccagggccccttgatagagaattctcacatgcccagctccaccactgtgccacaaagccttccagaagcccaaccatcaaggctgctgagagattcctctccccggcgtggctgacaggggtgttttccccggcatggctgacggggttgttttcacaccaggagccaccagcccactgctcagtgataaggagcactcatgaactctgcacacgagcaccctgaaaaaacccagaggagcttgccctggatagagccccataggttctctcctgtgtgcttcttgtctgtttctggtcacttctgcttggagttgtgtgagtccagtgagaagagtcccagagagcagagtggcaactgctacactcccaagcttatgtccttggtctgccagcctgagatgagaactatttttgcagaccaaaatgaaagaccacggactcccttttttgttttttctttgcagaccaaaatcaaagacggatggactctatttttttggcagaccgaaatcaaagatgatgggctccattcatttcctttccagagctcttccctgatagcgaagatgttgtgggcagagaaagatagaaaagaatcatttccatagcagttgcacgagtctgcgtctgtgtattcagtgcttgggtggctcccccttctcacgcaaggccttgtcacaagctcctgtgtcatgaattgttggaacctgcagcctggctcaaatgaccacaggggtgcctctttgtcagacatacgctgtgcatctggcggcatcatgagggtaatgtgatatggctcacaattttaattttaacaaaaaaatacatctgtcagactcatttcagctgacaggataaatatcatatttcattgccagtttgtaaacacctcacttttcatctctatctgacatgtttcctgggtggtttacaaattgaaaaatcaaatggaatacatttggggccgagcatgtatgctatgtcagtcaagtctgagggtagtgtttatatggagccgggtccgtgcaagcaatacagaggtggctgaccaggaaatgtgacagtggcagatttgtcttatgtagaattgcctatagtaagaaaacccagtagagaaagtggttttgagaccattcggcagctgctttggacacctggagccatttcttttacagatgaagatgcattgtgtcattgtctcaggatcctcgtcctgttgcttctctggccacaaattgttctttaccaaagatgattttatttcactgtctttgaaaatcattctttataggtagaatatgaagattctctgaaatgattccaaaatgccaaactcaaacactattgtccgatttctttacttgcaacaagagagtagaagggacagtatttgttttgtgatgttggggcgttcatcagggagagaatttgagataagtagaatagcaaatagaaatagtgaaataactagattcccagtcctgggttttttttttctcagtcctgttataaacagtactgatggcattttatgtgaatatttatgagggaccttttaattaaaggatctcaaaattctcttatcacctgttagttaattttcacaatgtcatgctagagtgcgtgcatagtaatgttatatgccaagtacagatggagagatcaaagcctgcagatgttcagttacagaacttgccaagaacctgcagtgatcaactgggctttttccagcctggggcaccagcctctggttaccggtgccacccggctttccccagcttggtaaccagtgagaatcaggtctagggctagctggaaaacgacaggaatggtgactttggactcaccccaaccctttcctgccatgtgaactcccacctcccacccactcatcttcctttcttgtcagtctgtttattactctgagctgatttccactgaccccagaaaaggattaattgataactacaggggttagtaattattgacaaggtcacacttttccaaaaaatatatgcattttcaaatggaaatctaaatgccagccaggtcttccccaggcttggcttcctgctgtcctgcttcaaatactcttttccttcattgttaggaacgagagatgcataagaaccttctacagaagtagccctcaaactacctctccatggcaggctctgccaagccaccacttagcgcagaggcttctgaggatgaggaggggaaggatggaatggaagaaggacatcctgtttgtgttcccacaatccacagcactataactctcaaagggtgaaacagtgaacattgggtgtaccaattctgaaagcctaaagtccctcatacacaacaatcacctataatatatttgtggccaaacatgttctaaaatccagtaaaataagccaggcatggtggcatgcacctgtagtcccagctatctgggaggctgaggtcggaggaccccttgagtcttggagtttgaggccagactgggcaacatagcaagaccccatctctcaaaaaaatacgttaaacaaaccaatgagatagaaaaactctgcaaaatcttgggaagtagaattcaaggaagttgtgacagttgataatttaagctcaagcaaattttctcaagggaaaaacctagataaataattgacagtgggtcaggtgtgggggctcatgcctgtaatcccagcactgggaggctaaggcgggtgggtagtttaagcccaggaattcaagaccagcctgggcaacacgacaaaaccctgtctctactaaaaatacaaaaaaattagcccggcatggtggcgtgcacctgtagtcccagctactcgggaggctgaggtgggaggatcactggagcccaggaggtccaggctgcagtaagccaagatcacaccactgcactccagactgggtgactgagcaagaccctgtctcaaaaaataaataaataagtaaataactgacagtgttgaagcatggccaggatatcataagacaatcgagattattctttagaaatcagcctcaaaataccattgattagatgtttaaagcctagggatctaaacatgttttctcttacccactgttactgtaatccaaaggccaactgaagtcacccttccacttaggatccagtaagatgtgctggaaccctcattccgtgtcctgtggacatgccaggatatctggaagtgctcacacaacacaccgtcacggtcacccccggcttccaggcccagccactgcagaggactcagctgtgtcttttctgctcatggagccctgcagttctccttgattgcattggcaggaggcagttgcagttttaatagcaacctccaagcaaggaactcagaatcatcctctgtgtcccccactgccatcacttttcttgctcacctcattcattaactcagcacttaattgctgagcacgtactatgtgccaggtgctgaagatactgaagaaaagaagccatcctcgtgcctgctggaagccctgtcccttacctgcctttcggagccatctccttctcccatcccccttgctgtggacgtccccagtcgcttatcaagcccctgagaaacactcccaattggtatctgctctgacttggtgctgtccccctttccctgcctctgactctctcctccctgacaggtcagttattctaaacttccaactaggccactgctctgcattaaatcctctcagagctccccaagagcaaatgcctgtctggctcagcagcctcatcacccagaatgccaccaggtgggtttgtttgtttgtttgtttgtttgtttgtttttgagatggagttttgctcttgtcgcccaagctggagtgcagaggcaccatcttggctcactgcaacctccgcctcccgggttcaagcgattctcctgcctcagcttcctgagtagctgggattacaggcacccgccaccacgcccggctaatttttgtattttcagtagagacgggggtttcaccatgttggccaggctggtctcgaacttctggcctcaggtgatccacccaccttggcctcccaaagtgctgggatttcagacatgagccaccgcacctggcccagttttttttgttttgttttgttttgagacagggtcttacactgttacctaggccggagtgcagtggtgccatcatggctcactgcagcctcaaactcctgggctcaagtgatcctcccacctcagcctgcctagtagctgggactacaggtgtgtgccactatgcctagctagttttgtttgtttgtttgtttgttttgtagagacagagtcttgctttgttgcccaggctgatctctaactcctgggctcaagtgatcctcccgcctcagcctctcaagtagcagggacacccacttagttttattttaatttttgtagagatgaagtctcactatactgtcctggctggtcctgaactcctggactcaagtgatcctcccacctcggccttccaaagagctgagattacaggcatgagccaccacatccaacctgattcttactccatgccattcaggaaaatttgttgtttcctgagcatagcttggctttgtgctctttttggtatctttttctgctgttctctcagccttccccttcagatttcttctcatccataagtaataagcaaacacctcccttctggattgtcctacctggtgcaacccacagtcagaccagcagcctcacaagccctcgatggcttggtcccacagccccactgtaaccatttgttcctgtgaccatctcattcatctttgaatagctcagggccaggaaaatggtaattgtgataaattagtcatttattgtaattcttcagtgaatttcacatcttggttttaaaaaaaaacacactcatatcacaagcccacattcagctcagagacaaatgttaaatcggcctcaacctcagtttcctctgctgaaaaatgaggataataatactgaattacaaagtcactaagagaattagcatctatctttgtggaagccatagtttcaatcacatcagagcatctccttatagagctgcagtttgtgttagttctgttgtcatcaaagtttgcacgcgaagttagcacacttggtcttgaattataccctctggacatctaagggattcatgaacatgaacatggtgcacctgctgcttcatatctgttccacgaggtggatattctctcagttaataaggggcagagtcaagactaaaatccaagactgactctgatgcccatgctgtgtggaaactccactgtgctgaggggtctgtgctggcaggacgtcctaccattacccgttttgcctttggcccactccggcaaacacaggaaaatacctccaccagaaagtctacaaactaactttccttccaaaattaataaaattgatggccaccatgagccacagagaaactacctttaaagaaaatcaggctgcgtgcagtggctcacgcctgtaattccaacactttgggaggctaaggcgggcacatcacgaggtcaggagttcaagaccagcctggtcaacatggtgaaaccccatctctactaaaaatacaaaaataagccgggtgtggtggcacgcgcctataagcccagctactcaggaggctgaggcaggagaattgcttgagcctggtaggcggaggctgcagtgagccgagatcatgctactgcactccagcctgggcaacagagcaagactctgtctcagaaaacaaacaaaacaaaagaaaaaacaaaagaaaatcagaatacagtaactaccattcagtacagtttccaacaagcaacagtgttaagtcctcagagtcccacatggtgccccaaagggtgttgaatgaccaaatgtcccacagttggcattacccagtgtcagctaccatcacagggagagttaagttgctactacactcttccatgcacctctctgcttgcctgtttggattagcttcttgaaatgtgttgccttgccccttactacctagggttttgcatccattctctcatttaacaaacactagctgagattctatttgccagatcccagtctggagctgggaaaactgtagtgagcaaaacagatctgccctcctggagtttgtaatctagtaggtccatcatgatagttgtgccatttagccagatcttgagttctccactggggtgctaacgtcctccaaaagggcattttggaaatgcttgaggttgtcaaatacaggaggtttcttttggcatttggtgggcagatgccacaagctcagcaacacacaacacaatgcattatccctcctcttacttgactgtcacccactgtgtatgcatgtaagtgaaaaacatttttaatcatctgagcttagaacctaatttcattccatagtctatattaatatgcatagtaattttaatatatatcctaaattaccctggaatgcagctgcagtgcaaattgagggaagatgacactttattttgttctgaacttttaccatatgttattttccatgtcagaaaatggcatctccagatatctccaaaagacttcttgtatttgatttgctaaaacactcatctgtatgagtccacatctgtggctatctctttctgcaggattctatgtgcagttgcaactttgagactacatcatatcttcctggtgttgttgtggccaagcatttatgtcttgaaattactttccttttatttcccctttattttacaattagacaccatatggatttcttaaagtgatgtgtacatgtagtttatattatctgtgaatttctttcaggctagaaaagaggattataaaacacttgcaattttaaaatggagtattgggttgggtggggtgtaagtcacaaagctagatgttcctgccatggcaacagcacgcctttgcgggcagaggtcctgcccatgagttttcggttgtagtcctaagattctgcatgggtccaatcagaacaaacagaatgagagccttggagaaggatcctggaggcctcctattaggccaggattgctggagtttggggactttgagaagtcctggaagagagactggggcagccagggcagcagggggtacccaaagggcttggaaagtggctgtttgccaaccactataaaggatcatggcgccttaacagctggtgaagctgcccttgtgccctttggctgaatgtcagctataagctcagccctcctgctgacatgtctgtttcccgtgcaagtaaactcttcaggctgtgcccatagctccactgggtaaaccacaggacgtgtgctactaaaagaaatctgtttctctttcattcttcttctgccttgagccggtagaaactcagtgtcattaacatcatgtcccagaaatgtgagtttctgatcctggggttcttctagcacccttgcattgaacttgaacagcttttcccaaggactgtcccccaacgcccccgagattgtcagggtgccccatctgttctccaccttttccagtatgtcccagagtcatgtaagtaaattgcctgagattctcaaaaagagatgacctaagtttccaccccattctaaagggcctgcattgtaagcatgtccttcttaccgcatatcgtgggcaccatgttctcagttctttcatcagctacagtgtttaactcagcaataattattccatttcgtccagctatccatgatatgctttttcttcagtatttgaggtcagtaaaattgcttgaataattacaataatagcagctgtcatttttagtcctctattgtgtgtcagacatgatgcacatattgtcttatgtaatcgtcatcagaaccttacagatgacataggaagaatactggggctcagactagtgtgaacgatacggtttaaacccagatgtttcctgttccgaagccaatgctttttttgttttgcctaagagtattagctgtgggagcgagacatatctgggtccaaatctcagttctagccagatgatcttgggcaagttactaagtatttcttgatcttgttccctcactcataaaacagggataataatgctaatgtttccaccaaagttttatgatgtttacataatatatagaatacaaagtacagtgcgtgatttatagtaagcaatcagtaaattttcatttcttccctccccgcaaactgatcttaagatgatagtcatcccacaggactctcagatttctgcgggcttcctcgcatgacctgctgatgaggaccaaataaatcccattgtctatccagttcagctgctcttggccccagccttgtccctgtgtttattctggaaggagtacttaatgtgccaggaggaaggaaagggtttgaccttactggtctttgcaggaactgtgttctgtactttgcagtacccatgtgcgatgctggaaaggtacatcttagaaacgcagagaaatcttctataatcaaccatgggaaatggttgtctattttttctctctataaatttcccaacttcttgtgatgtttgccagtggtggggtgcatgtattttgattttaactttgtattttggggtcaccaaaaaaaatcaaaacacaaataagtctatgggctggaagtcagaaggagcagaactgagggaaggtaactgaaagagaaaaacaagattggtgaggcaccagagggtctagcaggaacatggaactgcagctggcaggctttattctgtgctgccgatcagcagcaggcatattatatcctggactatgtgccggcgtccaaagtggctggaattgaaagtgaactttagcctatgcgtggctgaattcaggtcagccagttggggggaaaagcagcttttatccctgtccacttcctgatttctcctcattgatgttccatactccgttctgatcagctgctagcatgtgacaggctggctggatcaaacagcatcaaccaaatgttcagtcaaacgttgtagtcagctaaatattttcacataagccttttttacattaataaaatctcccctcctcctctgacccctttgtactgcttcactcctttttttcatagtacgatatccctaatatgtctgttgtttactgtctgtttactgcttgtaaaccccaaaggaaagacccgttttccccacttatgtatcgcaagtccctaggactatgcctggcacctagtaggtgctcaataaatattgtaacagataaaaagaacaagaaaacatgaggtcagagttagtggatatcaggcagaaaaaaatgtttatgaaggaaaacagaggaggacataaaagacaatatctgatcattttcttcacgtgtgaataaaaaatctgtatcaaaacaagataaactattaccttctttagagaggtacattttatttccgatttacccagatcacattggacttttcagaagcttaatttttatttgtcacttcagtgttagtttgtgtattcattcacttgttcattcatgcctgttacatgacactatgtttagtataaaaatgcaagctagaccaccagcatccactcatataacccaaataagccacttaaatagtgcacctctctctcacctcaatttgttaagatatgatagagatgaaaccaaggctaaaggttgtttctctctacaggccaacaagttttaggatataatgagtaattgacctgggaaattaaacaaaaataatttcaccgccaaccacagactgtacccataatggaggctggctgtctcacagacttttgctgctggccagagtgaatgactcagcacaagtcaaccccaggagagaaacaatacagagctcacccctggctgattgagggccagaagcgccattcttgtaggtgaggaacagagcatgtatacactgtgttgttctgaattggaactgaattgtactgaatacaggaacatatagcacatttatgaatcatgtgtactggattgaaaatgtgagaagatgctcccaagcaaagacacactgaggagtggagaccagaaaggaactgagctgaggagggggcaaaaaaaaaaaaaaaaagcaagcccattgcagctgcactgcagatattactcatcagttgtggcccctgggaacacctggttgagggcagccgaaacagtacgtctaaatcggaattcctggtctttgcgctaaagcctgctccttctgccatttcccccatctcagttgatggcgactccatccttctagttgttcaggtcagagaccaaggagtcattcctgactcctcatttgctttgataccccacatccggtctaaaatctacttttcacaatctccactacattcactctggcctgagctgccttcatctcttgtcggaattattgcagtagtctcgaatacgatgtccctagttctgcgtttaccctccaataatctattctcaatacagcagccagagcgatccttagaaaagaaaaccacatcatgttattcctctgctcaaaactccatggtgatctccgctttattcaggataaaagccaaaatcctttcagcagctcccatgattggtgccccaacaccctgtcattttctgtctgacttcaaaccctggccctttctccctcagtcgctccattccagctacatggttctgcttgctccttaaacactggaggcacattcctacctcatgatctttgtagtggccgtttcctctctctggggagcccttcctccagatgtctacatggctaatgccacttccagatatttattcaaatgtcaccttctcaatgagacctgtgctggccatcctattttaagtgggaacccaccccccatatatatttctgatcctcctcactaggttctacctttttccctctatggtttttaacagttaacatgctatataatttagttatttatataattatttatctgcgtctctctccccctgtgatggttaattttatgtgtcgacttggctgggccctggggtgtccagatatttggtggagtattattctgggtgtttttggatgagattaacatttaaattggtagactgagtaaagtagattgcgcttccaaatcagttggagtgcctcatccaatcagttgaaggcctgaatagaacaaaagtctgaccctcccttaagtaagagagaattcttaccgacagcctttgagctgggaaattgggttttttgttttgttttgtcccctgcctttggactcgaattgaaagatcgttggctcttcctggatctccagcctgccagccttcagacttggactggaacttacaccattggctctcctgggtctccagccagctgactgcagatcttgggacttgtcagcctccataatcacatgggccagatccttgtcataaataaataaataaacatatcctattcattgtgtttccctggagaaccctgactaatacatgccccttgccacttaaacaaaagagggcagggacatcagagtgctgtctgtattgtttactgctgtaccccagcacctggaccagctctggcacataaaagtcaccagtatatatttattgaataaatgaagaaacaaatgaaccagcaggtaacaaaataactctctttaccgataatagtgagcaaaattatctcattttattacacagtcatgatttataagctttacatctaagaactgagtcaaaaatcaaagaatggtccttccagcacatgcctcatagaaagtagttctggttgtacatcacgtttcatgctggatttatacacaccgttagccacactttccctttggggtcaatgtcaaaatccaggctcagcagtctacaagcactgataaggcttggagtccatgggatttatggcatatggagctatgggactcctctggacttggaagtgaccaaaaatcccccttggacgacaaagaagcatctcagctcaagactcgaagatgaaagttcattggccgtgagtgtgtgctgcaaaagaaaaagactgcaatttagtggcttttttccttaaaaagcctgctttttcacacaagtttaggtgtgtgaaagagaaagcaagaaaatacagagaaagagacaggaaagagactgtaactgtcaatggtgggagttgttagaagtggggacagggctggccaacaaatgacctgcagaaaagacagcaacagaggacagaatcccagtgcagtggggggatagctatgccagcagcccatccagagatgtttatagctcctgaaagcaactgctgtgcatgcgtgtgtgggtggcggggggggggggtaagtcagggaaaacaggctgctttacctctgttaaatgcccttgaaagcatctccatggttataagtgagacaaccagagaggaaggggcaaatgaatacacagtgagcagcccagcaggcctccatgaaaccctgaagctaccccacaggcctcttatagcagcatctccctgggtctattcacagaataccagttccttagaaaactgtgggtgaaattaaaagctccgtggatcaaaaagcttgaaaaacatcaggttaagcaaagttaaacaggtttctttagtatcttgttcagtattctgaagtgaattgtgggccaccaaaagagggggcgccatatgcagaagcctcccaaccctgttgaccaggaagcacggctcatgttgagctactcaccaaatgagctagtgctctatgggatgcattgctctgttttgtttttttttctttctttctttttttgtaaagatgcagtctcactctattgcccaggctggtctcaaactcctgggttcaagccatctgcccacctcagcctcccaaagtgctgagaatacaggtgtgagccgccactcccagctgtttgctcctgagaataacaaacaatggaatcttaggaagatgatgttacccttaaaagagaaagcagtttccgattaaggatcactggagctaagtatcagtggctcggtacaataatggctcatctaccctgtgggatatcttaacactcacaggggagttgttgaaattctttgcatctgctgagtttgaggtggaaactgtagatttacatcatttcagccacgttctacataaatgaatctcagagaaaagatctggccatccctctaccatgggccacttaagaggagagagacagtgacccagcaaattcagttgactgggctgggaacttcaaatggtggatttggtagtttaaactgagatttatcatttgaaagtagagacaacagatgaaaacctatcagcgtggtatttggcatatagtcaatgcacatcaaatgttgacagaatgaaaaatgaattgcagttcagaagaatttttttcttgctatttcaaagaactaatttctgatcactatacattgtcatagattttataaagctgatgaattcgattggtttcagcagttttctccaatttttgtccctagggattactggtgaagtccctctgggtttaagtaaagcacaagtgagaccctctgctcctcagcttttatgtgcagaatctcacaaagtgaaattataggtgattataaaattcatcgctgtcagaagccagatgatacctccctgatagggtaagagttggtatcttctcagctgaaccagtaagctgaaataagaacaaaatacaaaatgagattcttcttagccacctgatctgttctgttatacttactgtagacaactaggttaagctttggttttcaacttaattttctctccaaaacgtctggtttctctctgcagcaattttgtatgtcgttatttgtcattgcctagtattgatccactacttccttcctggatctcaaataattcagctaatcccatgcccctgccatgaatccagcattttctggaactcatgttgtcaagttcccttatacaagggaaatacactagagcttcctctgtctcccatattcattagttggctgcacactgatgcatgaatggaaaagatatgttttctctgactggactgttagctttttgcactaccagtcaagtatctatcagaacaactgtaatgaaaactataaatctcaacctgagggaacagttaatgtgaagggttttcttgtttgtttattttgttctgtttttatggtctcccaagccctggtgtggcattaagattcaggatatgagctattgtgaggctattgtaacatcgtgggtcattgtgttaaacgtttacatttccattcaacttgacttttcctctcacataacctatccttcggaaaagtgtcagacattgacagcatagagaaaattgtggcccacacatcatgtcaacagaactgtgttcttgttctgatgtataacttgtaggttttagagtgagcactctctcaaattctgcagcacaaaatctagaaatgatgagatgggaatcacatctgtgaacaatggcaaagacaaagaatagtaagtgggaagtgacaaaaaaacgtgtctactgttcattgtgtcagtggccccaaaatcctagagaagactttgaatgattctgacaagttaaaatatgttggtaatgacaacgtagattattatctatctgaaggatacaaaaatgacttcagagaaggcattttaccctatgatttgctgaacacttttgcagaaaagacattgtattaaaaatgcccaatttgcaactgcaagtgtattgttctacctttatagagcagtagaacaatctcatgtcaaacttcagggctgccccggaggtcttatttaaatagttctatgtcccaggctccagatctcttcctttctcctgaagatgtcagtaaaggggcatcgtaatgatgatcctgggcccccattaaacattaaattaaattataaatgggagcctgtcatcattattatgtttttctgtatgtctaaaatagcttgttttattttattttatttattttatttatttatatttttttgagatggagtcttgctctgtcgcccaggctggagtgcagtggcacgatctctgctcaccgcaagctccgcctcctgggttcacgccattctcctgcctcagcctcctgattagctgggattacaggcgcccgccaccacgcccagataatttttttgtatctttagtagaggtggggtttcactgtgttagccaggatggtctcaatctcctgacctcgtgatccgccctcctcggcctcccaaagtgctgtgattacaggcgtgagccaccacgcccggccagcttgctttaaaaacaaaaactattactgaaaaaaaaaatgtgccaatgagattgttgaaagattagcattaaaaattaaaataagggctttaaagtggtggctcacgcctgtaatcccagcaattttagaggctgaaccgggcagatcatttgaggtcaggagtttgaaaccagcctggccaacatggtgaaaccccgtctctactaaaaatacaaaaattagccaggcgtggtggcacacgcctgtaatcccagcaactcaggaggctgaggcaggagaatcgcttgaacccagaaggtggacgttgcagtgagctgagatcatgccattgcactccagcctgggtgacagagcaagactccatctcaaaaaaaaaaaaaaaaaaaaaaattaaagtaggagtttatgcatgttaaaaagcttctccctgagataccacgacaacgtaactatccaaagcaatgcatcctctgaaagaccaagtcaccaggttttatattcttgaagaatgatttttagataatataagcaaatatagctccggcacggtggctcacgcctgtaatcccagactttgagaggctggggtgggaggattgcttgagcccaggagttcaagaccagcctgggcacaacatacggagacccagtctcctcaaaaaatcaaaaacttagccagggctggtggcacatgcctgtggttccagccacctgggagggtgaggctggaggatctcttgagcctgggagattgaggttgcagtgagccaagattgcaccactgcactccagcctgggtgacagagtgagaccctgtcataaataaataaataaataaataaataaataaataaaagcaaatatagtatataaggaatataaggaacataaagtttagcaaccctaaaataaggaatatatatgaaccatcaagtcttataaagatgtaaaaatatttcccaaggaatctgttattattcaatataatggcaactgttgtaaaatcatgtacatgagtggtgctcactaggttttgcaaacattttaaattgtttaaattgtacaagtgtttttgaaaatatctccatggacgtattctgaaatctccaaaatgttcctggacagtaaaaaatttttatttaatgggactcaacaagaagggagctagcctagggaaatacctacaattgcaccaaagcaaaagttaactcagttgaacatttctgatttgtaaaaaattgctgctgactttaaatggtgaaaataattgcttcaattattagaatgtgtccaaatatatatgtgtgtgtccaaatatatatatatatatatatatatatatatatatatatatatatttggagacggagtcttgctgtgttgccaggctggagtgcagtggcacgatctcggcttactgcaagctccgcctcccgggttcaagcgattctcctgcctcagcctcccgaaatactgttcctgatttggataacctttgcttgagaaaactttattcttcttcacctgtataatttattctggcaacttccgaatgtgttttcctaaagcttcttccctgattggaaggaggtttaatattttgtgacacatgcaaacttaacagcccctatgtgaaatattttctacttttgaaggtgtgaaactggttaaaatgttttaaaacttttcccttaattgcaaaggaaatgtatgtacatgttagaagatttagaatatatagataagccaataaaattaaataacagttctatgttgacactttttgatgtatatctttccatacattttctgtgctgtgcactcacacacatacacacatgcatccaaatggaataaactagtgaaactttacacaaaaacacataagccaaagtaataatgattaatatttggtagtgtggtttactaatacatactgcttgatatgagctttcttggaattttaaatgtaggtggaacccaaacctttttcaaaattttactttaatgcttttaagtttgagttgtagtggtaatgcaaatgtcattaccttgaaatcattctttctcaaatgatagagttctcacaatacacgccaggaacgtactgatgggattttatttgtgtgcttgtttgttttcattgaactgtttgaattaaactcttagaatcattcttatggtttgaatcgccattacttaaaaagtaattattattatttctgaaaatatctccagtaattacatctacacttgatcttagccaaaaggccgagaagcaatgaataattacatctacgggaaaaaaaatgaacaccaacttttagcactactttttttccatgtggtggaatgcagaatgtttattgtttacttatgttttacgtctgtatttttcagtgtttcacgaagagcatatattgatttttataatcagaaaaagaaattcgttaaaaagaagtaacaatgactgaaccattttccacctgatacagaactacatgagaaccatgggttccagaaataacaggcctattttgttttgctcagtgatacatctttgaggtcaaactcccagagtttgtgccgtctcttacaaaacagcctgagtgggaatctggttttcctttttgggtaaagtttctacaaagcttgctgataaaactcatcttacttttgcaaaacaattcccttactttgggagccaaacagagatgaagctgataacaggactcagttcttcaactttaaagcagaagctagggtcataaagacatggagtcctaaaatactcttccaaagtacagtcgcatccagctaagataacccttggaaacgtttgctgaaaacatgcagtttgttcatgcatctcttccatgttggtcctttccaccttctgtcacaagccacagaaactaggggaaggccagggagcaggttcagctcatcttcacctgaattctgagaaattattgagaatcaaagaaacctcagtgagacgttaacaaaaagtaatctgagtgacatctatgtaaaagtcattgcaaagcacactagctgctagacatatctggggagctaccaccaatgcactcccttgacagaaaaccaggacacctcttagatgagctccttctttagtggaaaacccttatgtaattttaattgacatcaatgcaaatcagcctgtattgattgagtgtgcctaatatacgcttaatactgaaacaagttgaagtacctctcatagaccccccattgacttttcgtctgacatcccacacaaccagctccagctttgatggaagtcacaccatcactctaatgttctcttctatttttgattcctgccttgaaagtcaggatgaactggtgaagataagacttctttaaagtacaggagaaatctattggcacagaataaaagcactaatgtttattagagttgtgcaaatagctgttgtacttagttctgtcaacattgcttttttttttaatgatgacaattcttcacataattgccaagctaaagcaaaagaaaactttctcaatctttatgatgctttcatcagataaccaatataaagtatcttccagaagactctgtctcctcagactttagagtttgttctagggaagttagagataaacaaagatggccttaataaatctctctaacgttataaatatacagtttctggttctttttccccttggggcagtgggccaggtatcatcaacaatacagatattctggcctttctcaaaaatgtcattacattaagaacattatgacttagcaaattgttggagaaaattaggaagctttttttagtagttctgccatcattaaaaatcagctgccttctggggaaactgatgccacacctttgatcaggtgttgtatttggactgaaaacaatcccccaaagaaggagatgtttgctttctaaagaatgaagctccagggagggtatttaaaactgatttttggcagccattaacaaacaagcatgacataattgtatttggggccaggagtgtttagaggggtttttgtttgttctattgttgagaatttggaggtaaggagtccctgaactgccattacccctgcattggtttgctagggctgccctaacaaagtaccacagacaggtagattagaaacaacagaaattcctcacagttctggaggctggaagtccaggatcaaggtgacggcagggttggtctctccccacgcctcctctgtgtgtgtctctgtcttcatctcctcttcttataaagacaccagtcaggccgggtgccatagctcacacctgtaataccaatactttgggaggccgaggcgggcagatcacaggttgagaccagcctggccaacatggcgaaaccaaaaccccgtctcttctaacaatacaaaaattagctgggtgtggtggcgtgtgtctgtaatcccagctacttgggaggctgaggcaggagaattgcttgaacctggaaggtggaggttgcagtgagccaagatcgtgccggtgcactccagcctaggcgacaagagcaaaactctatctcaaaaaaaaaaaaaaaaaaaaagacaccagtcatattggattgaagcccaccctaatgacctcattttaatttaatcatttctttaaagaccctatcttcaaatatggttgcattcccaccatatttaagatcctttctccaaatatggtactgggggttaaggctttagcatatgaatttggttggggggcaggtgcacagagtgcagtccctaacaactctgattcaaggtcttttcaccaaatccataagccctttgctttgtagttgtcagaagggaaagagaggagacaggaagatattcatggcttttccacaagagctgactagcttctgcagcaaatgtttttgtttttcccctccttcagtaatggatagctaaaaagtccactgggaaccttgagagcactttgctttctttccctgtatttctttgtttcccccaaacagaagtgtgcctctgtccctcagcatatgtcagttaggaaaccactctccttgtgtttgcatataagggatgggaaagagctagtcagtgaactcggccaatcagaggctttgtaactggcagataccttggagaaaaccagccacctgttgtgcacccacagtatacctgaccctttaccaagcatgacatgttctctcatttactcctcctaacatccctgtgaagcaggtactgttgtcaaccctagcttgcagatgggacaagggaatcttggacaagtgtggtaattggtgtaaagtcccagagctgagtacactgtggagcaaggatttgaacccaagaagtctcattctagaacctttgctcttaatctcttctaacacctttccctagtcttattggtagagaagaaacctgtatgtagagaactaaccatatttttctcagcacccagtatcgagaattgtctcagggcctccccgaagacctagcttccagttccagctccactaatcattgctagctggtcttgacatagtcaattaacctctctgagctcgtattccatatgtaaaataggagaattggattacggccatgtttctcaaacttttaggctagatccataaaaagaaatacattttatttggcaacccagtacacacacaaacacacacacacacacttcataaccaaaacaagtgtttaataccaaaatatccatccttattacatgtgaatgccctctgatattttctattctaatctattttcatgatttttaaatattaattgtgacctattctattggatttgtcaaaaagctgaactaggtgacccagtttagactcctggaatcctaaaatcctgttaatctatatagatgtctgtttggagcttctcatatcttgaatgcatatttattttaaacaaatgaatatcacatattacaggggacaacatcctttttacctctggtatgagttaactgcatcatggaaataataataattacttctatttattgtgtacctcccatgtgccagggctttaaaatgcagtatctcctgtagcctgtaggtggtaggtattctctctgatttatagatgaggaaactaaggatctgattaagtaatttgctcaaggccccataggcaccaaagctgtttgaaccaaggccattctaattccaaagcccttacattcaacattcttttcagaggagggtatataaaggggtttagaaggagaggtaaagtctaaaagctaccgcagctgcacataatttatttcctaatagtttgctgtccgtggcagaaatgactgccctctggggtgtgaagccaccgctgcagcaatgattgaaatcacctgggaagcttaaacaatcgccctgccctcacccaggccacccccggacccgttaaatcagaattgctaggggtggaacccaggccttagtggtttttaaaaaccccaaggtggttctaatatgtagccaaggctgggaaccattgctctgaaatctcagaaattaaagagctgtaaggagcttttctattttacctcctgcaaacaagatttactaaaatactgcttaaagctctttaactgcttccacagagctgaagtacaggacctttgctgtttctttggggcacacacaaaaatctgataaacaaccttgtatctgcttttcaacacacctagagaaattagagaatgctaaggatgtagatgaggagatgtttaaagcaactgtggtattctggagaatctagctccgagatactttataactcagctcatgtcattttgtttttcatttcttatttttacttatttacatattttttcagacagagtctcactctggcaccaggctggagtacagtggtgagtcacagctcactgcatctcaaattcctgggtaattctaactctcccaggattggagtctcctgagtagctggaactacaggagcacaccaccacagccacttcatttttcacatttttttttgtagaagtggggtcttgctgtgttgtctgggctggtcttgaactcctggccccaagcgatcttcccgcctaagcctcccaaaatgttggaattacaggtatgagccaccacgcccagccagctcatctaattctgaaagttatttttgtatgaatggagaagtcggttgctgaattagcagaattgagtgtgacctgtagccataggcgaagtggactggggacaatgtagaatgccaacaaagactaaagtcactgtaaatatgataagccatcacattttcttaaaaagggctgggtgtggtggctcacagctgtaatcccagtactttgggaggccgaggtgggtggatcatttgaggtcaggagttcaagaccaacctggccaaccccacctctgctaaaaataaaattatctgggcgtggtggcagccacccgttgtcccagctactcaggaggctgaggcaggagaattgcttgaacctgggaggcggaggtcgcagtgagccaatatcgcgccactgcactccagcctgggacagagtgagactccatctcaaaaaaaaaaaagggttgcgggggaggcctcagtgaaagatttccactttttcacatggattatggcaactgtggtgaaaccaggaagcctctcccaaagcattttccacaggaataggatgaagtcattttactaaccttccggtcttacccaactttataccaggattattgcagtgtgtgatctatttgccatttgaaatataaatgatcaacactcaatttcactgtcttccatgaaggagtcttcaaaatgggggctgtgccatactgctgggttttttccacatctcaagccacagcattaataatgttaaaaatatctgcaattttcatacttcagacagtaaaagcacggcattaccataaccaagaacaaatgcatgctgttctcaaagatgattatatgtttcttttagaccccttaacagacggcaggtcctgaattctcctgcttaggccaacatggatagaggtgctatgcgtctgctctgtctgtagtaaaagcccccgatgtttgactgcttacagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtggtgagtccaggtgcaatgttgcctcttcacctcatcacacgtttggagtatttaggagaactagtagcttagctaccttcacgctccttgcactgaaggaagcttcttcctgggctgaatgcatccgctttctcctaccctgtttaaagttcaagctttctgttctgagatactgtagaaagtgtttttatcaacctttacagagcaacatgtgcctcccactttcaagtccacgcgtctccattgcttttcttcttctttaaggcattttctttcttatcctatttttttttccttctatgcttgggtgacggtcctgttttctcagtctcccaaacctggtccttatgtcaaggagatgaatgacgctgccaccttttacactaacagggtcttaaaggactacaaacacaggtacgtaccttcctttactcaccaaattttcagttgattacttgttagacatttgtccctaaaactcagtccagttaactactgattcctttccaaggctctacactaatgtactataaactttaaaggaaaatctaatctttgcagataaagtcaagtggaaagtggaatcaattatccagataatatatgggttttagaaagtctgcctcagttctctcataatgaataaactctccccacttgaatgcatgtcactatcttatgtattcccacaataatcagagagcttggtgatggaacaaccctatatggtacagaacctttacatgcatcaaagtagagttggagggtgagctatagaagagaggaggaatcaggaaatgaagtgtgaatcaagaacagaaatgaggtgaaacaacaaaccagagcagtgagaaggaaaccagagactcagttaatatgaaatacaactggggtgtacgcagagacacctggaagactagcagccattcagagtgctgctgaaagtatagatgagtctaaaccaaggggctttgcctggtgaaccagcgtgaaaggaccttgcgttcgacagcacaagtaatagatcccagagtaacttaaactggagtcagaatagaaaataggcccaaacggagacatggcagagctgaagaaatatccaggaaaatgtgtcctaaactatttaaaggatatcatgagattccaacccctctgataaggtcgtgccttgtactctaaacagctggctaaatgtgatgtggctggtgcctaggaactaagggaagggatgaggcaaatataagagcaacaaggttctacctgcttctggccctggactcgagagtggatctccctctgagctcttagatggcagcaacagaagtgaccattggtcagcaaatgcagaggcacctggggacgtctcatgtgttgacccagactgttcaggtggaaggaaattaaagaacctgcattattggattattgcttcaattcaccttctttttttttttttgagatggagtctcactctgttgccaggctggagtacagtggtgcgatcttggcatcttggctcactgcaacctctgcctcccgggttcaagcgattctcctgcctcagcctcccaagtagctgggactataggtgcgcaccaccacgcccagctaatttttgtatatttagtagagacggagtttcaccatattggccagatggtctcaatctcttgacctcgtgatccgcccacctcagcctcccaaagtgttgggattgtaggcatgagccactgtgcctggcctcaattcactcctttattttactaatgcagatctgaaaattagaaccagaagaaaagggtctacaacaatataagacaaattttatatggaatatagaaaaattgcataaaatacataaataaatacctagtatacttccaggccattaattaatattacatattcaaaattttcatcactttttttgtagatttttttatttttaaaaatattgagtagatacaaaagaatatttataaaatacacacgagatgttaaggattacaatataaaaaaatacctatacatccatccctcaagttaagaactatgtaacaatatttttttactataaaaagcagaccaggtgtggtggctcactcctgtaatcccagcactgtggaaggctgagacaggtggatcacttgaggtcaggagttcatgaccagcctggccaacatggtgaaaccctgtctctactaaaaatacaaaaagccgagcgtggtggtgggcacctgtaatcccagctactcaggaggctgaggcaggagaatcacttgaacccgggaggcggaggttgcagtgagctgagattgtgccactgcactccagcctgggtgacaaagtgagactccatctcaaaaaaaaaaggagccatatccagcaattccactcctaggtgtatttccaaaagaactgaaaacatatgttcacccaaaatcttgtacacaatattcattgcagcattattcataatagccaatagatgagaacaacccaaatgttcatcagctcatgaatggataaataaaacatggtatatccacacaatagaatattatttggccataaaaaaaaagaatgaagtattgatacttcattcttttattcgggcagcagcatggatgaaccttgaaaatattgtgctaagtgaaagaagccaggcacaaagactacatattgtatgattacatttatgtgaaattccaggatagtcaaatctatagaaagagaaagtagattaacagttgcctagggctggagaaatttagggaaaacttaaactttttaaaatttaagtttttttttaagtttttagtttaagtttttagtaatgattcccttttggggagtaattgctaatgggtgtagggtttcttttggggggtgatgaattatgttctaaaattgattgtggtggtgattgctcaactgagtgataactctgctgagctaaactatggaattgcacactggaaatggttgaagtgtatgggatgtgaattgtatttcaataaagctgttttatttcaaaaaacaaaaagaaaaacaaacagccattgtattcccctcacagaatttagtcgttccatgttgcttttgggaagaggagctttagcagacagaacgccgaattccagggtcttcagtgcgcctcttttcctcttaggggctctgcccaccccgagaaaactttggttaaaacagttgtgctcagttacagactttttgcatcaaggcaattgtgcccaatgatatgcctccaaatgttgccgtgttgtattagagactttagaactgtgcggcacgcatgagaaaggcatcagaaatgcaagatggtctgttcttctgacataaaaataacatttcagaaaagagcaagtttcaattcccaaacctggatatcatatgacagcatgaacatacacccatggtgacttcttttgttccagatatacagacacacacctacacatgccagttcaggacagctcaagcactacctaggtttctgcctttttaccttccacccttggagactattttaattagtatctcagttcatcagctcctgtccttctcccagtccctccttgagtatatgttggggctgtgggtgtgaggggttctccccaggtagcagcatagtcaaaagggttgggcttttctacatgctttttgttcacaaagagggttcagtatttgcccctcagtgttaactctagcaattaagtagaaaatgtacttccagtagtaccaaagatgactcagttaagctcagtggactacctcaagactgtacaagaagccgaagaaatgcagctggaagtgcaaatgcattcgttttactgctaggagtagtcaaagcactcccaggtcacccttgagcttctgaaagcggactaagcagcatactccacaccatgcaacacccatttaccggtggactcaagcccgtggtgccgtctctgtgtcgcagtcatttgtgcgtcactgctgcccactgggcagtaggaccgtaggtagaggagtagaaaggcagacttccttgaggtttaaacaggactgtgagcagtgaaatctgtatctgtgcaacgcttaccaccagcttgactgctcattggctgtttttctctttcttttttattttttttgatacagagtctcgctctgtcacctaggctggagtgcagtgacacgatctcagctcactgcaatctccgcctcccgggttcaagcagttctcctgcctcagcctcctgagtagctgggactacaggcatgcaccaccacacccagctaatttttttgcatttttagtggagacggagtttcgccatgttggtcaggctggtctcaaactcctaaccgcaaatgatctactcaccttggcctccgaaagtactgagattataggcgtaagccaccccgcccggcctggttctttcaatatatgaatacagcaagtcatttattttagctttatagaggtgtggtctctctgagtcataatcattaaaattcacattcccctaccatagcttcttccagagtatatgaaaactgaagataggtttgcagctcctaatgtgtatttgggtcctgctcaatttgttaccccttaaagactgatttcaggtaaaagggcaccatactcttagtccttattacaagttttgctagaacgttcttcaagtcaaaataatactgcattggttaaaaaaaaaaaagaatttgcccatatagacttgaatttcatccactgttaaattttttaatggaaaatatactgaatcagacatggtggctcatgcctgtaatcccagctctttgggaggctgaggagggaagataccttgaggccaggagttcgagaccagcctgggcaacatagtgagacctccatccctacaaaaaaatttaaaaattatctgggcatggtggcgcacatgtagctgtagtcccagctacttggaaggctgaggtgggaggatcacttgagcccaggaggttgaggctacagcaagctatgatctcaccattgcactccagcctgggtgacagagcaagaccctgtctctaaaaaaaaaaaagaaaagaaagtatattgaatgtcaacatgctatttctataatgtccacaaacatacatgtgtgttgtatgtacatacacatataaacatagacatatgtgtgtacatttatattgaagtaatgttcatgctctaataatagctatgtgtatactgcttcctatgtgctaggcactgtactaagacccttataagaccctacagacttaggaaactaacaagagagaccgttggagctacacttagtttttgagttttgactgtgaaggtgaggtaaagcgacaatgagatttttcatacatttgatgaatatatcagtacatctaaaaatgtagaacaaaaccacactcacattttttctatttgtggagtgaataattgtgacttcagttcccaatttcactccttctaaatggcatgccttaatacaataggattctaaacatgctggtggtactttagggcttttcaaggaaaacaaaatatgtctagagacaagtcattattacaagagctttaataatagagatttccattcatgattatcttcagattaatggcccaggaacataattaaatttttcttaactcaaatgtcattatttttgcatttaccttgacttctataagtgagaaaaaatatattataggtaaaaattgccgaaaggaaatgcaactatttttacctatctataagtttaatatttctaacaattctttcaatcttgtatgttaatcccattataaaaggtaagcattttactagcccttggttcaataaaatagagataaaaatactggtgatgccttgcctggtttgtattgtcattcaaagtattaaattaagggaatttaagtaaatgtccctttagaagtaaggggtgttacctgtttgtaagagatcaattttcttcctataccaacttctttgtcagtcataatggctaaaattctccaatttggttatacttttaaccaaataattcaacagaattattagaaaatgaacccaatgactttttttttctttttaataccattctcattcctgggagtatattgtctctcattttgcatcagaagcagtgcagaaagaaacagtctcccctccacgcccccgtcacgtgagggctgactgggacagtgcaaggacaccctactcaagtcagcttagctctgtcgggtcccctctctgtggtacctctgctccatacccggagctcagggcatccggccacctgccgcctcccctcaggagagtactgggccagcttcctcccagggttcccttctgaagcccttcacggtgcctgggctgcaaggacgattgctccgggctccagggcccctagtcactagataaccatgtgcccccacaatttttttaaaattttattttagatcctaactctgctttcttcaaccctctttcacaacaaagtgatttgcgtcatgtggattgggtgaagtcatatttgaacatttggagtgaacttcaagcatacatcaaggaacaccacaccacgggcctcacatggagcaaaacagtgagtacgaggccttcctccacgtgtgtaaaaaaaggccatgactatatatacaccctgtggcccagtaatctcacaccttaaaacttacctcaaggaaaatgtaagattaaatgtccatgtggagggccaggcgcggtggctcacgcctgtaatcccagcactttgggaggctgagctgggcagatcattgaggtcaggagttcaagaccagcctggcaaacatgacaaaacactgtctctactaaaaatataaaaattagccaggcatggtaacgcacttctgtaattccagctactcaggaggctgaggcatgagaattgcttgaacccaggaggcagaggctgcagtgagccgagattgcaccattgcactccagcctgggcgacagagcaaaactctgtccaaaaaaagcccatgtagaaacggtttatggaaatgtcatttgttgtaggagaaatttcggagctccctacataacatagaaaagaaatagaaaagaaaatggctggcagggcgcagtggctctcacgcctgtaatcccagcactttgggaggccgaggtgggcagatcacctgaggtcaggagtttgagaccagcctggtcaacatagtgaaaccccatctctactaaaaatactaaaattagctgggtgtggtggcacatgcctgtaatcccagctgcttgggaggctgaggcaggagaatcacttaactcgggaggcagacgttgcagtgagcttagatcgtgccactgcactccagcctgggccacagagtgagacttcatctcaaacaaacagcaacaacaacaaaaaaggaaatggctaagtcgtccatggtaagaatgcaatgaaacactctacagccattaaaatgctttaccagttaatgttaagtgataaagtcaattgcaaaagtttatgagtattaagatgatgtatatgttaagaaattgcgtgatagaggctgggcacggtgactgtaatcctagcactttgggaggccaaggtgagtggatcacccgcggtcaggagttcgagaccagcctgtccaacatggcaaaaccccatctctgctaaaaatacaaaaaacagccgagcgtggtggtgcacgccataatcccagctactcaggaggctgaggcaagagaatcgcttgaatccgggaggcggagattgcagtgagccaagatagtgccactgtacttcagcctgggtgacagagcaagactctgtctcaaaaaaaaaaaaaatgtgtgatagaaattgaagggaacaagaaggtttgaagacaggtgtacatggaaagctatgcagccataaaatagaacaaaatcatgtcctttgcagcaacatggaagctgctagagaccactatcctaagctaattaactcaggaacagaatgccaataccgtgtgttcccacttacaagtggaagctaaataatgggtacacgtggacataaagacgggaaaaacagacactgaggactgctagagataggatggagggaggagtccaaggactgaaaaactacttactgggtactgtgcctactacctgggtgacgggatcattcacacccccaaacctcagcatcatacaatatacccacgtaacaaacctgcacatgtatcccctgaacctaaagtaaaggttgaaattattccaaaaaaaagagaacaagatagatgtcattttaatgaggtggaattatgattaaaatgtcctttaaatgttcttaacttctcttttagtgttctaaagtgtattgaatagtatttttgagtacctaggcaatcctaggactttggtatcttagtagcagcataagatcacagcctgtgtctgttcccactttaattcccatgtgagatgttgcgctgacctttgcccctttcagctttatctctcacatcctctcccatgtctcaccgtgtgttccagcaacccctcactccttgtggtatcctgaacaaagccagtgcttggattgcaccaaatgaaattgatgttgtttcaaaatttaccgaactcatattgtgtaacctttattgcaatgtcctgaacctatatcctgctgtataacctaatttcccccggggaggtacccctacctcttctgcaagactcacctcacacatcacctctttaagaaacttccattgatctccatcagctccccatctgggttgactggctctgctctctgtctgcctcctttgcatcttgagtatacctcagtcatatccttagcatgtggaatggtgctttactgtgtgcttttgggactctcccactagattggaaactcatctcttgtctccagcccctagtatagtgcctggcacagagtaagtgctcagtaaatggtttgaactaaatgatcatgaggggactcttagaatgtttcttgcccttttgaatctctgcacttgcttttcatggaaactcctttccattagaaattaatgttacagtggacttaagggacttgagggaaaggttgggagggggctgagggataaaagactacaaattgggtacagtgtatactgctcaggtgatggatgcaccaaaatctcacaaattaccactaaagaacttactcgtgtaaccaaacgccatctcttcaccaaaaacatatggaaatcaaaataaaataaagaaattaatgttaacttgaatgaaacagcttctttgtgaattccattcagaggtaaaactcactgtcctgaaagcagtaccccagcacccaaccctccatgctggatgtccctgtcagtatagtaagcaggcttcatgccaaaggagagtttgtggtttttcaagagagtgtggggccttctacatttgttttccaacacttttacaaatgttaacacgacccttcaagactgatgtttctttttatattctacttcgcctattttctccatagcactgaaatgcacagtgcaagatacaactaagcggattgttttttttttcctaaccacaacattgtgacttttgagaagagaattcaaaaacatgtgaagggttttaataagtaagggtatgtgtggatatggatgggtgtttatgtagactaattggaattattttttatcgatttccaatgagatagtgttttgttgtacagccatgtatcataaagagaaagtgtcacatctttgccatggtgatagatcattattagagaacagtaaaatgaaaatcaggagcccttggctctattattatttcatggtagataaaggccagaggaatgagaatccatttatggaaaatagtgtcaacaaatgctagcctgttaattctctaatggtgcccatggaaaatgaatagaaaattacttttaaatggtttgaatacctttaatgcaatgtgcaaagctgagtaattgtgtttatgaatataaaagagaattgattattaattacagaaaaatataaatgtagttgtcttcctttgttctaaagtgaatacttattatgttcaagcttcacaaaacaatacttgctcttactatgtacaacacattcagatattttattttttatttcattttttataaaattctggctgagacccaataaattgatttcatgaccccactagtgagtcatatctcacattttttaaaatgtgttataagctaggtgtggtggctcacgcctgtaatcccagcactttggaaggctgaggcgggtggatcacctgtggtcaggagtttgagaccagcctggccaacatagcaaaacactgtctctactaaaaatacaaaaattagccaggcatggtggcgggcacctgtaatcccagctacttgggaggctgaggcaagagaatcgcttgaacccgggaggcagtggttgtagtgagccgagatcgtgccactgcccttcagcctgggcaacaagagtgagacttggtctcaaaataaataaataaataaataaatagttataaaacgtgttacatttatacaaaataaatatgatccatagagcacatcaggcatcatggattgccatgacagctgttatttatattatacatattatgtgctcacataatatgccaggggaatattctattcaaaatggtaaaagcaaagcatctacttcacttctctaatggaagagaaaatgataaagttttggtcagatattaaaaatgattaaaaatcttttgtcaagctttaaaacatatgcctagaaatatatttcctgattttttatcttattcttccaaggtttgggcagctattaaaaagtacattataacaattatatttttgaattttaaaatcaaatttcttttaaattattaaaaacgacttaaagattccaaagcatagtccatagcataaatcaagctaatttctcctctctgactgtggcctgtcgacattccagcaaaatggaggataaacagttatagccagagttgcagcattcttgcagagaagagaaaaggactcctagaatcatctgattgaatggtctttgggaggaaaaaataaagcaagaccatttcatttgtttgcccactgatcacaactctgtaaaaactatgtatttataaaatgataaatatcatgaaagactatagaaagatgtggtgttgatgtttgtggacaccacagtattcagagattttttttttaatttaatttttttgtttttttgagacagggtctcactgtgacacccaggctggaatgcagtggcacaatcatggctcactgcaaccttgacctcttggactctaatgatcctcctgcctcagcctcccgagcagctgggactacaggcctgcaccaccacacctggctaatttttttattttttgtagagacagagttttgccatgttgcccagggtggtctagaacgcctcagctcaaggaatttgcccacctcggcctcagaaagtgctgggattacaggcgtgagccaccacatccagcccagaggtttttcaaaaaaacccattccatcttaacagacacagtccattgcacaaaactcctacttgcaccgtgaaaagtttatgacgacttaacatctcaagtactttcagtaattgttgtttttttctattttcaaattggattttgagatttgcactctgtggggtttttagtgactgacagcctgctgtttgagacctggactgtccaagggcacgtggctctacaaaatcatccttccctgagttaacagttggagctgaaagtccctgatcccatctcctaacctctgcctccagaccgcagctgtgtcaggcaactgctgccctgttcagttgtcagggtgaaatgccaaactttgagaccagcgatttgaagagagtctacgtgtgtgtgcaagtgtgccgggtggggtggggtgagttgggtgggaggaggcagctgtggaataatctgtctgtaatgtcttcttacatttaccatggtaaatggaatcttgtcatttctatgagcttttttccaacttattaagacagctgtcaactagaaagaccccacaccagaaactaacttgctgttttcagttagtttcatccttgggactggacctctttttcatatgagtttgtgtcatttcctcagtgctaagtttcaaatgcacttcgttgaacaaattgatcttttggcacaaacccattagcagcactgttacttaggatccctcgcagttggtcagagctgtaatattccttggcatttccttcaaatcagataactaaagtcgaaagactaaggcctagtctttacccttataattattgaaataattgacttttttcctacaaaactcttcatttctgtgaatctataaatgcagactattatcctgttctaaaaacagactattatctgttcagaaaattctgctcagataaaggtcatgtaaagaattctatgattaggagaaatgtgattattttattaactttcggttgttaaacttgttgacatatttctgtcctttcctatatttctgaattactttagctttgggatcaaataagatataattatttgtagagtagaataaaactgcacatggatgaatgtatatacagtcttatgtaatagtgatgtagttctattttttttgttgttactgttttttgttttgttttgtttttttgatacagagtttcgctctgatgcccaggctggagtacagtggcacgattgcagctcactgcagccttgacctcctgaactcaagcagtcctcctgcctcagcctcctaagtagctgaggctacaggcgtgcaccaacatgcctggctaatttttatattttttttgtagagacgtgatttcaccacgttgcccaggctggtctcaaactcctgggctcaagtgatccgcctgccttggcctccctaagtgctaggatgataagcatggtaggatgataagctgcacccagccaatgtaattcttaataatacgggttttaaaaatccatcctatacactatcatccatcctagcctctcctgaacctccaggaaaatgcaagtcgttggtggtggttacaattatagacaaggtggcgtttcatttttcccaaagcaaaatgctttaggatcacttcttttcctccaggtagatatttcttttctttctgtttcttggtgtaaaggccaaatgtctgttaacaaagtgaaagtttaatagcttacttttgatcaaattaaaactcagccagagggtatcccgacttattataaataatgtagactctgtggcatgtcattaactatgaatatgtatgccttgtacgttttcaagtcttcaggcctctttaccttcctcttgctatttacaagagaaaactgttcttaagcttttatatccaaattttcatttagaacttgtaccaaacccacaccttaggggtattaatcaaagtgaatgggcagcgcctcagatgatgtgttggttgtctgatgacaaagctcactgttctctatggctcttcccacggagtggccctggccagtgtacctgaccacagctgcgtcgttctacttagttcagtttgggcttctaggtcccttctggggctctgggtggccagttactcttattctcttatggaagggttccacattgctcaacaggggttagaagtgtcatcaactggctgggcgcagtggctcatgcctgtaatcccggcattttgagaggccgaggcgggcagatcatgaggtcaggagatcgagaccatcctggctaacacggtaaaaccctgtctctactaaaaatacaaaaaaaaaaattagccgcacaaggtggcgggtgcctgtagtcccagctaccgggaggctgaggcaggagaatggcatgaacctgggaggcggagcttgcagtgagccaagatggcaccactgcactccagcctgggccacagagcgagactccgtctcagaaaaaaaaaagaagtgtcatcaactaacaaagaagcctcaaatgcacaggtagatagtaaagttaggttggaagtggctgtgagttcagcctgacagagaccacataattaaaccaatatggcttaagcatctactatgcactgagttctgggcaaggggctaagaatacaaagatgggtagatggcattgtggacacgattcctgtccacggaaacgcgcattctagctgaagaagatgagcaatgcaccatgatagaacagggggagcagtgtgctagggaatccacacaaggcatgacgcttgcatagaccaggaccacgtggaagatacggcccatcctgtagtgcagcatggttctggggccaacagcaacctgggcacttgttagaaagctcaggccccttgattgggcgcggtacctcaagcctgtaatcccagcactttgggaggctgaggcgggtagatcacctaaggtcaggagttcgagaccagtgttgccaacatggtgaaaacctgtctctactaaaaatacaaaaattagctgggcgtggtggtgcagacctgtaatcccagctactcaggaggctgaggcaggagaatcgcttgaacctgggaggtggaggttgcagtcagcctgcattgcaccacgggactctagcctgggcgacagagcaagactctgtctcaaaaaagacaaaaaggaaagaaaaaaaaagaaatctcaggctctcaggccccacctcagccctcccaaatcacaacctacttttcaacaggattcccaggtaatttatatgcatagtgaagttcgaaaagcactgctctactgtatttaagttgggccaaaggagttgttatagggaaatcattcacttttacacgttcatttatttagtaattcacttccttggtaactacttattggctacttaccatgtaccaagcacacaccaggcattatatttatactacagttcttccgtgaagcagcagggtttttattatgatgcataaataaataacagcaatacaaagctaggttggaaaataagccttgtgaattagactccttcctgggtgggcacgaagagccacaaaagggctgacacttgatttggatcttgacggtgagcaggagttccctaggcaaacagtaaagggaagggcagttttggggcagagaattcagcatatgtacgtaagacatgaacaatgtactttgagagaaaggctggtggttttgcagagctgaatgtggcaaaaggtgaggccagaaaggcaggttggggccagatggtgaaatccttatgcattatgctaagaaggtggggctatgtagtgtttgaagttgtttcctttgccataggttttgttgtttgttttttgtttttgagacagagtctcactctgtcgccaggctggagtgcagtggcacgatctcggctcattgcaacctccgcattctgggttcaggtgattctcctgcctcagcctccagagtagccggtactacagccatatgccaccatgcctggctgatacctcaggtgatccactcgccttggcctcccaaagtgctgggattacaggtgtgagccaccgtacccagcctgcatgggttcttaagcagaaagcaacacactgtgaataatgacttaggaattgcataagatagatggagaggggaagagattagaggccctgatacgtgttgggagactttagtggatggctagagggtgaggtagttagtatgtgacctagagtgtgacaatggcaatgcaaagagatggagtagccactgagttggaggacaagggacataaaatctaacacaaaatttccaatctggaagtctgggagagaatcgtggtaatataaaaatagggaaatcgcaaggaggagctggtagagaaggaagaaaaatcttcacctggggtttcactgcattgtgtttgaggtgcgggaggtataggagagacatccaaacacgtggagtcaggaggtgagatttagatctggaattcactgaagggggagaccccgatgtacgtgttgggagtcatctacctagaaaagaccggcaaataaataagatggttaaaaaagagagagtgagatcaaggataaaaccttggaaaacactattatttcaagaatggggtaaactaatcaaggagacaagagataggagaactagaagaatggagagtctcaaagctatagggaaaacaggctggccagtgataccaactgtagtaagctgtggtgaataaggattggacaaaggctgtcatcagccatgtttaccatgttattagtaaccttccaagagcagtttctggaggactggaggcagatgcagttttacagaattaaggagtaaaatgtttttgtaatcaaagtactttgggaggttgaggcggttggatcacaaggtcaagagatcaagaccatcctggccaacatgatgaaaccccgtctctactaaaaatacaaaaattagctgggcgtggtggcgcatgcctgtagtcccagctactcaggaggctgaggcaggagagaatggcttgaacccaggaggcagaggttgcagtgagctgagatcgcgccactgcactccagcctggtgacagagaaagactctgtctcaaaaaaaaaaaaaaaaaaaaaaggagtaagaagttttcctgtaatgatctcttgattatttctggaccagttgtctaatttgatggattatttcttatggcttcaatttactgccttttgaaatttggggtatttgtgaattttcattttaatctgtgctatatcttcaatagaataggtgaaaaatagtcaaatatctccaatttcacacacagtcattaagagctatactgtgaagctctaagtaaatgtgttctatttagaactgtttttattatctcataaatacctttgagttttagtgtcagttgataatgatgcagggaaggtgaaccccaaaagtggggcttagccaggagggttcttggctttgcccaggcgagaattcaagggtgagccagcggtgttagacagcagcttctatggcagcagcaatgtgcagcagcagcaggggtaccataggaactgtgcccagagtagcagctcagggaccattctgccattatatttatattcacttttaattataggcaaattaagggggaagttattcagaaagttctagaaaagaggtgataacttccaggtcattgccatggaaaggggtagttagtaacttccaggtgttgccatggcagtggtcaactgacatggccctggtgggcatgtcttctggagaggtgctttcacctctttcccccattgcagcgagtcttcagtctggtttggcattcaagtcctgcccagccccagtcaagcctgcctcataccttaataagaatctataaatattttagagtatttcttttcttttcttttctttttttttttttttttgagttggagtttcgctcttgtcacccaggctggagttcagtggtggcatgatcttggctcactgcaacctctgcctttcgtgttcaagcgattctcctgcctcagcctcccgagtagctgggactacaggtgcgcgccaccacacctggctactttttgtactttttttaaaaatagaaatggggtttcaccatgttggccaggctggtctcgaaatcctaacctcaggtgatcctcccgccttggcctcccaaagtgctgggattacaggcatgagccaccacacctggccattttagagtattaaatctctctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaaaaaaaaaaaagaaagaaaaaagaagcttctccaacctctgcttatcaccatgcccaccacaagctggaagttatccttccgtcctcagcggctgcatagcacttcttatactctccatttcttttgtgttgcttagcatttcctaccttatatggcagttattttctcattcagtaacatgtttatgaagcacttaaccatgtttcaggcactgtgccacattgaaacatggaattccctcctaagagagttccaaaaaccctacgaaaggaggaaagacacattttggttgaggcttgaaggctgttttccagatagtcagttgggcaagagccttccaaactagacacgccctgagcaaagactcaaagtctgggagccaagtgcctgccacgtctgggaacacagaagtatcctctcttcctaaactatgagctcattgaatgcaggctccatttccagttcagcctgagatcagtagcagtgactggtaccctggttctgggacagcagtgacttgaaaacagataggattcaaacacatttgctaaatccactgtattcatttgtcatcacaatgaaatttccaaagcgttagtccattaactatagatcatgtctgtttttcaaaagctgcatgaaaatgtgtcttttttttttttttaatgatggagtctcgctctgtcgcccaacctggagtgcagtggtgtgaactcagctcactgcaacctccacctcccgggttcaagctattctcctgcctcagcctcaagagcggctgggattacaggcacgcaccaccatacctgactaatttttgtatttttagtagagacagcgtttcaccatgttggccaggctggtctcaaactcctgacctcaggtgatccaaccttctgtgcctcccaaagtgctgggattacaggcgtcagccaccgcacccagccaaaatgtgtctttccttctgtccagtgataggaatggaatggacaatgcattttattcaggaacacccatcaaccgcccacacctcctctgctcctgtcccttgtcacccactgcctttcattctcagttggtataaactcaggaaacagaaggtagtattaacttaagcaaaaactgttttcttaaaaagggaaatgggggaaggtgcagattatcttctaaaggtaaaacaaacccttcataaaacagaacacacaggctgggcgtagtggctcccgcctgtaattccagcactttgggaggctgaggcaggcagatcccctgaggtcaggagttcgagaccagcctggccaacatggtgaaaccccgtctctactaaaaatacaaaattagccgggcatggtggcgcatgcctatagtcccagctacccgggaggctgaggcaggagaatcgctggaacccaggaggcggagattgcagtgagctgagatcatgctactgcactccagcctgggcgacagagcaagactctgtctcaaaaaaaaaaaaaaaaaaaaaaagaacacataggcaagccctggccacggtttattggtccagtctgcacccttgatgcaaactaagcatccctaaataaacaaaatgcatatataatatggagccaaaggtaactaatctttctaacagctattgttttgccttaacccccacctctactatctactaagtatagataattggagaaagtacagtcgtttctgtatgcccctgaaatctgaaagaaaaaaacctgaatttagtggtagttcagacttaggcccttctggccaaatgaagtagctgtccagctaattcaagccacatgtccctcttggtctttatataactgttgggcctcttgagtttgtttctttgatgagtatactctgctatctttaaccctggaaagttttcccatggaaaatttaattttatctttccttttttatgagaaattgtattctcaagctggcagacaagaagaaaagacaatctggaaattccagatttgatctaaatgtcagcaaagccaaactaataattatggccacatatcaaggcaatttatgcagaatatatggatcacttgagcatattagattgtgttcattatattctttttcatttttgttctctttctttttttttttttttttgagacaaagtcttgctctgtcgcccaggctggagtgcagtggcacgatctcggctcgctgcagtctcgcctcccgggatcaagcgattcttgtgcctcagctttctgagtagctgggattacaggttgtgccaccatgcctggctaatttttatatattttgtagagatgaggtttcaccatgttggcctgttggccaggctggtctcgaactcctgacctcaagcgatccacctgccttggcctcccaaagtgctaggattacaggcgtgagccactgtgcctggccatgtgttcattatattcttctggactctactctgagggcttggtctgcttttatcaaaaatttttactttgagcatgtagaaaagaaatcaccacctatgtttttagaagggccacatctgggtatacaggtagcagtttgagtacccatacaggcattctgtttttgacttcagtacactatttaataaattacctgagatattcaaccctttattgtaaaataggcttggtgttagaaggttttgcccaaccgtggactaatgtaagtgttctgaacacgtttacgttagcctaggctaagccacgaggttcaatagattaggtgtattaaatgcatatttgactattacaatattttcaacttataataggtttatgggacgaaaccccattataagtcaaggagcatctgcataaattagagaaaaacaaacataaagacactaagttactggtttacaggtactaatatagacagcacatgttattcccaggctgttttctgattttaagctgttgttacttctctaaagcaactttgctttctgctctgtctttttttcatgtactgccaaagctcagatctttccaggtcatcaaaggaatgacatacagggaccacaggagggtgggaggagtggagaatcatgaaaccatcagaaatcatcgacgaaaccatgagatctgagttttttgacctttcccctggtctttgtatcttgggataagggtgtttggagctttgcctctgaagaaaacggatccaaatgggccccacaattccttcatatttgtgggactgtctttttattttgactgtatttaagtaccgttagtactttcatggaaatctgaaattccagtagtgttctgttttccccaaattgactttttaaaaattattaataaacatatatttaaaatattatacagcacttcactgtggtattattaacaattctgtgttcttggaaaggcccccagaaactttgtttttattgacagaagtctcaaaattctaagaagtggagccgggtgcagtggctcacgcctgtaatcccagcactttgggaggccaaggcaggaggatcacttaagcccaggagtttgaaaccagcctgggcaatgtggtgagaccccatctctacaaaaaaaaaatttttttaattccaataaatgataaaaataagagaatggagacaaaagtcataaattcaattcagttacactcacattatacaggatgatcatcttttagttttatgtgcacctttttacttgactatagttgtcttctaataaaagtgtgctataaatatgaatgtaaaatttgcaagttattatggaaattaacaaatttggaaaggtgtcagtttcactaagttattgatcaatgtacatcttgcataaaatagaaagaaattagttttgacattgaaaatataaacacactctgtctgggcgtggtggctcacgcctgtaatcccaacactttgggaggccaaggcaggcggatcacgaggtcaggagatcgagaccatcctggctaacatggtaaaaccccatctctactaaaaatacaaaaaactagccgggcatggtggcaggcgcctgtagtcccagctactcaggaggctgaggcaggagaatggcgtgaacctgggaggcggagcttgcagtgagccgagatcacgccactgcactccggcctgggcaacagagcaagactccgtctcaaaaaaaaaaaatatatatatatatatatatgtataaacacaccctacagtatgaatttgtgaaggaagaccatctgatttatgtgtataaaacattaggtctgttctaaaactggtagttctttcttttaatcactccctcctattatgctatatgagaggcttatcatgttcatgttttatgttccatattacacaaggccatttgggattctttgtctttggaaaaattgataaagagtattttattaaaatattcagttgtcactttgggaggccaaggtgggaggctctcttgagcccaggagttcgagaccagcttgggcaacatagtgagaccaaaaaaaaaaaaagttccattgtaaagcattgttagtctctatagttgtagcatgaagatgtaagtgtacttgtgattgaaatggctttgtgattttgaaactgcttttagtttttgagacagggtctctgtctcccagctagagtgcagtggtgccatcatagctcactgcagctcaatctcccgggatcaagcaatcctcccacctcagcctcccagctcccaggtagctgagaccacaggcacataaccaccacacccggctaatttttttacttttagtagagacaggatctcactatgttgcctgtgctgatctctaactcctgagctcaagtggcccttccacctcagcctcccaaagtactgggattactttactttactgggatgagctactgcactgggcctaacctgcttttaaagtgtatgattggagacctataagttgtcactgctacctagagatcattaatggtaagccgggtggttattgggccaggatagttcagagatgggcagttaaagagaatctaactgacaaacaaaagggagtgtgtgtttgtgtccatgaaggacagttcgaggaggggctcataaaggaaggatgagggagaggaaatacccatgaacagtgccacggcatgtcagctgtttcattttgtggctttatgtacaatcttcacaaatatgtaaagacaggtggctcacaacagtactaccactaagctagctctgtggaagaaacatcttaacaaaaattgttctgtgagcaacataatccacctgttccaagagactgtcaggtgatatttttttcatttttttggtctcccacttttttttttttcagtttgagagcaggtactgtttattaactgaccagcttagaaaaataatcatggtagacaccttagttcattcttctaataagcctgttgatctggtcctccctgttgccagcatctccaccttctacaaaatgggtggtctttttcttcattctgcctcgtggagaagataatttgaagggccacaggaagttatttgcttctttgaagtgttttccaatggtatagatctcatgaatcagatcctccctgcagatgatgccatatttaccgagagattgagccatcaaagcctcatctgtcaaagcaattcgcttcttactgattttgccataaccacacttatagattagttcatttactgacttcagaattgggtacccccatgcagtgtatggctctacaatcctcagcatgttaactgaagccttgttgagcttcacaaaggttctgttgaagatttgacgaagggaagaagctgcaacacctttcagacctttgggctcacaccattgatacctctgatcctgatgacaaacgccaatttgggttctgcaggtacatagaagttgccagcttttcttgccatcctcgccatttgaatttcagttctgtacatctgcctatattccttgtgatagtgcttcgctttttcatagataagcttcttccttgcctttcaaagcatcttttggacaaacttctttctcaggtgcttgatcttcagctctgcgaaattccttcgctttttcttaagcgtttctggcacagcaggaaccttcttcttctcttctacaccttccatggttccagccagaaaaagagtggtctctgcttgttaaaaatgggtaagaacactaataggttgtctgacctgtacttaaagttggagatcaatgtcgtctatatacattccccccatgcttaaagcccttcagcttctccttttaggataaagatacctgcaaatcacccagaccgtcctgaggagagctggtcacttccacctttgcaccccagcatccctcatgcatgtgatgtgtggttcatatcacacttcatctacaattacttctttgtgcatttgtcacctccactagattatgagcttcttaaaaaacagaacgtatgcctgtttcctcatcaagtaccccattcccagcaaggtagcccttggtaaatgtttgtttagtggactgacaaagcagccttagttattcaattcacttttaatccaactattaagagttagattctactcaaaccaaattctctactacctctattgttgggtttgaaaatctttttttttttttttttttttttggaggcagagtctcactctatcccccaggcaggagtgcagtggcaccatctgggatcactgcaacctccgcctcccgagttcaagtgattctcctgcctcagcctcctgagtagctgggattacaggtgtgtgccaccatgcctggctaatttttgtatttttagtagagacagggtttcaccatgttggccaggctggtctcgaactcctgacctcaggtgatccgccagcctcggcctcccaaagaggttaagccacaaggttcaatagattaggtgtattaaatgcatatttgactattacaatattttcaacttataataggtttatgggacgaaaccccattataagtcaaggagcatctgcataaattagagaaaaacaaacataaagacactaagttactggtttacaggtactaatatagacagcacatgttattcccaggctgttttctgattttaagctgttgttacttctctaaagcaactttgctttctgctctgtctttttttcatgtactgnnnnnnnnnnnnnnnnnnnnggtgcagtggctcacgcctgtaatcccaacactttgggaggccgaggtgggtgaatcatttgaggccaggggtttgagaccagtctggccaacatagtgaaaccccttctctactaaaaattcaaaaaaattagccaggcgtggtggcaggcacctgtaatcccagctactgggaggctgaggcaggagaaatcacttgaacccaggaggtagaggttgcagtgagctgagatcacgccactgcactccagcctgggcgactgagcgatactcaaaaaaaaaacacacacacacaaaaaaaactggaagtgttggccaggcgtggtggctcacgcctgtaatcccagcactttgggaggctgaggcaggcataacacctgaggtcgggagttcaagactagcctgaccaacatggagaaaccctgtctctactaaaaatacaaaaaattagctgggcgtggtggtgcactcctgtaatcccagctactcgggaggctgaggcgggagaatcacttgaacccgggaggtgaaggttgcggtgagccgagatcacaccatcgcactccagcctgggcaacaagagcaaaactccatctcaacaccccccaccaaaaaaaaaaaaaaaaaaagaacttggaagtgttttccctttcataataaaatctaaagtaataaagcgattagtatttcaagaagtaacatttaatgaaaacaaattttgatgtacattagtatagaactatattaaatagagtatacttatatatagtatatgtatccaaaaaaatcacaaaccttccacacactgcatattggtttcattattttatagctacagttcatatatttaaaaatagaggaggcagctgttcccaggacagctgaaattaacttagagtaagggatttgcagtacagtagctttttaaaaagtctttgtgccaatttaaaaaaagtatataattgaatatctgctctcaaaattaatcttaatagaccttaaatgcagcatttttcggcgttgtgctgtgttcttgcaacagaagtgaacttttgtactctgaatatgggcatttaaaatcatagatgtgcagcttttctttctttttttttttttttgaaatggagtctccctctgtcaccaggctgaagtacagtggcgtgatctcggctcactgcaacctctgcctcctgggttcaagcgattctcctgcctcagccttctaagtagctgggacaacaggcgtgtgcaccatgccgagctaatttttgtatttttagtagagatgggatttcaccctgttggccaggatggtcttgatctcctgacctcgtgatccacccacctcggcctcccaaagtactgtgattacaggcgtgagccactgcgcccagcctcatttttttaagttgtaaaccattgttacaatgactccaatagaacgtactttttcattattcccagtctgaggcgctaagatacttaagtgactcatttcatcaacgtaacaaagttgttttttaaaaaagcatttgtgtatggatcactgctccttaactaaggttaagtctgtctcccttcaggctcctaggccaggatacctccattcagttctcaacttcactttcctgtccatgtggctttgtgcaagttacatgacatcagaatcctgtaggtcctggaagcttttagatgtatgattctacattgtagaaataaaatgaaactaactgttaggataaaacatactgtaaaagaatttgttattaagaaaagccttcttttgagaaggaccagaaatattctgataatttacaagtaaacatctcttatttggtgtctttgttgaattctccatgtgcagatccaaccatatagcttgtgttcattctgcagaggcacgaatgcagtctgcaggctatggctgcagtttctcaagactgtcactggtaaatggtagggaagagaaccctgtcatgtcttacccatctcagtcaggttcctgggcaggtactgttagttcagaggctcttcctagccctcgttcttggcaccgcctagacaaggtttgcccatctgggagcgatccttttgtatctctagactgatctaactcagattgtaaaggatacaaaatctgccctccgcccgtgccccctctcctgtgggctctgctgtcccacagagcctgttctcccacagttgcccactgggattgagaagtagtggatcactcgatgggcacccaaggctgcaggctctgatctgatcctttccttctcatccagtctagacaacctggtacattacctctgccatgagagtctaactttaaaatgaaatcaccctgaggggtcgtgtttttcaatctctagtctccagaagacaggtcacaaccctatctcagaacaacttgagccctagacggagagtcaagatctgggtacatgtacccccctactgcaaccagtgagtacacaggagaaatgaaccaggcaagaggccagtttctagaagcagggcacagagtcacaacaaaaccagcatccagggtgacttaattgtcaaagcacaagacatcttatattcccataggatcaagactggttccagaggtgctgtaggagctcagtcaactgctaaaaggcactgggggatggaacaaggggttgtggagataaaaactgagccagatattgcaccacttcccaatacttctgtcgtatttattctagccggaggcccacaggctgtgctacatatgagtcaaggtagcccagaccttcctttaatttggctaatgactttttttttttttttttgagatggaatctcactcttgtcacccaggctggagtgcagtggcgcaatctcggctcactgcaacctctgcctcccaggttcaagcgattctcctgcctcagcctcctgagtagctgggattacaggtgcccaccaccacgccaggctaatttttgtatttttggtagagacggggtttcgccatgttggtcaggctggtcttgaactcctgacctcaggtgatcttctgcctcggcctcccaaagtgctgggattataggcgtgagccaccgtgactggccatgactttttttttttaagtccaaatatagcataaaagatttccctgaagaaggctttagaatcaaggagatatgtgattcaataatgtctttaccattgactggccatttaatattgaatttaaacagcctttctgatttcctgccgtatttttgttaaagagatatttcagtacagtcccagtaatgtggttgtcataattaagattaatttcaacacataggaaagaatgtttattcccaaatttgtctacagattggaatcacctagggaaggtccaaaaatacagatgcctatgttgctacctcctccacccacaagagtatttctgtgacacagcctagtcgtctttggaatttttggcctcccaaagtgctgggattacaggcgtgagccaccacacccagctaatttttgtatttttagtagagacagtgtttcaccatgttggccaggctggtcttgaactcctgacctcaggtgatccacccagcccagccacccaaagtgctgggactacatacaggtgtgagcctccgcgcccagccttctctctgttttttcttgggacatctgaagacagtgtcaggctgtgattccacttgtggccagacataagagaatatagaaagttctcctgtcatgtgctgtaatctcccacagaatgagaagagacggaggcaaagataagtgactttgcaaggggcagctcacggagatccagtgaagggaacatctaatcagtttgatttcgagtccactgtacggtaaagcacctgaatgctaattgaaaagtaaccttggaaacaagagcccggtattgtgctcttgctggggccgatatgggaataagccaggacatacaaaggattagaccaagatggagtttcaactggtcctgagttcccttattttttggcttttattttcaactttgtagcattaaatgctttgtctcgcgttcctgggccagccatctgaatgtatcaaagttccaaaaagttgaatatgtggctttttagtttcagtgtcctttaatggctcttggagagagagtctctgaattctgagagctagggaaccatctaaatcattttaagatttagaagccagcatcatcttccctttacacaaaataggactataaagctgcagtgtttcagatgttgggggaagggggctgtcccttcaccggctgtatgagttatgatgtgcttatgagtaaaagtaatacttcgtggttctcagtgtctgaggactagaatactgtttgatgtccaaagcttatattatactctctttctgattcagagcaaattctcaaattttatcccagtaacatagaaaacatttcaaatactggtgagaaaaatggtcagtctcaggaactgtgaaatcattttctacttgacctaagaaacctgatggaattaggctgctctttcttagaaacaaagactattgcaaattaaatcttcaggagatgagccctccagcctgcagggtttctaaaacatgcattctgaataagacaattatattttattttcagggtaattctacacttaataggaattatataagtgctttgaaaatagcgtgttgtgttgttttgttttgttttgctttgagacagggtctcactctctgttttccaggctggggtacagtggcgtgatctcaactcactgcaacctctgcctcccaggcttaggtgatcctcccacctcagcctccgcagtagctgggactacaggcatgcatcaccatgctcagctaattttttgtattttttgtagagacagggtctcactttgttgcccaggctggtttcaaactcctggctcaagtgatccaagcgatctacccttctcggcttcccaaagtgctaggattacaggcatgagccaccatgcccgagccagcatgttttgttttgttttgtttttaactgaaaactactacagattaagaatcgctgattttgatactgcataatactaaattgtttatgacaataaggatattctgttttcattaatatttggcacttacgtaatgttttacctttcatatttgatattgaaaattgatgagtccaagccacatttccattactcgcaattttttaagcttcgtgactatttaatttgtttatagttccctattataggtatacagttctacttgagggttcaaaagtaaaacagggccgggcacagtggcttacacctgtaatcccagcactttgggaggctgaggcgggtggataatcttgaggtcaggagttcgagaccagcctgaccaacatggcaaaaccctgtgtctactaaagatataaaaattagctgggcttggtggtgcatgtttttaatcccagctactcaacaggctgaggcaggagaattgcttgaacctgggagactgatgttgtagggagccgagatcacgccactgcactccagcctgggcaacagaacaagactccatctcaaaattaaataaaagtaaaacagtatataggccaagtttgtggtatatgtgtgtttctatcctaccagttttaagttctgtgaaaatatcacagatatacaatattttggatattttccaaaatattaaaactggtactttgggaggccagggcaggaggattacttaaagccaggagttcaagaccagcctgggcaacatagtgagacctcatctctcaaaaaaaaaaaaaattaaaaattagccagttagagtggcacatgcctgttgtcccagctattcaggaggctaagccaggagaatcgcttgcgcccaggagtttggggctgcagtgagctatgttcacgccactgcacacagcctgggcagtagagtgagaccctgtctccttaaaaaaaagcaaaactgaactaaagcaagtctctctcttgtctatcacgtcttattgccatttgaatttgttaggctttcatactgaaaacaaaggttgtgctttacatagcagtgaaaataagaataaccatagctcttggatcaggaagaatctaattttcagttggttcactaacagccaacatttgatgaaaagtcatgtggatcctggaccctcattaccttcgggtttgacaagcatcccggtcacatatgctccttgtttgggggtcagtttgcagcaggcatatttggaaaatcaggtccagagagtttctgtatctctctctttcactgcttaaaaaggttcggaaacatccaatcaccactgaatatttttacccttccccacaccccattggtggtcacagtttccagtgtctcaaaagagctaatcgttttatcaattggatcacttttttcttgtgattctaaattggccaaggcccagtgtcatttagatcctgagccttggacctggacttgggagtatggctcgtttgcctctgatttggcagcagggctcattgccgcacagatcctactgatggggccacacagctaagtcatgttccactttcccaagctggagctgccatggttcagatcctcccaaacagacccatgatgcacaggtgtgccctctgggagcctttgctcaggcttcaaccccactctctcattggcagcaggtttcgactctctcgggcaaaatcccagcaagggcgcagtctcaatgcaatgcaatgccctgtcttctgtcttctcagggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaaggtgagagagaaaagaagaccttgaagctgcctccctttccctctggctcccagacacaaaagagccgctggagccccagtgatggatacatcactccatccctgcctccagcatgcagggagagggggaactggtgctgggaagacaggagcctgccatgttccttatgtccatgcagacgggctcagggggtcactgtgtagaccagaaagaagtattcagagactctgggttctaaatggaccactgtgctgcatccttgctttagaccccagtacttccacatcattgtccacaaccaaggcatcaagatcaagtgaaataaaaataaaaatggcaggctgggcatggtggctcacacctgtaatcacagcactttgggaggccaaggcaggcctattgcttgagcccaggagttcaagaccagcctgggcaacatagtgagaccccatctttaccaaaaataaacagaaattagctgggcattgtggcacacacctgcagttctagctactaaggaatctgaggtgggaggatcgcttgagcccaggaggtgggggctgcggtgagctgagatcgcaccactgcactccagcctgggtgacagagtgagaccttgtctctaaataaataaaagtggcaaacattagctcctctgtcctgaagcagtgtacaggcttgtcaaagaattatatcccactatactgggcttggagctaagaatccaaaattctaaatttttctctggctccagctggttctgctgtgccttgtgaaactcatttgcaaagtaaaggaatggattcgtaaagtcaattccatatcctgatatatactcactggaatgccctaaccttttaggctgtgtctggagaatgatttagccgtaagagaagaagtaagacatgatcctttttcgtgaggtggtttgctctttgcagaatttttatctatcattttatctcccaacagaagaggttcctcaaattaaaaaaaaaaaaaaaaatacttggctggtgcagtggctcacgcctgtaatcccagcactttgggaggccaaggagggtggatcacctgaggtcaggagttcaaagaccagcgtggccaacatggtgaaaccccatctctactaaaaatacaaaaattagctaagcgtgtggtggtgcatgcctgtaatcccagctacttgggaggctgaggcaggagaatcgcttgaacccaggaggcagaggttgcagtgagccgagatcacgccactgcactccagcctaggtgacagagcgagactccatttaaaaaacaacaacaacaacaacaacttacagtgcttctgtcaactctcaacttgtacaggactcagctcctgcatcctgacttggagaaagcactagactgttttgaaagtggccttaccaaaagttcttgtgctctttatttacatcatgttgatctagcaagttagagacatttccctttgcataaaataaatgtgtccatgtgtgttgtcctcctagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggtaagtgaagcattttaacctttattttcctgacatgcgccaatgaaaggaccaacagccaaaccatttaccaagatctgaaggatttcttttttttaatttttgtattggtacataacatttgtatatatttatggggtacctgtgatattttgttacatgcgtagaatgtgtaatgatcggcactttgggggtttgaggtgggaggatcacctgaggtcaggagttcgagaccagcctggccaacatggtgaaaccctatctctactaaaaatacaaaaattagccgggcatggtggcacgtgcctgtaatcccagctacttgagaggctgagacaggagaatcacttgaacccgagaggtggaggttgcagcgagccgagatcacgccactgcactccagcctgggtgacagagtgagactctgtctcaaaaaaaaagaatgggtaatgatcaagtcaggatatttagggtgtccattaccttgagtatttatcatttctatgtgatggaagcatttcaaggcctcttttctagctattttgaaatatttaagacagtgttgttaactatatttaccctactctgctgtcgaattagaatttattccttctgactatatgttcgtacccattaaccaccaaggtgaagtgacagaggcaaaaaccactggctagagtagaaaccagggtgtttctgaatgcttccataaactttattttcacaggttctcatgcattcttttcttcaactttttaaattattttgtgagtggtggtaaaatacacgtagcataaaatggactgttcaccatgtttaactgtccagctcagtggcattaagtctgttcatatggttgtgctgccatcaccaccacccactacagaactcttttcatcttgcagaaccaaaaatctgtaccctgaaccaatagctccctgtttctccccctgcacccctcccagcccctggcaattaccattctactttctgtctctatgaatttagctattctttctataagcttttaatcaggcagcaagacagaccgttaatatatggaactgggaagtctgtgccccactctgatgtgctgtgagatgtttcgttcagtcccatggatggagggattgatacctctgtaccctactgctgccaccccccactgcccgggctaagtgtgtgagcaggacatagacacttcaaatggtaatgaaagctggtgtctcctgctgagctggagggcttccctaaagatgaaggaccaaagtccctggagagttgtcatcgccttgaaaacacaagggcttagaccactgctgtgacccttcaccagcctgtttgcccaactcctgtttgacacagcaggttttgctgcatcatcaagtccagacttggcatcaaggcctcaacaaaaagctctcacatccctgctccagcctcccacctgctagggtgcctgatacctgatgtttacaaagagatactgacttgcttccaagaagtggttccgtttttcccatcctaacaatgacagagtaagacctgtggtttcatctataaggagatggttccaaaagaatatattgcaaagccatacttcatgctgagctcgtactaatttcagtgtgcagtggtttctgtttatatatgctggtgtttaatatttgtatttgtcttaattctaggagtaccaagaggacaggaatgaccttgtgatttcagagactgagctgaaacaagtggcttacattttcaaatgcgaaaaatcaactattcagataaaagggaaagtaaactccattataattggtagggcagaattatggctctatggttattatgatgttttataaacaagctgtatgtatttagtggagttggttttttgttgtgttttttctccccacagacaactgtaagaaactcggcctggtgtttgacaatgtggtgggcattgtggaagtgatcaactcccaggacattcaaatccaggtaagcagagcctttccaaccatgctgtaataagcagagcctttccaaccacgctgtaataagcagagcctttccaaccacgctgtagtaagcagcctttccaaccacgctgtaataagcagcctttccaaccacactgtaagctgcggccttgcacagaccatccactctgcctccaagaagcagccttgcagccagtcgcggtggctcacgcccgtaaccctagcactttgggaggccgaggtgggcggatcacgaggtcaggagattgagaccatcctggctaacacagtgaaaccctgtctctactaaaaatacgaaaacaaaattagctgggcatggtggcaggcgcctgtagtcccagctactctggaggctgaggcgggagaatggcgtgaacccaggaggtggagcttgcagtgagcgagccaagatcgcgccactgcactccagcctgggcgacagagcgagactccatctcaaaaaaaaaaaaaaaaaaaaaagaaggagccttgctcccccatggccacctaaaatactcctattcttgttccctctggacacagctctagcatcacctccttggtagacccctctcttacttctcagtgttagttctttcttttcaatctcttctaacagatcccattttgtgtttccattactggcataccatctcaatttcaagtacagctaactggccaggcatggtggctcacgcctgtaatcccaacactttgggaggccaaggcgggtggatcacctgaggtcaggagtttgagaccagcctagctaacatggtgaaaccctgtctatattgaaaacacaaaaattagccgggtggggtggtgggtgcctgtaatcccagctacttgggaggctgagacaggagaatcacttgaacctgggaggcagaggttgcagtgaactgagattgtgccactgcactccagcctgggcaacagagagagactctgtctcaaaaaaaaaaaaaaaaaagaaaaaaaggacagctatgtaatctttatagccccagaaacttgcacagtacctgcacatagtaggcgtccagtaaatgtttgatgggtatatgatttgagtgaatcaactaatgcataaataaaagtactgtgagactctcctagtatgattagccccattccaaagagaacttttttctcaggaaaaattggtcctagatcatgaagaggaaaagtttttctaaagaatcagtgagatcatcagaaaaacaacttgagaagtagggttggagttgaatttgcaaaacagaagaaaatctgtgaattaaaatatataataattttgatttagccacatggaattttatgatatgccaaaatctaaaggacttcttggttttggccaattataacttctatcttttttttttttttgagacagagtctcgctctgtggcccaggctggagtgcagtggcccaggccaggcgcaatctcggcacactacaacctgcacctcccaggttcaagtgattctcatatgcctcagccccctgagtagctgggattacaggtgaccaccaccatggcccagctaattttttgaatatttaatagagacagggtttcgccatattgggcaggctggtctcaaactcctgacctcaagtggtccacctgcctcggcctcccaaagtgctgggattacagtcatgagccacagcacccagccccagtttagtatttctgatcactacatttatccatttaataacactgctttctctccaaactattacgcatgcaaattttaaggaggttgctcatcttcagaaaaagcccggtacttcaaggatgatcatggttcatagaaacctaatgagaccacactttctgaagagctattttggatggtgggagttcctatgtaaagaaacatgctttttcccactttacattatttttaattttaaaaaactagaagtaacagcagtgaagtaatatttgatggcagaggtgagggtacatgtttagccatagtcatgcaatcatagtgtgtcacagttgaaaagtatcttggaaagaatgcaacctaacacacataccacaaacacaccttaattttagagagtttatttcaagctccctttcattcttacagaaattaagcttaggtagcaatggtgaaaccatatataagcagttagcattttttttaatgtaaatacatcacatctgaaatacacaaccaagtaaattaagtataaaatgtgaaaatgggaagttctaaatattcatcatgtttttggagggagaaaaaaatcttaaaccaagaagaaacagaggaaattttcaaacagataggcagatatgtctacctaaaaatttaaaacttctgaattccattcagtggaatactgtgtaaccattttttttgtattatactttaagttctagggtacatgtgcacaatgtgcaggtttgttacatatgtatacatgtgccatgttggtgtgctgcacccattaactagtcatttacattaggtatatctcctaatgctatccctccccctcccccaacctcacaacagtccccagagtgtgatgttccccttcctgtgtccaaatgttctcattgttcaatacctatgagtgagaacatgcggtgtttggttttttgtccttgcgatagtttgctgagaatgatggtttccagcttcatccatgtccctacaaaggacatgaactcatccttttttatggctgtatagtattccatggtgtgtatgtgccacattttcttaatccagtctatcattgttggacatttgggttggttccaagtctttgctattgcgaatagtgccgcaataaacatatgtgtgcatgtgtctttatagcagcatgatttataatcctttgggtatatacccagtaatgggatggcagggtcaaatggtatttctagttatagatccttgaggaatcaccacgctgtcttccacaatggttgaactagtttacagtcccaccaacagtgtaaaagtgttcctatttctccacatcctctccagcacctgttgtttcctgactttttaatgaccgccatgctaactggtatgagattgtatctcactgtggttttgatttgcatttctctgatggccagtgatgatgatgcattttttcatgtgtctgttggctgcataaatgtcctcatttgagaagtgtctgttcatatcctttgcccactttttgatggggttgtttgtttttttcttgtaaatttgtttgagttctttgtagattctggatattagccctttgtcagatgagtagattgcaaaaattttctcccgttctgtaggttgcctgttcgctctgatggtagtttcttttgctgtgcagaagctctttagtttaattagatcccatttgtcaattttggcttttgttgccattgcttttggtgttttagacatgaagtcctcgcccatgcctatgtcctgaatgatataaaaactctcaataaattaggtattgatgggacgtatctcaaaataataagagctgtttatgacaaacccacaggcaatatcatattgaatgggcaaaaactggaagcactcccttcgaaaactggcacaagacagggatgccctttctcactactcctattcaacatagtgttggaagttctggccaggggagtcaggcaggagaaggaaataaagggtattcaattaggaaaagaggaagtcaaattgtccctgtttgcagatgacatgattgtatatctaggaaaccccatcgtctcagcccaaaatctctttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaaggatgtgaaggacctcttcaaggagaactataagccactgtaaccattttttaaagtgatctataaatacatttattgtactttattaggagaaaataacagtcttataccattatgtagagcatgatttcattcttctaaatgtactcatgtaaacacatatatatgcacacatagatctatagatatatctatatctgataatcctaggtaagtcagaagagatatactacatttcataactgaattgagtgtctgtggaactcctatagcagaaatcacacttcatttgaaacttcaaaattcccattaaaattctgcagcaatgaagacgcatagaaaaaaaaagaaagaaaaagaaaataaagtcagaaacaagaagagaattcctcctgtcattgcttcttgttcaataatgcattgaaagttctaactgaccgggcacggtggctcacgcctgtaatcccagcattttgggaggccaaggtgggcaaatcacgaggtccggagattgagaccatcctggctaacacagtgaaaccccgtctctactaaaaatacaaaaaataaaccaggcgtggtggcgggtgcccatagtcccagctactcaggaggctgaggcaggagaatggcatgaacccgggaggcagagcttgcagtgagctgagatcgcgccactgcacttcagcctgggcaacagagtgagactctgtctcaaaaaaaaaaaaaaaagttctaacctatgcagtaagataatgattgagagagataaaactggaaaaggaagagacaaaaatgcccttatttcccaacaaaataagtgcctttatataaaacccaagagattcaagaaactataaaactaaaaaaacattcagcaagatggtagggtataatatgaacatgcaaaaatcaatagcatttctttctaccacaaataagttttagaaaatgcaatagaggccgagcgtggtggctcatgcctgtaatcccagcacttagggaggctgaggcgggcagatcatgaggtcaggagattgagatcatcttggctaacacggtgaaaccccatttctactaaaaaatacaaaaaaatagctcgtcatggtgcaggcgcctgtagtctcagctactcaggaggctgaggccggagaatcgcttgaacctgggaggcggaggttgcagtgagccaagatcccgccactgcactccagcctggcaacagagctagattctgtctcaaaaaaaaaaagaaagaaagaaagaaaagaaaagaaaatgcaatagaaaataaggttgaaacagctattttgttgctaggtgcaacaaaactgtgaggtacctagcaaaaaaagcaaacagaaatgggagatagttacaaagaatgcaagagtgatgttgtaagtaaatggacaggaagacatcattatcagtggtctcagctatttaatgtgagtttaatgaaattcacctcaaaatctcaacagagttttaaatgaaaaatggtcttaaaattcatttggaaaacaaatggacaagaatagctaaacagtgtgaaagatgaataaggtgaagggacttgcatgcctgatattgactcattgtaaagtgctatattgttagtgatatacaaaaacagataaatgaagcagactagcgagccctgaaatcaatagatgcatagatggaaatttgtattttaggacaattgattatccatgtgggaaaaaaatacactgaattctacctcacatcatacataaaagtaaaatgctaattgtgaaaaataaatacttttaaactttgataataacatgtagaagaaaaattttatgcctcagagtaggaaataaattaattagggtcaaaaagcacaaaccataaagaaagtactggtcattttaactacattaaaatttaaattatatgtttaacagaagacatcatatgaagctgaaagacaagccatggactgaagaaagatatttgcaaggcagataatagaaaaggatttgtatctagaatttataaagaacttaaatcaataagaaaaaggctgctgggcgtggtggctcacgcctgtaatcccagaactttgggaggccaaggtgggtggatcacctgaagtcgggagttcgagaccagcctgaccaacatggagaagtcccgtctctactgaaaatacaaaattagccgggcatggtgacgcatgcctataattccagatactcaggaggctgaagcaggagaattgcttgaacccagcaggcagaggttgtggtgagccaagaatcgtgccattgtactccagcctgggcaacaagagcgaaactccatcttcaaaaaaaaagaaagaaagaaagaaaaaggctaacaatctgatagaaaaatgggcacagaatattaaggcaattcagacaaaaaagaaagtggttgataaatatatgaaaatatgtataacctacctaactagtagaagtatagatgccagttaataccacaattagtgatgtcttctcacactcacccattctgcattcagactgtccttactttgcgtggtgctaggttaactgaatcttatgcctacaggaactacaatttgaggattgcctatatactaaagtctgatgctataggattgctaaggaagtgaaacaatgagaaccctgatacatcagtgttgggggagtaaatctgtgacattcactgcaatgcaaattggcagcatctaagaaagtcacattcatagtctgtgactgagtaatttcactcttagtgtatacactaaagaagccccagcacgtgtgccaaggagacaaatgtaaaaatgtttattgcaatatcattcataatggcaataaaaacaatttaaatgtccaccagttggtaagttaataaataaatcctcccaataggatactagttggtagtttaactcgtatagcagctaaaatgaaccagccgggtgcagtggctcacacctgtaatcccagcactttgggaggccaaggcaggtggatcacctgaggtcaggagttcgagacagaggtggaggttgcagtgagctgagatggcgccattgcactctagcctgagtgacagagcaagactctatctcaaaataaataaataaataaataaataaatttagaaaagacatctagaaattaccaaaacattactgcagacacattattaaatatacatatatgtgctgtattattatttgtagtagagccctatgtgtacctgaccttgaactacccctgccttttttttttttttttttttttttttgcactggggctcaattccaactcagtgttcagtttctatggagagagaggaggaaacagagaactagagtgacctggccagactccccacaaggaattctttacatcactcgcaccatcaataaaagttgctcttggtttgcaatccagccttttctccacggtgaaagaagagatgtctttatcgctttaattaccatgacaagaaggaaaattatagagttgtaatatggtctttgggggaacagtccgcccttatggagattttgggggtatgtctgaaaactgattgttagaagagaaatttaaaaccgatcagaatttttatagcacttcgatatttataaacaatacaaagaatcgcctcctcttttgtatgatcctacttatctatataatgagtgtcctgagccaagcccccagttttgtctcctgaaatgaatacatttcaaaatacctagacattcatctcatgtaagcctcaaattcagccactgagatttttatctagcaaaggacttatgtgaaaagaatggtagtgtttcttatttaagttcaggaaaaatctactcagtttttactcaagaatagttttacttgtaagtgacaacattagaacttgttttaatcctagtttcatagagatttgtcaaaagtaaaatttcaagcaaatgaatatgaatgcatcttgtttcttttatcatgaaatcaaatacatgttttgaatctactaacagggttgtgaggctttttctgaacatctagctgctgtttccaaattaatctcttaattttgtctcaggaaagagacactgaggtttgagaatccacttgtgtggtcttttcattctgtccctgagtgacacctatcctattctgcctgaagactttgccattaactcacctccccagctttgacccagtgaattctaatgcttggttaagcccaagctaaagccaagaggaattgagattgtatttattcgagggcattgttatttctgtttctttgctttggtcccaggtattttttcctatttcaggtaatggggagagtgccaacaatttccattaataagacagaaggttgccacatatacctcagtgaagatgcattagactgtgagatcgtgagcgccaagtcatctgaaatgaacatacttatccctcaggatggtgattatgtaagtacctttcaaaaggctgtcaagaatttttctggagccttcattattaacattcttagagattgattaatcagctaccaacctgcgagctttatttgtagcataattcacaggcaggcgaggaattcagggagctgtcttccacatctcttcccgcctattagcttcttgactgtactcactcctggatttccgattctcaaggtagtgtactaataattcatttaatggaccagcgtttatcaaatagcacagcatgcatctgagttcgtattaggtaggactaaatattttcctttgctctggtggaggtaaacaggaaagaaggagaaataaatacttaggggaaaaaatgtgaggacagagaaaagacagtaagtagggctatttgtgcagctatgcttaagtgagaggttaagtgtaagaatcgggaagttttatgaaaatgccagttcccaaatcttccagctggaggttggattcaggaggcctagagtaaggcccaggaatccagatttttaactggcatgtatcccttaagtccatccaatggcccttctgagaaacactagcctaaaagacttggccactatttattttctcagctttctctcctcaacaaagcactttctcaaagaaccatacacgtattctcacactttgaaaagggagtatgaataaataagtacatttcctggttcatgaagtgtgatggatctgctagttgctacttgaaagtgaggaaataaatacagagaaggccaagcatggtggcttacccctgtaatgccagcactttgggaggcagaggcgggcagatcacttgaggtcaggagtttgagaccagcctggccaacacggcaaaagcccgtctctactaaaaatacaaaaattagccgtgtgaatcccagctactcgggaggctgaggcaggagaattacttgaacccgagaggcggaggttgcagtgagctgagattgtgccattgcattccagccggggcgacagagtgagactcagtcacaaacaaacaaacaaacaaaaacagggaaaattccctctaagtctgcctgtgcagggagccagtgaaccagggaaggatgggagaaaacataacttagcaggcaaaacatctggaagaggagctccctcagcctaaggggtcaattgccagggcctacacagcaatcaacacacaggttgatctccttgagcagacggtgtgactgctgccacattctcccttccccacctggcagtaagttcgtcagctctgctcagccacgtgtcatacattacaggccagaattcatcatttcagtttaaaaaaacaaaactctgcaagcctcaggccatgctttactagtaagtgtgtatggacagtctaaccctgagatacagaagagtcctctcttgggccctccacctaaaaaaattcctgaagagctgatgccaacagcttcagagtaggagagtcaaaaattggagggagccctggcctttgcagctgtttaagcagaaggaaggctcagctgcatgggactggatctgctaagaaaagcagtgggatttggatgaacactgcagactaatgaagctggaatctatgggcgtgggacccaggcacctgtaactgttaaagcttcccaggtgattccagtggggagccaacattgaaatccaccggcctaaaggatgagtgtaaatcaaaacctgagcgttcatgctaaaaaccaaggtcttggccgcgtgctgtggctcacgcctgtaatgccagcactttgggaggccgaggcgggcagatcacgagctcaggagatcaagaccatcctggctaacacagtgaaaccccatctctactaaaaatacaaaaaattagctgggcgtggtggcacacgcctgtagtcccagctactcgggaggctgaagaaggagagtcacttgaacctgggaggcagaggttgcagtgagctgagatcacgccactgcactccagcctgggcaacacagcaagactccatctcaaaaaaaaaaaaaaaacaagatcttgcctcttacaggtcaattaccttgtggccctcttcacatgttctcggttggagctggtagggaacaacacagaggacctgccatgggcattatggtgtgggaatggatggaggagatgattcgtcctgaaagaaattggtctcccagagaagactcgttagcatattactaacccctcacagccaggaacagatttgggacagctgttgtgcaattactatcaaagaggtgccttcatctggcacattctctacttggcctggttcttgagaacaaacaccaagcctcatctacccatccagaagagccccagaaggaatattggctgcacaaacacacacgttattcagattgtgggttctttacttcaagatttttccattgcagattttactcaagaagaatacatcactcattatagcatgggctttgccttttattttatttatttgtttgtttgtttgtctgagacagggtcttgctctgttgaccaggctggagtgcagtggtgcgatcatggctcactgcaacctcgaccccccgggctcaatcgatcttcctgcctcagcctctcaagtagctgggactacaggcgtgtgccaccacaccctgctaatttttgtatgttttgtagaaacagtgtccctgaggataggcagagacaatggagagggtgggattaccatccccactcctgggaatccttccctgcaactctgccaaaagagataccaaatcagagtggctcttcagcagcactacactgtgtaaggcttgtccttatacagtggggtctcgctatgttgcccaggctggtcccgaacttctgggctcagaggatctgctggcatcagcctcacaaagtgctgggattacaggtgtcagccaccgtgcctggcccaggcctttccttttgaatgaatgaatggcttcatcccaaagaaacagttggatcctacatctaggaagataggtacccatgtgtgttccatggaaacaccacagctcatgatcatgggcatcagcttatcagacacatgaggtttcaatgagcaccgcatggactggaagtccgaggaggcccagaagacaggtccaaggcctccttgccttagagaggttttctatcttcttctgaaggtctctgtccttcttccttgccttggaggaggtcttctatcctcttctgaaatgactggagaatcactgtctgggaaagcagagtgttgacttagactacttttattttgactattctctattattctttgtctgtacgtgtttgtacgtgtattttccaatgggagaagtagagtgccttggtgaagggtaaccaacgtgtatataaccctaggctcatttttacaatttatcaaagagtagagagctacctctgggataaaacctttctactccatgtgattggaaccagcagcattggcatcacctgggagcttgttggaaatgcagattctcattccattccccagacctactgaatcagaatctgcattttcataagatcctgaatcagaatctgcattttttttttctgagacagagttttgctcttgttgcccaggctggagtgcaatggcgcaatctcggctcaccacaagctctgcctcatgggttcaagtgattctcctgcctcagcctcccgagtagctgggattacaggcatgcgccaccacgcccggctaattttgtatttttagtagacacggggtttctccatgttggtcaggctggtctcgaactcccaacctcaggtgatccacccaccttggcctcccaaagtcctaggattacaggcatgagccacagagcccagccagagagaatctgcattttaataagatcctgggtcagaatctgcattttattattattattattattttattttattttattttttggagatggagttttcacttttgttgcccaggctggagtccagtggcatgatctcggctgaccgcaacctctgcctcctgggttcaagcgattctcctgcttcagcctcccgagtagctgagactacaggcgcatgccaccattcctggctaattttttgtatttttttagtagagatagggtttcaccatgttggccaggctggtctcgaactcctgacctcaggtgatccccctgccttggcctcccaaagttctgagattacaggcttaagccactgcacccggccagaatctgcattttcataagatcccagttgattcatgtgcatgttaaagtttagtggagagtagtaggtaagatagagcgcagatttgaattctagctgcgctgttactggccacatcatttggggccagttgcttactctcaggcctctgtttcctacagatggcatccccaagaactcctagctcatagggttattataggagatctgctgagttcatctatctccagtgcttagaaggatgcctggttcattctaaatgatgcttttagctttaatgatgatactggcttgaagtcacagaactgacacatgacatacacaagtctccacgtgacaaagacctccccatgacgcagcttgcaattcgatcgaatttctttgcctatcatgtggcacaaatcagcctcaccatctgtttgcaaaaggaagccttagtttaaataactttgttgtagtttaaataactttgttgttcttgcctttttccagagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttatattaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcatttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaattctggatgttaaaatgatttcttttctactttgatttgctccttgctcatgtgtcagacttagaaaagacagctgactccttcgggttgaattagagaatttatccagcatgccatcagcttccctgatgaatgatgtctcctttgagatagatatcagataaagccatttgcaattggatttactgtcagaaaattctagaattcagttttgtaaatcaagtcctctttactgagaaaatcctgctcgcagatctttgttaatgtaaacatcccagaacataagtgattttataaataccatatataccttataaacatataactataaatagcataataaatgtataagtaaactcctaaaagaaaaaaactgagaacatcctaaaatggatatattatatacccataatatagtgataattttgtattgagaaataaatccacccataattcttagaatctgtcagcttgcctcatacttgacatcagtctttcagcatgcctcaccatatgtattgaaaatctggacttgaggctcaacgattactttaccagccctgtattccttaagccagggatccccaacccccgagctgtggactggtagctggtccgtggcctgttaggaactgggcggcaaagcagaa

SEQ ID NO: 16039 - DNA, 50810 bp, Human
ggtgaaaccccatctctactaaaaatacaaaaaattagcctggcgtggtggtgggcacctgtagtcccagctactggggaggccgaggcaggagaatggcttgaacctgggaggtggagcttgcagtgagccgagatcgcgccactgcactccagcccgggcaacagagcgaaactccgtctcaaaaaaaaaaaaaaaaaaagtgatatattttaggaactcatgtcaggactctacaaagaaaactattttgcttctttgaaaacatgctgaattttagaattttatatcaataaaacagtatctttttcaaaagtatcactctttcacagaatactaattgtaagcaaaacattgggggtaagagtaccacatcagtttattaccaagtgaatgtcctaccccagccaattagttagttatctgagttaaaaacctgaccctgtcactttgtagctacgtgttgtagatcagctgtttagcctttttgagcccccgtttcctcatttttaaaatcgggatgatatccacacttaggcttgttgcaaagctttcatgaagtgatgcatgcaaagcagatagaacctctacttgcgatgtagccaggagctagtagagttattgttgccattgtggttgtcatttttattaaaacaactcatctatactgagcttttcttgtgattttaaaaaaattgattctttttgttttgaattatttaactttattttttgaagctaacatgctatctttttctcttaatgctaatatagaaaattattacaatttacatgtgtattttacaagttgatagggtatcttggaaaaaccagtcaatagcaatcatcaggtaatataaaaattcctcctgagtcactttaattttcagcttcttttctggaaattaaactgagtgccaatgtgtgggaatacagcataaatggcactgaatagcaggcaaatgtgtgaatgtacaaggagaaaatcatgtcccaggctggtctgagaatgcatctctcagtccaatatagttctgggaaatattaactgtgatgatgattttcttgttctactattgagattgtctaacattctccttccctacactgtcctcacttagtgatgtcagtaactttctccttttgtacatgtgacccagagccttgatctttctccacagtatccagcttattggtcattaccaagttgatatcctgcccagcccattaggatttacctataccacaaccatcacggtagctcattggagcaagatctgttagtacatctataccttttcacccatgtgcatggtggtgagctctgtgcctgtacacgtgagatgttagaaacaggtttttattatttttgcaagtgaattgtccttttagatactagtctgagaaattgccagaccatatccttaagcaatattttcaaacatgtgctgtgatctgtaagtttcctcccacttagagaaattcaatagtaataggatttgtggtgaaagtcataaatctttgtcgtataccaaaactgatattaaatggacatagaaatgaattaccataaagaaagatcaaatcttatgtgcttctgtgtttggaattgtcctagatttcgtgaagtttttcttcccagtggataagatcacattcctctctcttcccccatctgctggtagtaggttaatgatttatctaaacgttaggatgagctcatcaaattgaagaaagtaacgtagaggatgtggagaatgtatacttataaagggcatttatctgcaatgtctgtaacaaggaatttgagaggatttccctgatgtggcccctcaggcctctcacaaaaagcgtattgactggctagattccttgctagaggaagcctcccacaggctgcagtgcctggcatgaatgcttgttttagccgccactaagacaccttgccttgtctcttggctcactagacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagaggtaagaactgcagcgcgggcagcccagagtcaaggccccaaggccgtgggtctttgagggaggggtttttgagacatgtcagggacaaacctagcaacaagagaactcttaatcccatacgtgatattgccaattagcttttcctttcacaaatattgtccaccctaagtatgtttactataatgttagctgttaaagacccctcctacccccaaaccatttacccttcaataaaaatggtgccaagttgcaagggttagacaggtatgtattgaaatttagaaagtttgaataatttctttaacacaaaagcatttttttcttatttctcatacttttgaatctatttaaatacaacttcagtgctgattaatctactaaatgtgaaagtttaagatttatagctgggtgcagtggctcacacctgtaatcctagcacttggggaggctgaggcgggaggatcacttaagcccaggagtttgaatccagcccaggcaacatagtgagaccttgtctctacaaaaagtaaaaattacccaggcgtggtggtgcatgcctataaggtcactgggaggatcgcttgagcccaggagtttaagaccagcctgagcaacataacgagaccttgtctctacaaaaaataaaaaattagccaggcatggtagctggtgcctataatcccagctacttgggaggcttaggagggagggtcacttgagccccagagatcaaggctttagtgagctgcgatcatgccaccacactccagcctgggtgacaggaagaacctgacctgactcaggccaggtgcggtggctcaggcctgtaatcccagcactttgggaggccaaggcagcggatcgcctgaggtcaggagttccagaccagcctggccaacatggtgaaaccctgtctctactaaaaatacagaaaaaaaagaaaaaatagcagcgcatggtggcaggcgcctgtaatcccagctacttgggaggctgaggcaggagaatcgcttgaacccaggaggcaatggttacagtaagccaagatcgcgccattgcactccagcctgggtgacaagagggagactttgtctcaaaaaaaaaaaaaaaaaagaacctgactaaaagaaaagatttatgactttaaaatacttatatcagaactctcaaaggagaaagtggtagagtgtgggtggcaagccacccaggtgccaaggcaagagaccaagggcacaagctgttccagtataataaagctaatatatagaataagaatagttatactagaaatagattatagatatgattatatatgaatatcattaatcattagtttgtagcattactctttattccaatattataataatctttgttctacagttatcacctgggaaaaaccagccatacagagataggagctgaagggacacagtgagaagtgaccagaagacaagtgtaagccctctgttactcccaaacagggccactagagggctccctggtctagtggtaaggccagtgcctgagaaggcgcccattacctagcgggccttggtctagcagtagcgtcagtgcctggggaaggcactagttacttagcagactgggaaagggagtctcccttttcccgggggagttagagaagactctgctccaccacctcttgtggaaggcctgacatgagtcaggcccgcccgcagccatccagaggcctgtctccctgtgatgctgtgcttcagtggtcactctcctggtctgctttcatgttccaccctgtacgcctggctctgccttctcgatagcagtaacaggattagcgaaagtacttaaagtctttgaaatacatagaagaaataatggtgtaagctgtcctctctctgtctccgccttggctgccaaacagggaagggacccttgtccagtggacacatgacttgcgtgaccttcctgtcattggtgatggctcacactctttcccctgcccccttttcttgtatccaataaataacagtgcagccaggcattcggggccactaccggtctctgcgtctaggtggtagtggtcccccgggcccagctgtcttttcttctatctctttgtcttgtgtctttatttctatgatctctcatctccacacacgaggagaaaaatccacagacccagtggggctggaccctacagtggaggaaatggtaataataataatcaccactaccataataaggacaataggctattgaagacttcagttgtgttcttgccatagtccagtcttttatttaacatcccagcagcagtatgccataggaactattatccctgtcttataggtcaggcaatcagtttaaatatcctgccttaatcaaccatctaggaagtgaaaaaaacagagtttgaacccagttctctctgcagtctcctaataacacctgtgttatgataataattaatagtactaataaaagcaacacctggctgggcgcggtggctcacgcctgtaatcccagcactttgggaggccgaggcgggtggatcatgaggtcaggagttcaagaccagcctggccaagatggtgaaaccccgtctgtactaaaaatacaaaaataagtcaggtgcggtggtgggcacctataatcccagctactcgggaggttgaggcagaagaattgcttgaacccgggaggcagaggttgcagtgatctgagatcacgccactgcactctagcctgggtgacagagcaagactgtctcaaaaaaaaaaaaaaaaaaagccgggcactgtagctcatgcctgtaatcccagcactttgggaggccaaggcgggcagatcacgaggtcaggagatcaagaccatcctggctaacaaggtgaaaccccatctctactaaaaatacaaaaattagccgggcgtggtggcgggcgcctgtagtcccagctactcgggggactgaggcaggagaatggcgtgaacctgggaggcggagcttgcagtgagctgagatcatgccactgcactccagcctgggcaacagagcaagactccatctcaaaaaaaaaaaaaaaaaaaaaagcagcaccttacatctatagaccatttataccatgtaccaggtactaattgctgttcctgtattcctctaatcctcacaactgctactgcctttacacataaggaaactcaggctgagaggttaaatgatttacccagatggtcagttagctggtaaattgggcgatgggatcagagccgtggcattctgactgtagagctcttcctgtaactcacacacacactgcagctctcactagcaatgagatgcagaacacaggccacacccggggaaggtgactcccaagaggagaaaagggaaccctgccctgcagcgcaaggctcgcaacagtcacgcacttgttaatgttaaatgaagagaagagagtcaattatattttccccaggagctacctgctcatctgtctggatactgaaataggaagatttatcatacttatattactcttttttctgagatggagtttcactcttcttgcccaggctagagtgcaaggctggagtgcaatggcatgatatccgctcactgcaacctccatctcccaggttcaagcgattctcctacctctgcctcccaagtagctgggattacaagtgcccaccacaatacctggctaatttttgtatttttagtagagatgaggtttcaccatgttggccaggctggtctcgaacccctgacctcaggtgatccgcccgcctcagcctcccaaagtgttgggattataagcgtgagccactgcaccagatgttatgttactttttatactttattgtacctggaagaaacagacaaaagttatcagatggtcctttttctgaagagctgccttttacacatttactatgagctggtggcttcacgccaagcaacagctagctgttgaggataactgatataattgtacccattgatatcctttctatttactaaacaatataaaagataaaagcaaaagtgtcttcaaaagaagacatacatgtggccaacaaagcatattaagaagtgttcattatcaccaatgactagggaaatgcaaatcaaaaccacaatgagataccatctcacaccagtcagaatggctattattaaaaagtcaaaaaataacagattctggcaaagttgcgaagaaaagggaacccttatacactgttggtgagagtgtaaattaattcaatcattgtggaaagcaatgcggcaattttttaaagagctaaaaacagaactatcatttcacccagccatctcactattgggtatgtacccaaagaaatataagttgttctaccataaagacacatgcacatgtatattcattgcagtgctattcacaataggaaagacatggaatcaacctaaatgtccaacgatagactggataaagaaaacgtggtacatgtacaccatggaatactatgcagccatgaaaaacaacaagatcgtgtcctttgcaggaacatggatggaactggcggccatcattcttagaaaacgaatgcaggaacagaacaccagataccgcgtgttctcactaataagtgagagctaaatcatgggaaccgatggacagaaaggggaacaacagacactggggcctgtgggaggaggagggagaggctcaggaaaaaaaaacaaaaacctgccaagtactatgcttactacccgggtaatgaaataatccatacatcaaaccccttagtcatgagttgacctgtataacaaacctgtgcatgtacccctgaacctaaaataagtcaaaatatttaaattttaaaaaacaaaagtatctgataaagaaggtggtttgcttttaaccatagtgtttttcagttaaatagttaaaaatatttttttgatttcccttaattccagattgattttctttggggcttaaattcttaaaagaaaggaaaagtgtagaagtcgggtacagtggcacatgcctatagtctcagctactccagaggctgaggcaggaggatcacctgcgcccaggagtttcaagctgtagtgcactgtgatcatgcctctgaatagccactgcactgcagcctgggcaacacagggagaccctatctccaagaaaaagagagagagagaaggaaagaaagaaaaagggagggagagaaggaaggaaggaaggaagaaaaaaaaagatgagatattttgggaatgtcattcaaagacaagaatagttgcattattgattttgtcaggtttcactggataaaagtaagatgtcattaattgtatgtggttatataagaagctggaactcttacctaagtaaattgttgatgggttgtgaaataatgaaggactcttacctacatgaatgttgatgggttgagaatcaagtaaatttaaacgctggtgagaattacaaagaaagccacagatgtcgtttattctctttgtacacttagaatgtagtatgaaacaagatataaatttgtggaaaaattaagtcatagaaaattaaagaacagtttcattcaacaataggaaacgttaggattatatattaatagttatttgtttgttttctatttcctaccctggaaaatgagttgcaagggacagggaatcctttgaagtatccctagtgcctagaatgatgtggtcacctggtaggtatttagtaaatattgtatgcattgattgtgtgaatgtattgaagtgaaaagcatgtaatcgctaagtggacagactgcacagtaagcttgttggttgttcagtggaagatgagacttaatgaagctgagtcttctacagaggttttcagggagaaggattgatttcaagtgcatttgagaggtagagtttgaccagcagagagaaagtaagaaggacattttgggtgggcagattggcatgaacagatgagaagcaatggaagagaattaagatgtatttgggagactgcaaaagaactgtttcgtgtagtctagaacaggggtccccaatccccagaccacaaactggtacgggtccgtggcctgttaggaaccaggctgcacagcaggaggtgaatagtgggccagcaagcgaagcttcatctgtgtctacagctgctccccatcacttgcattactgcctgagctccacctcctgtcagatcagcagtggcattagattctcacaggagcacaaaccctattatgaactgtacatgcgagagatctaggttgcatgttccttataagagtctgaagcctgatgatctatcactgtctaccaacacccccagatggaactgtctaattgtaggaaaacaagctcagggctcccactgattctacattatggtgagctgtatcattatttcattgtctattacaatataataatagaaataaagtgcacaataaatgtaatgcacttgagtcatcccaaaactctccctttccccaacctcggtccatggaaaagttgtcttccatgtaactagtccctggtgccaaaaaggttggggaccactggtgtagaaggtgatttatggaagagtagggaaaattaagttcaaaaaccattaggcaggggttgtgggagggtacagatttggagtttgggatttattttatgggagaagaggagccctgcaaggccttgagccgaggaacggcctgaggaaggcagggcttgataaggactgtcttgcagtggagcaagaagagcctgggtactgtgagattattgagaagggtgtaagggccctgagccagggatatgataaaacacagagagacttaggagatgcttcaaaggaagaatcaataggcttattttttggacattgtagaaaagagaagagactgagccgactgaacaaatctaagcgtgggtgactggaaaaatggtatcaccttttttgtttttttttaatagagatgaggtcttgctatgttgcccaggctggtcttgaactcctggcctcaagtgatcctcccacctcggcttcccaaagtgttgggattatagccatgagccactgcccccagctggtaatatggttttaagaaactgttttgtttaccttagcatccgcacagcatgcgtcttctgtcatttctaaggtgacgagtgaggagtagagatttaggtgctttgagttcattatttttctatgatgtaagcatttcctgcggcgtataaatggtggaaaagagaagttatatatggcacagagcaattgctagatggagtgactttagaacccagattcaaatgtgaaatccagaagcactcttttctttattcagtgggtcttttttgaatatcctacgatgggtcatgcacttggccaggagctagggtagtgcaagcaaaaaaagacatggtccctgccttggggcaacctaacagcctagtaggagacagatattaaacaaataattatacgagtaaaaatgaaaagttctaactatggcaaatgctatggaggctaaaggcatggggctgagagaacatataagagggttttgaccaatctgggatattagagaagctttttatcagcaagtaatgttgtacagagagttgaaacgaagaattcctgctactgcagaactaccttaccattgcatgccttttgccaactgcagaagtcatgaaaaataatttcttctcctaactccaggtttctctcatctgccaacccctccctgccccaccaccctccctcagcacacacaagtcgtaatcatcgtttgtttttcccaaagattcctgtactggttttttgcatcctcctatcacaatctgatcgttttcacgtgttacataatttaaaacgtggttttcagttaagttgctcaacaatttgcttcccatcagtagttctcaacagatagcccatctgtgggcaggagggaaggatgagaggtagtctggtaaaatagtttgaaaaatactgcccgagaggagttttctcccattttctaataagatgctcacttagaaacgggattgcagttttcttttagattttctcgttcccttttctatgacactgcagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaaggtaagaatgtccttcaagtgagagggcaagatgcacaatagtaaatattgtaaaataggatctaaaactgaaaccccagaaacatgcctgaggagatcctgatatcagccagagatgtttatttttttcaagacattctttatatacctcattggataagaatgctatttaaatgatgttcttagatatgtaataagcagaatacacaaaattttagtggctgaaggacttcctaatttatatgccttctttaaaacaataaaactggaaacatgtattttgcctgcttttttttgcatgtaaatgcccctttctgaaatgggggaatacatgtaggctgtagtacctgagggttttgtttgtttgtttgtttgtttgtttgtttgtttttagactgagtcttgctctgtcacccaggctggagtgcaatggcatgatctcagctcactgcaatctccgcctcctgggttcaagcaattctcctacctcaacctcccgagtagctgggattacaggcgcgcactagcacacccggccaatttttgtgtttttagtagagacagggttttgccatattggccaggctagtcttgaactcctgggttcagatgttctgcacgctcagtctcccagagtgctaggattacaggcgtgagccactgtgcccagcctgctatggtaccttcttaagagtgaattctacaagaaaggaagacttttcatgatacctgacttcaaatacacggctctctttgcaagcgtctgggagtttcctgtcatttcaccttgaagaatttttcctgtagggagaaactttgaagaaaattgtttttcatttttgttgctgttgttgtttatcaggggaacccgcccacaatatttcattgtaggttctttctattttccataagtgtcagccagctgagaaataaagagaaagagtacaaagagaggaattttacagctgggccgccgggggtgacatcacatatcggtaggaccatgatgtccacctgagcctcaaaaccagcaagtttttattgagggtttcaaaaggggaggaggtgtaagaacagggagtaggtacaaagatcacatgcttcaaaggacaaaaagcagaactactaataccagtctagcaaagatcacatgcttctgagggaacaggacagaggcaaaaggagaaccactgataagggtctatgttcagtggtgcacatattgtcttgataaacatcttaaataacagaaaacagggttcgagagcagagaaccggtctgaccacaaacttaccagggtggagtttttccccaccctagtaagcttgagggtactgcaggagaccagggcgtatctcagtgcttatctcaaccaggtaagacattcccagagcggccgtttatagacctccccccacaatgcattcctttcccagggtattaatattaatatttcttgctaggacaagaatttagcaatatatctcctacttgcatgtctgtttataggctctctgcaagaagaaaaatatggctctttttgtccaaccctgcaggcagtcagaccttatggttgtcttcccttgttccctaaaaatcactgttattctgttatttttcaaggtgcactgatttcatattgttcaaacacacattttataatcaatttgtatagttaacacagttatcacagtggtcctgagatgacgtacatcttcagcttacaaagataataggattaagagataaaagtaaagacaggcataagaaattataaaagtattatttgggaactgataaacgtccatgaaatcttcacaattcatcttcctctgctacggttccagccggtccctccgtttggggtccctgacttcctgcaacagttgttgttttttgagacagagtttcgctctttgcccaggctggagtgcaatgacatgatcttggctcactacaacctccgcctcccgggttcaagtgattctcttgcctcagcctcccaagtggctgggattacaggcatgcgccaccacaccaagctaattttgtatttttagtagaggcagggtttcaccatgttagtgaggctggtctcgaactcctgacctcaggtgatccacccaccttggcctcctaaagtgctgggattacaggcatgagccaccgtgcccagccagaaaattgtttttctatgactcagaaaaaaagaaaaactaaatttaaaaaaagtaagaaaattgtttttcatccattcactttttcttccagcaagcaagctagaaaatgagtcagggagtatcttatcagtcttactgggttttagtcttttgacctagtagttcccctttgggaaatttattctaagcccatagtcatagaagtgtccatagagatttatacacaaggatgcttatagtggactttataatagcaaaaccttgaaacagacatgatgtcaaacaatagaataattactcaaatgtatagtacatccaaatgctaaggacactgctgtgttgccattaaaaaatcatggttatggctgggcctggtggctcacgcctgtaatcctagcactttggcaggccaaggtgggcagatcgcttgagtacaggagttcgagaccagcccgggcaacataacaaaaccccatctatacaaaaaaatacaaaaaataaaataaaaaatagtcagtcatggtgtcatgtgcctatagtcccagctacttgggaggctgaggtgggaggattcctggagcccaggaggtcaaggctgcagtgcactaagatcataccacttcactgcagcttggatgatgagcaagatcctatctcaaaaaaaaaaaaaaaaatcgtgcttatgaagaatatttaacaatacaagaaaaatgatcacaatatcaaaactggagagaggattggggtatgaagttatacttttgtttggtcttgatcgtgataaaaattaaaaagtgtgcatgagtgtacatagaaggtagaaaataaaccagactatcctcgtaggtggtagaattttatcttcttttgtatgcatttatgtgttttgcaaacttactgtgttactgttgtatatatattgctttagcaatcgaaaaaggagttataacagggtttgttttgtttttcttccttatgcagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggtaaaagagacaaaatgtaatggagattttgttatgttaaaaacagagaatataagcgatttagcaacacacacacacacacacacggagatgtgctcatgatacgttagatattatattaggaaaataaagtacaagtgattttgaaagaagcgctaagttggatcagtaatacaacacatgatccccacacagttgggaactaaatgaagaaaacatatagtagattcttatttggcttcatgtttactacatttcaagtgaaaagaagtagaatgaagtaaatttatgccattttatcggtgctgtgaaaaatcagcttgactggagccagtgtggatttcgcattcattaatgtgtgttcacgcacccctagctgtgatcgtggccaggtagattactaagagtaatttaagcttgcataatccattttttggacattagcagtggaaaagaagacttggcaaaggagatgaggcaaaacaaaggggatgaaatgaaaaagctgcaagtgaggtagataaggaagacaaggcaggaactgaagaggaatcttctgcacaggcattagttagctccccagcaaacaggcccctcccatgggctaattttttttttttttttttttttttttttttttttttttaatggagacagagtctcgctctgtcactcaggctggagtggtgtaatctcagctcactgaaacctctgtctcctgggttcaagcgattctcgtgccccagcctcctgagtaggtgggaccacaggcgtgcgccaccacgcccagctaatttagtttttatttatgtgacattataattttacttgctgtttaaatggatagattctttaaattttttttcaaatgctagttttaaataatattatttaaattgatgttatgtttcttattcgtccactcactggcccctcctacttctcaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggtaagcacaggccagccttggagaacgatggtggttcaagttttttgttttgttttattttgtttttcattctatttaagctatgttcttgaggtggatcaagaaactaaggcaaatagtcaaggtctgcattcttttttctctactaataatcgatattagaagctttgaggattaagtcatggttttgtttgtttgtttgtttgtttgtttgagacggagtctcactctgtcgcccaggctggagtgcagtggcgcgatctcggctcactgcaagctccgccttccgggttcacgccattctcttgcctcagcctcccgagtagctgggactacaggcgcccaccaccatatcgggctaattttttgtatttttagtggagacggggtttcaccgtgttagccaggatggtcttgatctcctgaccttgtgatccgcccgcctcggcttcccaaagtgctgggattacaggcgtgagccacggtgcctggcccaagtcatggtcttaaaagattattataacatttaatatttggaggtcacaagttttttctttgttttaatcaaatgggaaatattttggaaaccatattcagctctgtgccccatatcgctctctctttttaaaggtaatctcatacctttgcgatatactctagttccttcctggcccctaaatggtctttgtaagatacaactcaggaggattattttgcagtccaaagtactcaaaacaaaacaggcttcaatgactcattgttaccctccttttaaactctggtatttcagctatttagatatagtggcctaggtaggcataagatatttcagaaaatgtacgttgaactaccaggttatttcttgtgattcttagagcaggtgaagaataagatgccattctgcccaaagtgaagctgcgatatagacccgggttcccagttgtggggtgtaagtgcacagcccaccctccactatggaaacaccccatggacattctgctccagaggaccagtgcctaacagagctttttcccatgggaaaaatgggcacagttaggagtctgaaaccagcctggtcaacactatgagaccccatgtctaaaaaagaaatttaaaaattgaccaggcatgggcagagtgcagtggctcacgcctgtaatccctgcactttgggaggcagaggcaggtggatcacaaggtcaggagttcaagaccagcctggccaatatggtgaaaccccgtctctactaaaaatacaaaaaaattagccaggcttagtggcgggcacctgtagtcccagctactcgggaggctgaggcaggagaatcgcttgaacccgggaggtggaggttgcagtgagccaagatcacaccactacattccaacctgggtgacagagcaagattctgtctcaaaacaaaaaaaaaaaaaacaaaaaaaaacacaaaaaaaattaaccaggcatggtgatgagcacctatagtcccaccagctactcaggaggctgaggtgggaggatcaccaaagcccaggtaggtctaagcagcagtgagccatgatcataccaatgcaccccagcctggacaacagagcaagaccctgtctcaaaaagaaaaagcacagttaacatggcagagtgattcagtggctgagtccctagttcaggacttcttaatttggagtctgtggtatgctttgagtattccatgaatccccctgaaattatattaaaatgaattagattatcgaaaagcattaaaaagaaaaaaaaaagcttggccgggtgtggtggctcacgcctgtaatcccagcactttgggaggccgaggcaggcagatcacctgaggtccggtgttcgagaccagcctgaccaacatggagaaaccccatctctactaaaaatacaaaattagccggcgtggtggcgcatgcctgtaatcccagctactccggaggctgaggcaggagaatggcttgaacccgggaggcggaggttgctgtgagccgagatcgcgccattgcactccagcctgggcaacaagagcgaaactccgtctcaaaaaaaaaaaaaaagcttaagaacaactatcttctgatttcttttatttcctttcttcccccatcttactacttcctccatatttgtcttacttctcagatatcatcgagtaatttcttgtaggtccttggtgccagtaccaattgctgtgtggaaattggatctgatctacctttaaaaataaccttccctgtttaggatgatagcagtactaccagaacatgtgtcaccttgtacacatgtgtaatgacagccacagtcattacaacctgaaactatgttatgaaatataattaagacaaagcactccaagaatgcaaattttagaataatccttttcctctaatttgattctgtgcagccagctttaagaaaaacacggttaaactggctcctatccagagagccaccatgatagaaaatttaaaaccttttaatgaaaaagttttaaagtaacattcctcatatctgtgtggctttcaatatgctgttcctcctggattagatctaatggcactgctttatggagccctccttcatcctgctcccagccccagtctgagttacacacccattctctactctcaagagaataaaagctgcgcgagcccgggaaccttgtcaatttggtttgctattggatgctcatagcacagttcctggcacagttagttcttggtaaatatgtgttagtggataagtttatcccataacaactcgcacatatatctattatagcaactattctatgctgttattagtgagttttgttgctgttgttgttgttgtttttgttgttgttgtttgagaccgagtctcactctgttgcccaggttagagcacagtggtgcgatctcggctcactgcaacctccgcctcgcgggttcaagcagtcctgccacagcctcccgagtagctgggactacaggtatgacccaccatgcctggctaattttttttttaattatttgtatttttagtagagacagggtttcatcatgttggccaggctgctcttgaactcctaacctcaggtgatccacccgcctcggcctcccaaagtgctgtgattataggcttgagccaccacgcctggcctgttagtgagttacttctctgtcttgcctccctttactgtgagttgcctgatggcagaacctgtgtttttattttggtatttcatgagctagctgtttggtcaaatgaataagtgaatgaagcatttcatattcactcacatgaataggtgagtgaatatattttaaaaaacatggatagccaggcatgttggctcacacctataatcccagcactttgggaggccgaggcaggcagatcacaaggtcaggagttcgagaccagcctggccaagatggtgaaagcccgtctttactaaaaatacaaaaattggccggacacggtggcttatgattgtaatcccagcactttgggaggccgaggcgggtggatcatgaggtcaggagtccgagaccagcctggccaacacagtgaaaccccgtctctactaaaaatacaaaaattagctaggcatggtggcaggcacctgtaatcccagctacttgggaagctgaggcagaagaaccgcttgaacccaggaggtggaggttgcagtgagccgagatcacgccactgcactccagcctgggcaacagagctagacattgtctcaaaaaaaaaaaaaaaattagctgggcgtggtagcacgcacctgtaatcccaactactcagaaggctgaggcaggagaatcgcttgaactcaggaggcagaggttatagcaagctgagatcatgccactgcactccagcctggatgacagagcaagactccatcttggaaaaacaaaacaaaacatggatactagatgactccaagtaaaatgtgagagctacctttaagctattcctgggctgtcctttggaaggatacatttgaggatgactccagaaggcaagttgcagggaggcaaatttggctcacactaaggcaggatgatcacaggggcaagtggtggaatggactgctctggtagtagcagggctcccgttgccgaagacgaccaagcagcagctgcagagcccctctccaggttcactgtagaaggcacgtctgtcttgggtcgaggttgcccacaggatgtctgttcactctaaggtgctctggttccttgacccaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtgagaggacagtgatgggaggctcatataaatgacctttttcatgcaaaaccattttacaaaaaatcttatgagagtttttcatccagggtagtaaaagttggattttgtaacagcagatacagtggtggacagtactttgttttcagaaatatagcacactttcttatgacagttgcatcaaatttcaaaagtgtttatgtatttgacatgcaagaagtgtatgttgcttagtgaattatgtttttctattaaaggttgcatctcagtcattaggaagcttttgcaggaatgtgtgtatttgttgccaagtttatatactatagttacagaactgtggtacagatttcattatcgatacaacccttagtgtcacggtgtcagatataatattttcacatgtcaaatggatgaccgatttgtttcatcgcttactcttaaatttgaggtagctgaaatgaaagaatgtttagtgttcattggagttttatttgtattgtttatctcttcaggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggtacaaatgccattaccaaatgagctgtgtaggaagcagcagaaattggtgcagttcaacaatcagttgtccccacaagcatttgttttaagtataatatgtttattagatgttttaacctcaaaaatgtacctcattacaaatgcaaatagtttagaaatatttaaaataaaatctaaaagatctctaccaacagtcttgttccccaaagatataaaccaccagtgacaggttgctacatatttcattaaactactttctatgctctgcatcttttatatgtgtgtcataacatatgtacatacacccttttacatcatgcacacataagttctttaaaaatgctatgcaaaagtgggatcatattatacatatttcagaatttgcgcatcttaacatgtaagttgctatacatctgattcttatgaatatagcattacattctaatgtatcatatgagtgatatgtttcatatagagtttctcataagtcatatgagaaaatataaaaaaaggaaaggtgaatttgtggtgaatgtggttggatctcctttgagacatcatatactcttcctggctttcacaaggactgctgacaagtcatttctaaaagaccagctccatcctctctatagttttgtttttccttagacttcccttcatagatacacaagatcccttcttttgcaaatcatgcttattctttctggttctacacttagaaaacgaatccatatcaccacctataaaatttcacataggtaagggctgtcaagtttttctttttctgaaaacaaatagcatacatttatctgtattcaacaagtctgttcctcaaaatctttattaatcattttttattgttgttctctgaatattattttaaatattccccatctttctttgaatccacaaagctgcttgtttagaaagatgaaatctgaattttaactgtgtcctggttaacagctgttttaataaatgctagtcccagagcttctgggttcttatgatcttggagttttttggatctcttgtgatcttggagttttttcatcttggagttttttcatcgctaaaatgtatagattgtcatgaagtttctttttcttcttaaattctgggtctatcttcaaataaaatagactaaaaagcagatactatatggttaaataaatatagcacaactgtttctgcaaattagagtcacaagcaatgtcttcacctgagattccacctaaagactaatggaaagaaaattagcttggctcgttgcctacttcgtttttctgggtgatttgccacccatctcagtcagttcagtattcatttcctcacaatcatctgtttgggtttgtttttatttttaaagacgatgtctcactctgttgcccaggctggaatgcagtggcacaatcacggctcactgcagcctcgaactcctgggttcaagtaatcctcctgcctcagcctcctgagtagctgggactacaggtgtgcaccaccacacccggctagtttttactttgtagagacaggatctcattttgttgcccaagctggtcactatctcctggtcactttgtccagctatcctcctgccttggcctcccgaagtgctggcattacagacgtgagtcaccttgccctgtctgtttgtgttttggaaagaggaaatagggtaggaaagcttaagagcaagagcataaagtcatgaagataaccatataaaatttaattctgttattattctcctaagccatggcaaggaacagttcattgagttagtctatgccagctgaaaatcagagtggtcctgtggaactgagaatgaaccaagtgtaagacgatgtagattcagctttgcaactaacaaaccgtatgactttggacaatttgctttcttcattttctttattgatataagaaacgggttgaggccgggcatggtggctcacacctgtaatcccagcactgtgggaggccgaggcaggtggatcacgaggtcaggagatcgagaccatcgtagctaacacggtgaaaccccgtctctactaaaaatacaaaaaaatagccgggcgtggtggcgagtgcctgtagtcccagctactcgggaggctgaggcaggagaatggcgtgaacctgagaggtggagcttgtagtgagcggagatcgcaccactgcactccagcctgggcgacagagcaagactctgtctcaagaaaaaaaaaaagaaagaaacgggttgagttaaattacctcccaattttctttccagatctaacattctgtggttctttatggttttctataaaacagaagagacggatttaaggtcacgatcaggctaatatactctaaaataaatataacagttgaaaggtcaaaaggaaatttcacagactcctttaagcataattcttttgctttcccccacttatcccaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtttgtacttggctgtgagctttaggtacaaggttaagactaggacttgagcagagtctctgaacctactctggcctaggaggctgcttataaaaaaataaaatcatttaaaaaaaaaaaaaaaagaatggccaggtgcggtggctcatgcctgtaatccagcactttgggaggccaaggcagacggatcatgaggtcaggagttcgagaccagcctgaccaacatggtgaaaccacatctctactaaatacaaaaattacccaggtgtggtggcacgcgcctgtaatcccagctactcaggaggctgaggcaggatttatttattttttttttatttataaaaaaataaattatttataaataaataaaacccgggagctggaggtttcagtgagccaagatcgtgccactgcactccagcctgggcaacagagtgagactccgtctccaaaaaaaaagaaaaaaaaggaaagaaaaaaaaaaaaagaatacaggctttgaattctgggactgctgccgttattttggacaagttatttaacttctctgagcctatttcctcgtttgtaaaatgagaatgatgaaagaaattaccaaccaccaaagaaattcaatggggaatgatatgtcctatcaacaaatgagactgaaacaactacatctctatgtggagaaaaatcacccttgttctttacttcacaccatatacaaaaattaatttgagatgaatcatacataaccttaaatacaacaacttaaactataatgcctacagaagaacacaggattttgagatagtcacatattctcaggccacagaaagtgctaaccatggaagaaaaaattgtttaagttggacttaatcaaaattaaaagcatgtgctcatcaaaagaccactatgaaaatgaatacacaagctgcaatctgggggaggactggcagtttcttatcaagttgatcatttgcctcttttatgacccaagaatcccactcataggtatttacccaggataaatgaaaatgcaagtccacaaatagaattgtacacaatgttctttttttttttttttgagatggagtcttgctctgtctcccaggctggagtgtgcagtggtgcgatcttagctcactgcaacctccacctcctgggttcaagtgattctcctgcctcagcctcctgagtagctgggcttacaggcgtgtgctgccatgcccggataatttttttttttttttttgtatttttggtagagacagggtttcaccatgttggccaggctggtctcgaactcctgacctcaggtgatccacccgccttggccttccaaagtgctggaattacaagctcgagccaccacacccagcctatacgatgttcatggcagtgttattcatggtatccccaaattgcaaataacccaaatatccttcagtgagtgaatggggataaattggtattattcacaaataaagtattactctgcattaaaaaagaaaaaaactgtttatatccatatggatgaatctcagaaacattatgctgaatgaaagaagccagacacaagaatacataatgtgtgattccatttatttggagttctagaacaggcaaaactaatctctgagagttacacagttgctacgggaatgtggggattgaatgggaatgcatatgagcaaactttctgaggtgatagggcaggttacactcatatgtgcatttctcaaaactcatcgagctctatactcaagatgtggacatttcagtctacctcagtaaaataaataaaaagaaacaatatgacaggttggttttgagagttaaataaggaagtaacttatacaagataaatggcacagtgcctagcacatagtaagtgctcagtgaatggtggcttattactattactaacagtatccctggacgatgacgctcttgcttgttggaatgtgtttctgcaggtggaatgaagtaacgcgaagaatagaaatgtggatctccatattagaattgaatgagttaggagagtatgctgcagtggaacttcatcaggcaaaagatgtcaacacaggaggcatctttcaacttagacaggtactgagtttgttttgggtttttttttaatgttttctctctgttccactcttacacattgtttctggggattttctaactatttgtatctttattctctaatccttttccccttctttatcccgttccttttcattatcattcctggcacccatactcctccccaccctcttcagggtcattcccgtagagtacaagtcacggtgaaacctgtgcagcattcagggacactgccacttatggttgaagccatcctgtcagtatccatcggctgtgtaactgccaggtccaccaaactccaaagagggttggacagttaccaggtaagacaagcagacttaaaatagtatttaacaaagcttggttaatgcaggtcccagggggacctctttgccaatataacagaactctttgccttaaccgtagatcttcccccagttcacatttccatccattgccttttttctagctttaaaatctgtttgcttagtgtcagttaataataattttatttataaacacacgcatcctaatgctatagtagtcattaactttaggcagattttattttatatctggcccaaaatatgttgtatctttggcattactgcctgacctgatccactttttgggtttttttgtgtgtgttttttttttaaaagatagggttttgctttgttgccaggttggagtacagtggtgtgatcatggctcactgcagccttgacctcctgggctcaaacagtcctcccaccttagcttctgaagtagctgggactacaagcacacatcaccacgcccagctgattcttttattttttgtagagaagggcatgtcattctgttgcccacactggtctcaaattcctggactcaagtgatcctcctgcctcagcctcccaaagtgtagggattacaggcatgagccaccgcacctggccacttttatttatagtgtaaaattattttcatacactgtcataataaaccagttctttgaaagctttacttctttttttgttaaaatttgtccttatgatcatttttgctcattaaatcttcattttctaaacattctcattttaaaaataaaaagatgaaaacctctaagaattgatctaagaattgatcgtattatcagtcagaactattcagtactccatgaaaagaatctctaaaattaggaacttggccaggcgcggttgctcatgcctgtaatcccagcactttgggaggctgaggtgggaggatcacttgagcccaggagttcgagaccagcctgaccaacatggcaaaacgccgtctctactaaaaatacagaaaattagccaggtgtcgtggtgcatgactgtcatctcagctattcaggaggctgaggcatgacagtcatttgaacccaggaggcagaggctgcaagtgagccaagatcataccactgcactccagcctgggtgacagaggaaggctgtctcaaaaaaaataaaattaggatcttgtcccccagtagcctaaaaaaaaatgtgtgtgcttcattgagtccccagtttactaccagatatgaattaggaactgggaagaatcactgttaaatctgcctccctcaccgtcatatgtgatcgggagcactctccctatcgtgccgaggagaaaacatttctctgtggagtctgagtgtaagcccagccaatcttgaggatgttttctcttctatcttagtttccttttggcttcctggctttcaggcaaagtctcttctgaaagctgaaagtcagtgcacagactattgaacttcaaggcagtaatagctttgtcagatgctgcctgccttcttcaagcccaaaattccctctagctcggaacatctgtccacacttcattcagagtatgagtgtaggtgcaaggacagggctgctgtggtttggtaggcttctccaccagacttttccttgtgtgtgtgcagcccgtggagcaggaaatgggattgtaggtattctcatagcagttcagtccttcacttagccatcaacttctacgtggctgcacggtcgaaagagaacactagactgggagtcaggaaacctgggttcttaagtctagttgagctttactaaatggttatcttggctggaaaatttaaactttgagttccccttttctccaaactgatgaagtagacttaataatcctctgaggtccctgtccacaataaaattttgtggcttaataaatctctggtgttcaataaaaacatcggctgtgtgctccaaactgtgacctgcagtataagtatatgggtcatcaactaactaaatgttctcatttgaggaacattccaaggatcaactatttgctgctttttttttttttttttttttgagtctcactctgtcccctaggctggagtgcaatggtgcaatcttggctcactgtaacctctgcctcctgggttcgagcgattctcctgcctcagtctccagagtagctgggattacgggcacctgccaacgcacctgtctaatttttgtatttttagtagagataggggtttcatcatgttggccaggctggccttgaactcctgacctcatgatccacccacctcgacctcccaaagtgctgggattacaggcgtgagccactgcgctcagtactttttttttttttttttttgagacagagtctctctctctgtcacccaggctggagtgtggtggcacaatctcggctcactgcatcttccatctccctggttcaagtgattctcttgcctcagcctcctgagtagctgggattacaggcccgcaccaccacacccagctaatttttgtatttttagtagagacgggtttcaccatgttggccaggctggtcttgcattcctcacctcaaatgatccgcctgcctggtcctcccaaagtactgggattacacgtgtgagccaccacacccagcaactgttcacattttttaaaaaacagctctacctctgagttaaaactgatttttgtcaaattgtaaactttaaaatattagcctttccccagtgctatgtgctctttaagagcatagtgcttaaaatttggactgtaactattttaaaggctttttttttctttgctgccatgttccaggtcacgtctgttaagtgtttttgttgttgtcacagtgttttagaattattctgatgcaaaaaaaaaaaaaagaattattctcatgcagtagctgaaaccaatgcagaatatgctggttttgcaacaatttcatgtcatgaatgcttaggccaattttcagttaatagaactacctccatagtttaaaaagttatgataaattagagccatttgttcttttacattaataggaagcattagttcaagataaattacttcaggattaggattacatttaataagttagtcatataactgataatggtggttaccaaactaaaaaaaaaaaaaaagcagttcattttgaagtatatatgaaaataattttgactatattcttaaagcactttttagtcataaatctaaattaagggattctaggttctcgtttataaggaaaatttttttctaccaagacccttttgttttcaacgtgattactttgttttgccaaatgtttttgcaaaaattgttactttgtttatttattttacaatgttgccctgtgtttgggacagttatgattctttcaagtgattgttatggtcaatagagagtactgaccaatccttatattccaaatagtatgctgttgcttttatttcaacagtgtagtacagacccttgtatgtatatagcctgaggttgccccagctttcccctgggatgattgcatcagggaagacagctgaggttggagacctcagacatggcttacagttctgacctgccattatctgtgtggtcctaaggttaaatcatttcatcctttaaggcttaaaggatgtttgcctcattgctcaaactgagattgggcaagagaatgttccctgtagttttgccactctgtcttcctaagcctatctcaaatctcagtcaaatagtctaccccaaaatacatatcagctgtctgtatgacagtggtataaggcctggcccaattatgttggttcctatctccagctaagagatttcttatttttattttatgtttttggagacaaggtcttgctctgttgcccaggctgaggtggagtggtgtaatcagagctcactgcagcctccatctcctccgctcaagtgatcctcccactttagtctcccaagtagctgggaatacagttgcacactaccaaatccagctaattttttaaaattttttgtacagatggggtcttgctattgttgcccaggcgggtctcaaacttctagcttcaagagatcctcctgcctcagcctcccaaagtgttgggattacgggcatgagcccagccaagtttttatgtttcagtgactctttatgtgaaaaattctttatagacaagtgaattaaatccattttaccttttttgagattcaatttagtgttttattttgcttatgttaggtaagctgtccattttaatgtgtgttaagcttaaataattattttccctgtatgtggtttgaaaaacaaaatgcttgtcctttgtgtttattttttcctaccagagagatgatgaggatggtgatgatatggatagttatcaggtattgctactgctgtcaatcctgtggcatggggcacagctactgctaattgccagcattcgcaaagcagaggccagggaggaggaaggagggccctagagcgagaatatgcagtttttcacttgcttttgatttgctttatatgtattcaaacacaatattatttctatagatgccttgtcagttcaaaatttataactaaatattgcctttttgctatgccatctcgatttactggcttattgctaagcaagaccattatcactgtattaaaatggatgatctggagactgatttgagtaataataaaactcctgtctcctgcaaattaattaactaattaattaatttaaaaaatggatgatcttaaaatattgcagttatccatccataatcttttagatagactcttatctttcccatgctaaagtgcattctgctccttacatccaagagctaatattgttgtaatatgccattttactttacaagacttttgctgaataggaaaattggagacattttatgcgcataattgtgttttgtttagccagctttcttttctcatttgggtcacacttagttctccataacctatagaatttaaatctcagctttttctggttgggaatctagaaaaaatatatagatgtgcaaattgagattgtacctagtcagcactgactggcctgatatcatggagtgtggggttacgtacaaatagtcaaagcagcaaaccaagatgaagctttctgggttcggttcccagtctttgtacggattctccatacacatcttcaaaggatgttttcccagtgtgccttcctacatgtaaaatgtgggtacagtggctgggcgtggtggctcacgcctgtaatcccagcactttgggaggccgaggcaggtggatcacaaggtcaggagttcaagaccagcctggccaacatggtgaaactccgtctctactaaaaatacaaaaattagctgggcgtggtggcgcgcgcctataatcccagctactcgggaggctgaggcaggagaatcgcttaaacctaggaggcagaggttgcagtgagccgagattgtgccactgcactccagcctgggcgacaagagcgaaactctgtttcggggaaaaaaaaatgtgggtacactgttggtaaagtttcagaggtccaagggctctattcttgatgtaacgtcttaagtcttaaactagaattaggcaagtcaaagagcatttttaatagaattgatggattttctttccctactcataattccacgaagaaaaacctttaagggaaatatcagtatccccttgaatctcagcaatgccattgactaacgtcctgcggctgtttgtgcgcttcctggcacatttttcacagtgcagtccaatggctgcctaggggatttcttaaagcatggctgactgcatgttggagtttgcatgggagatttttgcttagcctcgtggtggttggaagtaaaatgtttgtggcaagtttgaaaagttctctgctgacctactctttgcatttcagaaaatctatgttatcagaccactgaactatggagctatgaaaatgcctgtcattttccattccatttgttgttacttggtttgggctctgttcatgctgtccttctgtttgggatcacaaatcctgcaatgaatagctacgatttaaatatacatacactcattgtaaaaaaaatctgacagctggtatagtttgagcttgtcttgcttttaagtataattatccttctggagatccaggggctctgatttctgggtaacagcatccttgatcaacatgcagtgttactgaggcctctctgctttcttgcatattaatcacacagcaatgttcaacagcttttcctaatgaaaaatttcctagttgatttaaacatcttttaaaaaaagaaagaaagaaatcgttgtctgtgcagtctacaggaaaatattttccctccctgatgttaggaagaagacttaaactgcgtaagggagaggtggtcagatgcactcattaaacgacgagaatacctggatgaacagataaaaaaagtcagcaataaaacaggtatgtgagatcaaactcttttatggggagtagctttttcacttttacacaatggcagtaggtcgttttcttcccctaactggacagtagtatcttatttttgttgttgttgttgttgttgttttaagacagggtctcactctgtcacccaagctggagtgcagtggcaggatcatatctcactgcagcctctaactcctggcctcaagagatcctcctgcctcagcctcctgagtagctgagaccacaggcacaagctaccactcctggctcatttttaaatgttttgtagatggggtctcactttgttgcccaggctggtctcaaactcccggactcaagtgatcctcccacttcagcctcccaaactgctggaattgcaggtgttagccactgcgcccagcctgtttagttttgtgaacttgtaacaattatagacatcagtcaatcatattatacattgttggtttaagaggcctccaaatttgaaagtagtaagttttcataaaactcagaattatctcataaaactgtgacattaaatgtcaaattcaaatttcgttttgatgaacacaaatgtgatcaataccagtatgtcaatacaaggtactttaggcaccaggacctaggacatacagcagctgaagggtcacttctgaaaccaaaccgcttagcaggtcagcacctatccactgttgggccattgccatgcactccgctggttcagggtggcccctacaactctattcactgccactcagctccaagggtgcagtttgcttatgctagcagtggccacttggattctagagtagaaatatgcacttaaaatccttagtctgtcatccagacatcatggtccactcacggtggttggttctgcagcaaagaacatacacatcatgcatgttaatccatttcatgtagaagctagcagaaagtctccctcaggaaaacaccttggctcaacatgtgatgtcgccttgtgtgtgtgctcaggctgctaatgaaaactcacttagactgtacccagggagccccagagttgaattatgaataagaggatttcaaagtatatcagataaaatccctttcatgataagcctcgaggaaaataaaggtgattttacagagtaagatatatggtgggttttttatttttttatttttatttttgagatggagtctccctctgtcgcccaggctggagtgcagtggcatgatcttggcccactgcaacctcctcctcccaggttcaagcaattctcctgcctcagtctcctgagtagctgggactacaaggcgcccaccaccacgcctggctaatttttgtatttttagtggagacagggttttaccatattggtcaggctggttttgaactcctgacctcaggagatctgcccacctcggcctccaaaagtgctggggttacagccgtgagccaccatgcccggcctatggtgttttttaatcctgtctttgtaacatcatgtatagttctataaagcagtgtcacatccgtatttcatttgatccttccagcaagtacatgaagtagatacgacttcttttatccctgtttgacaggttaaggagactcatctgttggataacttccccaaattacagaaccagtaaaataacctcagtctcataattgctgttccaatgctctttctgctatttctggcttgcagttccttaaattggtgttgaagcccctcttagctccctatgcatgctcttgcttgaacttcaaagactcaaatccattttagggacatagtggatggttaaaccacttatagatagcactgagtgaaatctgtttattgtttttgtttgcttgttttttgagacagggtctcttgtctgttgcccaggctttagtacagtaatgtgatgatagctcactgtagccttgaactcccaggctcaagtgatcttcccacctcagctgcctgagtatctgggactacaggcatgcgtaccaccaccctgcccaactatttttttttttttggtagagatggggtctcactatgttgcccaggccgaaatctattccttgtaaactgagaagtcatactttctctcttgttggcattgatctcctcatttttttctgcagagaaaacagaggacgatgtggagcgggaagcccagcttgtggagcagtgggtagggctgactgaggaaaggaatgctgtgctggtgccagccccaggcagtgggattcctggggcacctgccgactggtaaggctgccctcccttctgtgcagacctggggagatggtacaggtcgcctgtggcaagagccatgcaagagactttccaggattgtcacagaaaatgccaaccagctgaactacttagggaatgtccactcatctctaatgcttccatccctttttttccttccccaccgaagccaactttctcccacaggaagcgagagagcattgattacctggccaggaatcacataccactcctctgttcctctgcataagcaacttggacattgttccctgatgcccagaaactcttttatcttggctggaaagtatttgaataggacagaaaatatattagtggagctatttttttggtagtattgtgagaattagagataatgtatataaaataccttatatatgataatactatcttgtatattgtaatgtgtataaaacacctttcatacccattcattaaatcctagctgctgctgcttattctcattctcatttttattataacatatccagggcatttaagagaaatcagattccttttgaacacagaatgtacatgcccagatagtcttttttgaactggcatagaaacattagtgataatacctgcatctctaatgataaagggaaaagtaatcagtttcgtggtctgttttctgaaactagagactctgaatctgcaggcacataattcataacctgatgtttctccctgcagttcctgctgttgtgctggaatcctgtaggtctcttgcggtaattctgccagccacttcttatagacagcctactcaccccaatcttgttctggccctcaaagccctctctagacagtttgtctccttacttcagtctctctcgtgtaaagtgttttcaaacttcagatcatcttgagtgtttgtaacatgtaggcctgggtgtcatccctagttatgttgattcagaagagaaaggaaggacccacgactcttctttttttatttttttaaataagaatttgcatttctaaagggactcttcactttaagaggcctctgaggcggttctgatgcagctgggcaagttgggtttttttgtttgttttttgtttttttgagacagggtctcattctgtttcccaggctggagtaccagtggcacgatcttggtgcgctgcaacctcgatctcccaggttcaagccatcctcccacctcccaagtagctgggaccacaggcctgtgccaccacacccagctagtgtttttttgtttttttttataagacaagatctccctgtgttgcccaggctggtcttgaactccagtcctcaaaccatcttcctgcctttgcctcccaaagtgctgggattacaggcatgagccaccatgcccatccctgggccagtttttgataaaacactgcttggtctcttctgtacacaaccctccctcctttcacacatctttcattctgtcctttgagctttgagcttttgtttacttcctctaggctctgatcctgtcccgttaccaccctaacaacatccccccttccctttacctctcatgggaattatttttagaaaggcttaaaatcatctttgtttcaattaattacatgtaactcatataactggaagttcttttatgtaagtcatataattcccatgatttatgtctacagggaagtcaagaaatatgaaagtatttcattagtggaaactgcatctccaccatggttctctttgcttccacagctctgtggtgttttatcagctaacaagatgtaaaatacatattttgttatgattaaatgttgttattaaatttaggatcccacctcctggaatggaaacccacataccagttctcttcctcgatttgaatggtaagtagacacttaaagtcacagggattattgtatttaactaaggtttgtaatctatccagattcacattattttgatccttaaatcactcttctaatcattcatgtgccaaattgggtgacatttttgttctcattaaacgtatataagcatgatatgtggataatcaaaaaaagagcacatagggtgattgagaactgcatgcacgagcattagcacagttgctctgaaacagtggacatagaaattaccctggaaagtaatcacccctagagattctgagtctttaggcttggcaagggcctatgaatctgcatctctgactagtgcccttaactctcctcaaatagttttgatggcagaagtgatcacactataaccctgccttaggggttgtccttcatattgcaattagatggaacctgggcaagtctagaacaatggtttccaatgtgctttagcagaacaatccttttctaaacgaaatattaactggaaccccatgtgtagaaaacaacggcagagttgctgagtttgcagtgggcaggatcctggtagatcctttggcagggccctagggctcctcaaaacacagcctgaaaacctctgttctagaaggaagcccaaaataatggatggaagacacagggagggtggctttggctcttcatgtgaagaatttcttttttaaagcctagatgttgaatgtatgcctcataagatagtgagttccctgtcataggaggtatataaacaaagactagttggccatttacagagatttgtgaggggcgaaccccatattggataggatgttggaagaagataatcttcatatttctcccaagtgctcagaactttgattctaaattgatttcattgctaaaatctctaatttatagtaagttattaagtaggacaacaaacctaacagtttacaggaggaattgacctcagaaagcagcaaaattctaagatttgttttgttttgttttgttttgttttgttttgagacagagtctcactctgtcacccaggctggagtacagtggcatgatctcagctcactgcaacctccgcctcccgggttcaagcagttttctacctcagcctcccaagtagctgggattacaggcacccacgaccatgcctggccaatttttgtatttttaatagagacggggtttcaccatcttggccaggcttgtcttgcactcctgacctcgtgatccacccagctcggcctcccaaagttctgggattacaggcgtgagccactgcgctcagcctccgaggtgtgtttaatgaatatatttgtacctaggacaacaaagaatatattcattccatcttataggagactcacaaggcaactttttggctcctgttgtatttttaaagaataaaagcagccgggtatgttggctcatgcctgtaatcccagcactttgggaggctgaggcgggtggatcatgaggtcaagagattgagaccatcctggccaacgcggtgaaaccccgtctgtactaaaaatacaaaaattacctgggcatggtggtgcacacctgtagtcccagctgctcgggaggttgaggcaggaaaaccgcttgaacttgggaggcagaggttgcagtgagccaagatcacaccactgcactccagcctgggctacagagcgggactccatctcaataaaaacaaaaaaagaataaaagctgtggggcacgatgagcttatgcctgtaatcccagggcttttggaggaccatgcaggaggactgcttgagttcaggagttggagaccagcctgggcaacaaagatggactccatccctacaaaaaattttacaaattagccaggcatagtggtgtgtacctgtagtactagctactcaggaggctgaggtgggaggatctcttgagcccagaagttcaaggctgcagtgagctatgatcaggccgtgcactcaagcatcagcaacagagcaagaccttgtctcaaaaaaaaaaaaaaaaaaaaaacccaagtacagtggctcacccctgtaatcccagcacattgggaagtcaaggcaggaagattcattgagcctaggagttcaagaccagactggacaacatagtaagacctcatctctattaaacataatgattttttaaaaaagaaaaaaagctgttgtgagtcttggagtctctatttcaactgcagaataaggaatgaaagaaaaaagaaaaatgtgttatgtgtaaacttcaactgtaaaaagcatatatttaaatttttggtgtttgcttaaaaactgactttcccctactgttttttctgtgctcctgatgtggttagcggatgacctcagtgccaatgagcagcttgttggcccccatgcatccggcgtgaactccatcctgcccaaggagcatggcagccagtttttctacctgcccatcataaagcacagtgatgatgaggtaattaacccccaagtttctcttaaaaggcttcagattagcacacaaggcttgtgggcctgctcactaaactgctatggtttgctttggggaaaaagaccggggactttaaaaaatagaacatttgtgttgctgtttaaaaaaggtgaggaaagaaatctatttgattacagtgagttgaatttattttctttctcttgtatgtcctgtaaaactgctacatctgacttttgtcttgtttccatctcctcatcattccccaactcctaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacaggtaataacggggcctgattgtgccattctggctctgagctcaaaagatttttccctctctctatcacaaagcagtgttttttggtgctgtgatgtgcaaaacatgaccatcctggccaagttatagtctgattctcatttatccaaggtagtgggcattaggatagcagaggtcaatgtcatccagtaagggcagtttcaccttgactgattggagaggtgtaatcctaccaggcagtggagctgtgatatttcactgtttgaaaagtagaaaaactgaggctgagagattaagtgccaggtccaagcaagtgagtgacaaaaccaggacaaaaggcagactccaaacaaatccctatcctactgctttgacggatcccatctcagaggtgctgtcagtgaaactgatcctctccagtgttgttctagccatctcaggaaagactgattaagccctggagagatcacaggaaggcagcagatgggagagagaagcaaccacagaaatcctgaacatgctgcagattctgtagtcaaattcccaactaacagctggacgttagtatcccttggggttggagacagggattcttagcttcagttttttctgttatgctgagtattctgcatttcaaaaacatagtaacttgtaatgcttctacaatttgtaaaatacaaaataactggctgggcgcggtggctcacgcctgtagtcccagcactttgagaggccaaggcgggcggatcacgaggtcaggagatcgagaccatcctggctaacacggtgaaaccccgtctctactaaaaatacaaaaaaaaaaagttagccaggtgaggtggcaggcgcctgtagtcccagctactcgggaggctgaggcaagagaatggtgtgaaccccagggggcggagcctgcagtgagccgagatcgcgccactgccctccagcctgggcgacagcgagactccatctcaaaaaaaaaaaaaaaaatacaaaataacttacatttgtcacatagcttaatacagcttttttttttttctactagagtttcacgcagagtttgaagaggagaatatccctgaaaaatatattttattcctgtggtgtaacctatgaaatagtatccaatataccaaaggtaaaatatatgctactttaggccgggcgcagtggctcatgcctgtaatcccagcactttgagaggccgaggcgggtggatcacctgaggttgggagttcgagaccagcctgaccaacatggagaaaccctatctctactaaacatacaaaattagctgggcatggtggcgcatgcctgtaatcccagctactcaggaaggctgaggcaggagaatcgcttgaacctgggaggcagaggttgcagtgagccgagatcgcgccattgcactccagcctgggcaacaagagcgaaactctgtctcaaaaaaaaaaaaaaaatatatatgctactttaaaaaatatcagtatctaaataatggagaatgtgttcattctccagacttctaaaacgttttctcaccacactttggatgaaaacgttgttcacatcaaagtattgtcacttccttcctgtcctcgtaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggcaagtaactgaatatctggaccgaggatgaaagcaccagccttcacccccaatggacagatatgaatttacttaccaaacacctcactaaatctatcagagaaggagcacttgagccatctctattgaaaggactctggcaaaatagtaaccaaaataaaaataatgactaacttttattgaataacccctacttgccaagcactgagcctgagtaatttagatatattatttcatttaatcttcaagataaccccctgaggtaagtactgttgaaatccccattttcaaatgagaaaattgaggctgatagaagttagctaactcacccatggttacacagctaggaagtggtacaaagtcggatgtaaagccaagtagcttgactccaaagcacatatgcttaaacacagacttactatctccctaatttttagacctgagttaacttttgaggtgacgacaggtcattcaagtgaaaataatccactaagtaatgcaactataagataagatatgtcatttcataggagcaatagttgacattattgggggaggtgttgattaataggaggaatgtaattggcatctgtcagaaaaatcttcccttagtggaaatcccacctgaattgctgcatgagtaaaatacaaacagcatcacacttcattgtcattttgcaaatgagatacatagttagaagtacctcttctacattttctctgtccacctgtataaaaatttcacaacataaatgtcttccattctgctgttttcctggttttatttatttatttgtttatttatttttgagacagagtcttgctctgtcgctcaggctggagtgcagtggcacaatctcagctcactgcaacctctgcctcctgggttcaagcaattgtagtgcctcagcctcccagatagctggaaccacaggcacccaccaccatgcccagctaatttttgtattttttagtagaaacagggttttaccatgttggccagctggtctcgaactcctgtctgtgatccacctgcctcagcctcccagagtgctgggattatagacatgaaccaccacaccctgcagttttatttatcttaaaaaaaatatttttgataaattgctaagcaaataataataagtgggtaaaataatatttcagttttataaatgtgtatgtatgtagaactgatgcagtctatatttaaatctataaataaacatatgttacttttataattagaataaaaaataaagtaatggccgggtgcggtggctcacgcctgtaatcctaacactttgggaggccgacgtgggcagattgcctgagctcaggagttcaagaccaacctgggcaacatggtgaaaccccgtctctactaaaatacaaaaaaaaattagccgagtgtggtggcgtgcacctgtagtcccagctactcaggagactgaggcagaattgcttgaacccaggaggcagaggttgcagtgagcagagatcgcatcactacactccagcctgggcaacagagtgagactctgtctctggggaaaaaaaaaaaaagtgttattttcaaattattatgtttacaggccgtcacagtcaaagaagcactttccaccaaagcccggcacattcggaggagcctcagtacaccaaatgttcataatgtaagtgcatcctgccaaggatctgctcctatgtgacatgtcgcagcctctggggtgggggaaggtgggattcacacagtggcagtagagcttatggaactggtgtgggcatcccaaagtgtagcctgcttctctgtaccagggacacacaccaggcagcacagttgtctaagactgagccatttgttcaatcttatgaattcctgttcagcaagttatctccttgaaagaagttccttaagatataaattgagtttagttggttacagatggtggagtcagctatgaatacttgcacccgagtccctggacgctggctgctccagggtcagtttttgtgcccattctagctgccctggtggctctgagtctgccaccatcagtgtgataaggagtcagccactgcatgtaggcactcttggagtccctagttgttcctttgaccattttcgttatttttctcaaccagttaatctagaaaatccaattgacagaaactgatcctagcaggggggacactgtcacagagggataggacagattagtgcatggagcacttctaagcagccacttcccagaagcagctgagtagaagtaaggtctttccaaggaaaaacacaggcttatttgccttcctgttctctagaattgccagaaaattatttaaaacatggtggccacttacaaaaattgtcctacagtgggctacagagcaaatcccagtaattattatcacacagattacttcttctgaccacaatgcatttattagaaatagataagagagactcatatagttgtaaattgaaaaacgcttttcatgaactcatttctcaaagaagaaattatgatggaaattaggatgtatttagaactaaatgagaataaaaatgatacatagatcagtgtttgtgcaatgcagctaaagtggtacctagaaattattagccctaaattccctataattctgtataaagcagaatactagacagtagaaaaaatgagagagtgagggctactattaggaaatatatagctcttatattaaaaagtagagtaaaaaagaattaggtaaacatctagcttaaaaagtaaagaagatcgggcacggtggctcacgcttataatcccagcactttgggaggctgaggtgggcagatcacctgaggttgggagttcaagaccagcctgaccaacatggagaaacccggtctctactaaaaatacaaaattagctgggcatcgtggcaggtgcctgtaatcccagctactcgggtggctgaggcaggagaatcgcttgaacccaggaggagattgcggtgcgccgagattgcgccattgcactccagcctgggcaacaagagtgaaactctgtctcaaaaaaaaagtgaagaaaaactgcttatgaagtaatctaaaaaaaaaaatatttttttcaacctcaatctgatcaagtaaagtcttttggaagccaaggcgagaggattgcttgaggccaggaatttgagaccagcctgggcaacatagcgagacctcataacttgatgttatgccaacaaatgtaaaagcttaaataaaatggaaatgtcctgtaaaaactgaatcaagaagaaatagaaaacctgaatacagctatcaccaaaaagaaggactatactaaaataatgactattactatgctcgttgatgagaattcacagtatcaaaaaattggcatgtccttaagctaatcattctcaacagaattttttgtaagatttgataagctgattctaaaacctgtatggaaaagcagtcaaaatatactcctgtacaacccagagattacatcccttagatatatactctagagattctcataaatatacaggttgtatttagaattaaatgatactaaaaatagtacacatatcaatacttgactagactattgaataagaccatatatagtaagataccacttatgtgaagcataaaatatgcaaaataatgttaactattggttatgagtatatacacatacaattatataaaacttatatgggaatgataaaccccaaattgagagtagtcactactcctggagagggaagaaagaggaggagaagaatgaagactgcaggcttcaactgtgacattctgtttctttatataaaaaaaaccccttatattaaatatataaaccacattgctaaaaccattcttctcttataggtctcttccagccgaccggacctttctggctttgatgaagatgacaaggtatgcacctatgggcatggctaggtttttagtagaatcttagtctggaaagttgtgggatcttggtgtttttaaaatctctgggcctcacctggttgatcctgtcagtttaaaaaaaaagaaaaagaaaaatctctgggcttcccatcttaattgtaagcaaataactctctccacaactccatttccaggttcaaatacttgatgtgatattgctttgcacttctttttttttttttttgagacagagtttcactcttgttacccaggctggagtgcagtggcatgattttggctcactgcaacctccacctcccaggttcaagcgattctcctgcctcagcctcccgagtagctgggattatagtcatttgccaccacacctggctaattttgtatttttagtagagatggagtttcgccatgttggccaggatggtctcgaacttctgacctcaggtgatcgatccgcctcggcctcccaaagtgtttggattacaggcatgagccaccatgcccagacaattgctatgcactttcagtattacattgttacttaccatgataggttccataccaggacagtaccacacataattgaatagatatctgtgtgtttatgggtttaactctaaatgattggagaaggtgttacatccaccatagcataatcaaaattatttcaatgggtaaaagaggggatttaaaattaaggacagattgcaacatgatcttattcaacaaatatttcttgaatacatattatatatgagttactatgctagagactagatgatccaaaaggtataagcacagatttatgtccttaagaagtttaaaatttagtcttcagaggcaatcaactcctgataagttgacataagattaagtaagctcgtatgatatgccagcgttttctctgttttgtataccaatactttatgcctctttgaaacttttaaatctcaaatataggtagagtaaccacactgccaaatttgccttggacagtctcagctgtgccttctacccaggcagaattactaatggaacagttgtcctttgagagtgtttcagtttggtcattaaattatcaagtcactctgggtatatgccacattgctcaaagtagctacctctggggaggaaggaagatgaatgggaccaaaagatcacactacatttgtaataattttattaaacttgagcaaatataataaaatattaacatgtattcactccgggtataccttggatatgacagtattttttacgatattcagccctttctgtatatttgaaataaatcataataaaaataaagaagagcatatgctgccattaaaaaaaaacagaagaaactccaacctgggctttatttcttattttggagtgattcaattacagttaacccatatttttaccttgtagggttggccagagaaccagttggacatgtctgactatagctccagttaccaagatgtagcatgttatggaactttacccagggattctcctcgaaggaataaagaaggtagtggtgagattattttgcagtgatatttctttgtaattacttagaaaaagtatgaaaaaatgtctttcattaatggcatataataagatatgaagctgatattctagttaactagatgatacaaaactgttattgaatgtaacatataacattcacttatttgatttatttttgttttgtatccaacatatcacccaaataatcatagactttttgtatattactttagaacttctgaatcattttttgtcatcatttcctgactttcaagtccagttttgagacacatacaaatcctattattttctaccagaatatccagctctgtcatatttgtgtactcaaaggaatttttaaaagaacatgactttgattcataaagcagttttcaaaaacgatacccaaaatgagtttgattcatggtgacattattacctaaattatacagtctaccagtgccttaatgggaacagtattctttggccatatatatcggttctgttaccttataccttatattagtaggtaaaatataaggtatattcgccattatactaacaaattggaaagggaggaaagaggccaaaaaggtaagaaatgatacaagcaaggaagaagaattgtcctcccttagtcatatatagcagggtggcctgagggggaaaaaaagaggctcgcaagaaaatttacacagtattaattcattgaatatttattgagcctctactttctgtcttataactatggaaataagatacacagaaaatgagatgttaaatgataaggtgccaaaatgaacatgcagataataagggctgtgagaattcagaggaatggaaaatcagcgtgagctgaaattggtctggttagtggtgcttaagctggatcttgaaaagagtgtagaaatttgctatctcactttgttcacacagactagcactttagtaactctttgtgacatcacagatttatgtctattcttgcctacatctgttccatggttttttgggggtttttttgtttgttgtttgttgtttgtggggtttttttgttttgtttttagacagggtctccctctctctctcttgcccgggctggagtgcagtggcaccattataactcactgcagcctcaacccctggggctcaagcgatcttctcgcctcagcctcctgagtagcaagtacaacaagtagacaccaccatgcctggctatctgtttattttttttttcacagactggtgtccctatgttgcacagggtgggcatacatctgttttaatgcttagccaaatattagcctatgaatttcattgttctcccagatattcccatggctgggtcattgtctcagttcctatgttttgcttaaagtgttcagcatctgtaacctcataacttctcatcttccctaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggtaaatgcttgacttgtctgtactatgcagaatagagcagagttgtgtcacctgtgaagcagcagtgtgcattaacaagctgagtgctgcatgtggacatgcacggtcatcactccatggttcccgttctcgaattcctctttctcaagcatgcagagtcatggtagaatctcttgtttgttgttgctgctgtggttttatttctttgtgtttatggcttttcaaagtatttttttatgtttcaagtgagaaagatgttttctaggtgttttgaaaagattaaaggccttttttaaaattatttttcttttttgtctttttggggatttctgattttgttttttatagagatagggtcttgctgtgttgcccaggctggtctgaaactcctggcctcaagtgattcttttgccccagcctcccaaggcactgggattgcaggcatgagccgttgtacctggtcaaaaggctgttttttaaataagactaattatgctttttgccacagaatctgtttattcctgtcatatctctccagtagtttaactctggcctgcagaattggctgctgcattactcacatgtaataagagtgttagcattgcttttctaacttgcatgtacttaatatgtattttggccgttgtcgtctttgtgtgtgatgcatctgtgtgtcttaacctttgcagagcatgcctccacctcaggcacataaccctggctgcattgtaccctcaggaagcaatggcagcagcatgccagtagaacacaatagcaaacgtgagaagaagattgtaagttccggaaccatttctgtcatattgcctggtggtgggtttaaggccctttcacagacaatcatccaaatgctagaagaaattaagacatgtattgggtctttgtcttaaagaaaataaaaatgtgaccattggtaatgatattttgcatggatgtggccatgacctacaattttatcttatttatttatttattttttgcttaagtttgcttagaaaaagggagaaaggcacttttattgcttctggcctttataaaaagtgtaacaaagagatctttttaataccaaaatctttctaatgtgcctatacatattgcctagattctgaagttaatctacctagaggaagtgcacttacttggagtaagtaatcatgcatttaatgcatttagctgtggatatgtttggaagcttttttatgttgcctgatgctattgccaagataattctgtagttagagctgcactacaatctatcataatcacccttcatcgtctcactgtctagggtagcctttgttaattagctggcaaaatatattccaataccttggtgccagccttgcattcaggatggcttatatatattttgccacaggtaggctgaaactctacccacaaaacctcattccttagcacttggttttaaaattattaatttgagatacagttttaaaaacactgcataccaggcaccttaggttataaattatacctcaatttacaaaaaaaaaaaaaaaaaaaaaatcctgtttattctcaagcctggaaagaattctctaaatttttgtctcagctttcactctcctgtggcttcctaggctttgaaaaagtaaaaccagctcagggagacaggagactgcttgatgtttatgtcgcatctcatcgtctctattgggaagagtgtagggagtctcattttccagcgacaccatgtcagacccattcccaattccctcattagtgtgggatcctttaacagttcctaacgcacactgtgtgagaactaactaactgcagcttaatccagatatgcagttggccacccacctgcgtgcttggggtgcgggtggatcttcagaaacaaccttctcattcctaatgtgaagaaagaagaaaagcaccattttccctctatttcttcatccctcttcccctcctctgcctttggtttctccttgtccctctatcccaaagccctgtcctagttcctgatggagaagaatccgcacattaatagctgctccttcatctctccaaatcttactgagctgttctctcacttacctgaccaccctctgctcaattaataagggctgcagtgtgggctaaaaaggccaaatgactagttttttcccctgccaattctctggctctgtgtctgattggatctgtttattggcatgacacttatcactggtgcacagccactcaatttaaacctattgcaacgatacattttggtacaacaccatcaagacactgctggatgacccttctggggtgttcagcagatagtttcacagttcacagagctaggctcgtgttttcttcactttctctttaatattttaaaataaaacccatctcggggctttcagctagcagagagaaggatggaaccagattctcttgacccaggaagtctcaagcagcagttagactctgtgactgaatgcaccatggagtacagtaagaaggacttgatggtgttattgttcttgctggagtcttacttgaaaaagctgtctctactctccataggaaactggcttgctgagcactctgcacctaagaggcaattgggctctttaattcattccagacagcagtttttcaaggtgttttggtagagattaagtgcattatttgtttgacctgaggttcttgtttctctttgggaaactttaattttgttttttctcttataaatgggtacagactgttttcttcctttgtgactaattcacgttcttttctcttccactcttgaacaatcagagtgactcagttcagatgatcaagagagtttgaaatcattcttgagaagaacagcatcaagacattgttcctgttaatgtttaacccacctaattaccatagtaacttctgtaatttcacataaaatatagtaaacatggctatgcttgattctttaagcaatattttgttgtttgatcaatttgggaagacatacagatgtacttcatgtctcatgactaagacagaagcaacaatatgcctttggagtctgtctttttaagtcataaagcatagagaatagcagaaagaaagtcagtgatttttcccagtatccacacgacctttccgttaggtcttgcatagacagcatgtggtttattcctctggtttacagaagaagaagcaaagggttagaattgttgagcaacttgctcaaggtctcacagttaatgatagcataagaccaaagagccccattcctcagcataattaaggggactccagtgactccaggtgctttcaaatatagtgcaattccagtatgccctgcagctgctcttcagataaagggctcactcctcagtaccatggacagaagtactggagcccttggctggtgcagttctgcaaacagagatctctggtgaacagcacgacatgattataataggagtggaaattgcattaatgaaggaaactccttacaaagagtcactgctttaatgtggatttcagtccctttttaaaatcaaggtgttttct

SEQ ID NO: 16040 - DNA, 83697 bp, Human
ggtctgtgacataacccctggaaaatacccaggctgcccaatggaagagtcactaatcagatattgaatatgatatttttgtgttcaaattttcaagtcctcacacccatcctaactaatttttaggcctttcctttaagacaaccaaaaaacaaaactataactgttcaaacttggaactaaggaaaggaaataaatattaaagcggagctggatttatttctatttatttagagtacatcacctccagtagaattatgttgctaaggttgggatcacggctttggtctcgcgaagggacctgctttgcagatccagggctcgtttaattttccagctgggttcctgctttgcttaactaatcctgtgcaccccgttgtgcggtccacacctgaaagggggagtttcgatgttgtggtttattaaccaggtactttccattcactcagtcaacagaaagaaagagagagaccgcgcctcctactttttttttttttttttttttaactacaaataaggagacggaaactattaaataagaaggggggaaactcccgcatatttcaccttgacctggctggactggtctgctgcctctaagaggcgggtgttgtattaaaatgagaggtcaaactcctcgaatgggaatcgctcctgcccctagagggaaaagagaaccatcaccgtgttaaactggaaacactgccttgtttccaatgcgggggactgagttccctccctcgacttagcgtggtaatgacaggacccgaggaggcgcgctgcttccgggcagttgcccagcataacacccgcaccctacttgcacctaaatttctgagctgcaagcaggcagaagtgccttccactttctctccttagctcccctctccccgctttgctgctgtctgtaactttttgttccgtttactgggaaggtgacgcttaagatcaaaagacccactgtaacttgcaaaagcccagagccaccaccagacgctggggaaaaacagggctgtccagtccagggttaaggttttgagcagagaaggagcagcgagaaatctcggccagtcgctccgggaacagcccctgcagactggtccaactctccaaaggctagggacaccggggcagccttgtggtggggtagaggacgagctcctaactgcaagcaaagtgctgagtagagggcgttgggggcaggggaggtcccttgactccactttgtatgcagcagctgcggggcagtgagtatctccgaacaaagcggcgagcagcgcgggggtgagagattggggtttgctcgcagctgccgctggcgctgagcgagtctcccaccacccccgcgagcgttggggtgcaaggattcgggggaggagggagaagggaacgaggcgtgccattcctgttgcgcggctacgcttcaggagttcttgtgaacgatgggaatggcaactatcagagccaagggggaaaagaaagagctggagtgagcaaaacaaagagcgagtgtgggccgcggtgacttcatgcctcaccaatgtcccgcccacgctgctccgagctgttactgctgctcctgcccgggctgcagccgcgcctgcgggcagccgaggcgaggcgctccggtagcgtggggaggtttcctagcaactctctgccctgagtgcacccggctacccgcaggtctggagccccccggggggccagagcaggaccacccctctcccgcccatcgccggcctcgcctctctcgcatcctagccgtgtgcaccccagagcgcgccagcaactcgggctctggactgcgggacgcctgagccgcgcactgaggcgaaaaggacaagggcacgcagcccccgccccgcgaagccgggctccggcacctcgcggaacctcccctcctgcgctcgcagccgcaggccccactccccgccagggagggagcggcgatgcctcgctctgtgcctgcgggtgtcggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgcaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtggtaagttgttttgttttgttttgttttcttctcttccccaaaggtcttgggctggcacgaagagctgcccggccagagcatcccggccaggtaagttgcggtcatcagagaacttcaagggggcgggtgcggggcagcgtcctccagcacagatggcctagaggccaggtgtcaagcatttctgccctggagcgacagcaaggactaattatcagaggagacactctgtgttactcctaggtgttgaggaagccctaatagaaaggaattttggaaaagagggtgtcctgtttacagaagtcatttaggggccctggtccattcttaagggcatcgtctgtacacaatgttctccctatctttctaacatttgggtccactaaggactaacttgcctttaactcgaggctgtagataagttggttataatgggagtagtcttcaatttttgagtccagaaaaagacagcatacaagtttctgctatcattagtgctcaatctgaatgaattacccacactggagggatattaatgctttaagtcatcatcctttcggcttaaaaaaaaaaaatactatctaattgatccctcactgagatcaatctctgagacagagaagcagaaagaactctgaaccaggattaacagctttctgtccaggcaaaccatttgtgtaagagctaccttaatgtggagaggttaactctttacgaaatgcattgtcctcatctgtaaaacgaggtttattaataatacctgccttctctaaatcacaaaggaaagttcaagtcaaatagcatatgagaaggtgttttaggacttttgatttatgaaacaaaatcaaatgtaaggtggtataccagattggattgttggaaaattacacaactaagtaataggacgaatcatgagtttaggatgagttcttaatggttttcaatataggcccaacatttatttttgctaatgcagtgactcttgtcatactttctttttttttttttttaatttcactttttctctgtttggtcaccaagtccttaaattatattagagcctttctctgacctcttgggctcaaggagagtttaattaatagttgtaattgttttgtaggttaaaatttactcctatactttaaagtgtcaaggttttgcctgaagctaattaaaacagtcaaatcataaccttataagtaggttttatatatatagatatagagatatatggaaacatccagctatctttaggaaattgttgcatatacagttttctaatatttgtttcagggagatttgctcagttatctgaaatggagaaattagagtaaatctctttatcttgtggttattttttggcttatttgttgatttcaaaatagtgaaaaggcaaaggaaaaagtagcattcattatcagttatctcttaaatggaagaaacatgcatttgttgcagcaaattttccgttaagcataatttcatcctgtttcaataagtaataaagtgcttttctagatttagtaaacacacatacacactagtaaaatgaccaaaatttgtgttaacacagtatattttgttcccaacgtacaggcaaaggaaaaagtcctacttgcctctaaaatttactatttaaagtacatttttaaaaaccattaactgtgcttataattagtcaggctcttgtgaaaaagcattgcatttctacccagcgtctaaaactgatttgaaggaaatattatgaatgggcctacttgcacctgcagacctgaaaagggaatgcttatctgaaatcagaacaaggcatccttttcccagtctctgtcaatatacaaaggtttctgatgtatactgaattgcatggcagttaaaaacatgcaaaaaatgtaaattatagccagtataactcagaaaattagagatcagcataaactgctgtacttttgtgatatagctacaagtctcaaattatatgtctttacagtgcaaattagatgcttaaagcagaatagaaatttaggtatcagttacaatggaaatcttgtttccttgctcagtagtttacaccaggagaatgttgagggcaataaagccatacaaaagagaccagaagctgcataagaccagcataactttgggtttaatttttaaagcagaatttataggtctcgaacatatagtggacttttaataacaaatatatagtgagcagtgggggatgttattaatcaaatccaaagatttctgatgtagcaaaaattatagcagtttgttttttaactgtctctggtgaagattacccacagctagagaaataatagcactgtaaaatggtcaataaataaccagaaaaacataaagtatatctagtggttaatatttgaagagttaatgtagcaacattgtttccacatttacttattttaaaagattaagaactttcattacctaaatttttatatagcaatataagtgtaacaaatttcagatatcacagtttcttttaaaaaagcggtaactattattgcaatcaaatttcaccttctgtgtattgcaatgaaatttcaccttctgtttattcagctatcaattatttattattttcaacaacaatcaactagattaacattattttgtgaccatatcattacttcccctcaaagcgttgcatagcataagtgttcccagaattctttatgcttacctaaagtgatcggatatttaaaagaaccaaggtatcattaacaaaaaattcagccttctaaattatttgcataataagctcccaaattaattctatcttgaagcaatggagacactttctgatcaattaaaaatcatacatgtttgccctctaaactgacagcaaagtagctgatatgctttggaaaattcctgtgccccaaaataacttcttctcttgttaccaaattatctgaaatctcactacttaatggattctttttggttaaccatggtattaaccctatgattttttaaagtttttaacatggtataatggaaattttcaaatgcatacagaattagagagaatggtataagggaccactatatactcatcacccagcttcattaaccatcaactcaaagccaacttctttcatctgtgctcctgctggtacccaattcacccccttctcccaactaaatattttgaaagaaatttttcatatcattttattttaaaatatttcagtaaataaaaatactactggaggaggaacacactgtaactaatcttaaagcatgaatttttttaaaaactgaaacttagggcaacaagaatgttcacaatttttaagggaagcaattgcaaaagagaaggacacgaggaatgggaaagacacagtttcaaccatttacttttcaatagttctattatagttccattaaaaatatttttattttgaaagtatggatatgtaatagctttttgatacgcatgtatatgaacagagaaaaacaacatgagtaaatctgcttcccgtgacaaatgttaattgttttattccaatggaatcacagcaggtataccttgtaaagtttcagtttcaaggatctgcctgcccttgcatgattagtttttctcctatctactgtatcatttaaagcaatatccatatatgtggcaaaacctttttatctcctattttttctctccttttgctataagtccttgaaagagttgtccgtaactcctctctccgattcttctcctcaccttctctttgaatccattgtgagcaggctttctttatcacctctgcagtccactctcttaagatcagggtaacctccacattgccagatctgatggctaattcttaatctccatcctgcttgatgtatcatctgttggtgacttgacactgttgaccttgccctccttggaaacagttttgttggcttcttggacccacactctcttggtttaagctccttctccatctctgatgttgattcttcctcatttcttaacctctaaatgtagtagtggctcaggacccactcctaaggacttctctgatccagtcttggttttctttttttttttttttttttttttgagacggagtcttgctctgtcgcccaggctggagtgcagtggtgcgatctcggcccactgcaagcttcgcctcctgggttcacaccattctcctgcctcagcctactgagtagctgagactacaggcacccgccaccacgcccggctaattttttgtatttttagtagagagggcgtttcactgtgttagccaggatcgtcttgatctcctgacctcgtgatctgctcgcctcggcctcccaaagtgctgggcttacaggcgtgagccaccacacccggcccagtcttgtgtcttaaataccatttccacattgacacctccagaatatttatctctaaacctgacctccagaaggtgcagcaaattgtgtaaaccatgtctccactacacgcctaaaggcaaagaccctaacgcattcaaaaccaaactccattttcttgtccagtcttcataatcacactgtgagagaggtccctgtttttgaaacaaataaacaggagcagaggagataagtaacttgcccaatgtcacctatctagtaagtaggagagatgggatttgaacatcgtagagaaagcttgaattatgcttcataatatgaacttcctaatcagtcttcatcatttcaaacctttgtccacatgttcctttctactcagaactttcccctagctccccattgtcttcaggctcctcatacaacttcctcccagctttgctatggacacacccacctgtgacctccttgagggaagaagctgcctgtatttttgtgtgtccaatgcttggtacacagtaggtcttcacaaagtatctggagtaaatgaccccatagataacttgaggataatagtgagcaatctaaaattgggcagctaagcaaattctccctaatcatttctaagcctcactagaatttgaacttagagaaataaaattttcttttaaaagtgggttacaccataaaggacacttgtttctgttttcccagcccataccagaaagcagtctcttgaccttctggacaaatcattagcaaagattaaaagctgagacttagtactctttaatcttatttttcaaagtctgtcttgttttcaaactttctgtgacaatgatttctattgttgataataaaatataaaaagtaatcctaattctttacccttggtatcaactttaaaattgattttacaattttacaaaattgtaattagattacaaaaactggaatttgtagtcattttcaactaaatacttcaaaaattacaaaaactggaatttatagtcattttcaactaaatacttaaaaaattaataaaaaatccaagctattctaactcctttaatgactattcattcagactttcttaaagcacatacagctttatgacaggcactatactgagttctggagttaaaaaataacaacgattaagttttgtgtattatttactgtaggccaggcaccctcctggacacattatttgaaaatataatatatcctttaatgcttacaaccctgttagttatatactgttattcccattgtataggtaagcaaactaattcaagaggcattgtataacttcttccagatctcttaactaataaataatggtcccagaattccgatctgtgtggtttgagtcagcattctgaatcataattatagacatatagattgcttttcaaaggtgagaggagtccctaccttgaaccttggaaggttcagctctagctgtcctcaggccattgacctcaaccatgggcagggagtccatggggcttgctcaagtaaagtctgtcaccccctctagatcatctccagaattcttagcctaaacagcctcaggctacttttatggcctgccttctgggggtaaactgagtcacccctgtgccaaatcctaggtgaagatggccaaggacactgatgcaggagaggtaaacagagcttggacatgcaagctgaagtgtccatgcaggtaaacaacaggctacctgtgctgcagaataaatttagaggtgggagagaagaggggaagataatggctggagaggcaacgcttcacacactgcccagttcctaactagaaatctggaggtgaatattccaaattcagacctagccttccaggtcattatgcatatatatttatcaaggaaggaagatagaacttattttacctatgggtttctttgcctggtttgtagctgttaaatatgtagtctgttatgctcactgctatttgtgttcttgctgttggccctgaaacagttaggggcagacttgtctactagtttaaatattactgggggccggttgcagtggctaacaactgtaatcccatcactttgggaggctgaggtgggaggaacacttgatgtcaggagttcgagaccagcctggccaacatggagtaaagaccagcccgtctttactaaaaatacaaaaattagcggggcatggcagtgcgcacctgtagtcccagctacttgacaggctgaggcacaagaattgctagatctcaggaggttgcagtgagccaagatcatgccacagcactccaggcctgggcaacagagcaagattgcatctcaaaaatagataaataaataataaacaaataaatattattgagccggggagacaaagaaagcaccagagaccattgcataaggtagtctggtagtcttgactacctcatgtcaaagtgtttttatattttaataactaaatcccttttggtaatctttgagatgtgtacagattatacaaaattttactctcttgcaaatcatgttacaatgagagtcaaatgtatgcatagtcttaatttagttttacttatttccctctatatcttagaaggctggccacagtggctcacacctgtaatcccagcacttttggaggcagaggtgggtggatcacgaggtcaggagttcgagaccagcctggtgaacagggtgaaaccctgtctctactaaaaatacaaaaattagctggatgtggttgcacacacctacagtcccagctactcaggaggctggggcaagagaatcatttgaacccatgagatggaggttgcagtgagccgagatcgtgccattgctctccagcctggcgacagagcaagactccatctcgaaaaaaaaaaaaaaaacaacttaggaaagaacattttactgacatgaatgacctaatttggtcaaattattcagttggcatatatttgatatttaatatctataagtgaatgactatatagaaaaagcagtgccatactatattcatggagtaaaaggactatttttcgacttaaagtgaatcttaatgtgaccttatttcctctttcgcagtaagtaaattatttgatttacacaccaaaaaagtgtattgaaagtcagaatgatttccattgggattttataatttaattaaaacagacccaccttttaacaaaagtgctaagatcaattcttgctaggaaactactaatattaaacagatatatttaaattatcttcctgcagttattgaaaaaagtccttaactaatattagtttaggaaacaaaaataagattattaacttaaaattgcattgttaaagtgttcttatcagatatatacttttaagatgatttttaaagatgcttctattttgagtgctattatccaaagtactaaaagttcattttaggccaggcgcggtggctcacatctgtaatctcagcactttgggaggccaaggtgggtggatcacctgaagtcaggagttcaagaccagcctggccaatatggtgaaaccctgtctctactaaaaatacaaaaattagccgggcatggtggcagacacctgtaatcccagctacttgggaggctgaggcaggagaatcgcctgaacccgggaggcggaggttgcagtgagccgagattgtgccactgcactccagtctgggagagaaaaagcgagactttgtctaaaataaaataaaatataaaagtttgttttataaacagcatatagggtcttataaagtggcctttcatgctgacctcatcaatgagccaaccatcactgctataatggttttagacgtgcgctatctctgcctggtgttttattgttgttttgctttgttgtaatcaaataatactgttacatttgttaaggacagaatctgttgctattccagataaatattggtatcgtttgtttattctagaggattgccaaaaaattcacagtctcgtgatagtacagggtaagaaagcagagtagctgtcaagggctagttcaagtcaaagcctatggaagagaccgagtttggaagtggagagaagggctggtgatgaagacaggaggatgaaaaactagaaatattccagctctgaagaactgtaccaaatatgtcatattaggtatgtgagatgtgtggtggatttgggccaggaatgttttggtgttttccatggttttggactcaacttccttttaggataaagcgggttgaaatttcaagatctgccgatagtaaatgaagccacagttaaaagtactgctgtttcatgtgtacatgtggtatcagggatctttccttggaattgaaccacaaacagcttcccaggtaaaggcatttttttttcctgattttagtaaggaccatatatttaggattatttcttagtaactgttacaggtactaggtagggaagggggctgggtgaaaagcttcatccttatggaatgagggattaccactatgctgtaaaggatcattagaatattatgaggtcaaacaaagaaaataattaaaaggaaaattcaaaattctacaaggactggattgacaggatttatattaaggagtaccaaatagggaatgtcttttctaattgcctgctggagaggtgcaaagaggccaggctggataggcttagtcatgcaaggtattcattgactgcaatagaacaaaggatgcaaagaagttttggggtggcaaggacttgctgtagaactggctgttctagttggaaacaaagacactattgtagcagaactgcattgttggcagcaaaatgactggctggtctctttcttagtacaaatcatacctcccaaggtattgctccattgtgtttttgtgcatttggtttggatttttatggggaattgaagacaagtggatcataaagtgcaaaataaaatgctctagaaatgacagatggggcacaatttccaagaaaattcatctagacagtggcaacactgagaaaaaaaagaaacattcaagaagggagttacagtttcagacatcctcagttttggttaaaaaggtcccttttgatgagtgtgtcagtcactaccagctagaacaagggccctaaagtgagggccaacgtatataatcagagagcctgacgtcaggttgatactgaaaatatgagaactaaatggcattactaccagtctttagtttagaagatatagcatgtttgatgccttgtaaagaaggtatccaaggccacatgatactttgtaacatctgatgggactgtggtcacatgggagaagggaagggggctcttgagcacgtgcctgtggcccactgaagacagcatagccagctggagattgggcccacccacccttttagggctgtccggggctgacagttggctacttgggggtcagcatagcactgatgccagaactcacttgcctgaggttggattatctggttatagacttgtctgggcagagattgacttttgggcattatgaaaagtcagacatcagggctttttggacaaattctgcctcttaggtatatgtttgagttaaaaaaaaaaaaaaagatgtgttacttctgactgctttctactggtggggtagaaaagttgggtcagccagaacgatcattggatgttacactcctccttctcacagggcaaacttctcagatactgcccaggtggtatgtgatattttctcctatactgcgtaattatcaattcctttgggattaatcttaatgaaaaaaagcccacatgcagaaccagagtattcttggccctttgaacaaactagatgcttctagcatgatatgaaagaacatcaagctccagaggacgtcagaattggcctccaagttgtataatataaagctgccctagtgacagaggacccactaactggtcagtccacttgaggatctttgttagggctctgtattgacaatctaggaactaaataccctgaaagtcccaagaaatatagaattacctcaacgttttggagcttacctctccagcctaagtggcacttttacacatgaatttcctaaggaggaatttggattcccaaaaacattatccttaaaagtgcaaactcacctttctaggcctctgaggatgctgtacagtaagtggcccaggatggtctaaatgagttggttacacaagaccaggttgttggatgttgcctagatatacagtaaactcttccatccaaaagatctcaagaggtgccacataaacactgggagactggctggaaattacagaatctgagagggttttgccagtaacttctatacccatggcacatttggcaaaagatttttcattcatttttttttttttggaattattggtgtgcaaaagtgaaaggtggtgggaatctgggcactttaggttgttcaagaccaaaggaatcaatggtcacagatattcacactgcatttgagagcacagaaacctagaaacacaaagtttggagtttggttgtcatttgttcggaagtacggcagagccttccaggccagaagaaacagattaacttagctgtctctgcataatcaatggatatgcagtgtgggtctgacaaggtgaagagacatcctattgcctcagtcatggtgagggtgtaattcctgtttttcccattcaaatataaattggttgtatattttgaaaggcagcttgcagatcttcagtagacacggcagagttgaacctgaaaggggttaaatgttagaagacaaaagagatctgaggtcccaggaaaagctaagtaggaaacagaggggctcagatttcaaagtttagaaatgggatgttggatattggcagacaatttcatgtctctgaacagctttgctgccgtttggccagtttttattgatccggctgcctgggctgactctcagtagtaacctaacaatactgtgtggtttttaacagataatgtatatttgggaaccagacagaataaagatgcaatcatgtaataaaatggcccaggaaattccttaaggaagttttctctggccctcccactcccccttgaggtgacatcgtcctgttatctgctgcctgctgtaccctgcctgttccatttcatagcactcttgttaagttctgtcttatgtcaggttttgctgttattctacaacaggaatacaagcaggtgccctatccctaaaaccctgcacaatgccatggcttaattgcaagtattaaataattacaaaaaaaaattcaggatggagaagccatcaaaattattacaatctcaaaattccttaagaagcggagttttctgctctccactcccagatgataatgtcctgtctcttttgactaaatattcacccattctcttcctctaatcaagtagcttttgataatactaacagagctacctatgagcaggtaaaaaatagttataggagaatcctggtcacctagagtgcctatgaaaagtgatgttttaattaattaaattctatggccatttatattctgactcttgcttttgaacatctttttaatatgtgtgtgtacactttccttgcttggtgagtacatcatttaaactttctttggtatttgaaaaaagccttgcagttatcctttgatcacatttgcaaattttcaccattactatttaatcaataaatgaattcattgcttgagcacctgctcagtgcatttcacattggactagttgctatggggacagagaggaagtaaggtatcaaggagatggggtggctgagcctgaggaactgtgtgggcatacaatacgagatagtgctgtggggcagagatgggtggtttgggccattagtgctgtagagctttaggcttctgattcagacaggaaatatgtcaaatgtgttctgatgcaagacagaacattgccatcttttctaaagattgatacttagttttaatttttctcattttttaggagggaattaaaatttagagccctgattaactgaaggttccagctatttagattttcaatacatatggtccaccttttctaggcatagtgtattttgcgagatggtcttaaaatgcatcagcataaagcaaaatccaggctgtgtctccaatagtacatataattagttgcattgttcttagctattagaagaaacttttaaatgtgtgcgtaaagactggaagaacagaagtgtcagtattaatttactaaatgagtagagtgaggacatcacaatggtgaaattcagggacaacctgtaggaaacaatagtgctttgtgtgtgtgcagggagcagtgcagaatggccagaggagcaagtgcagtagcaggacaaagcttccccagggagacgcaccctgagctgagttcgagagttgaccaagagaagggacagcattgggagaaagttacctgaatgtcacagaagtaaacagaaagagagagagcacatacgatgttttgggcaatgcaggggagacacccattcatcctctccttcagtgaatacatactgaactcttacactgtgcctggtattgctgtaagcctcggggatatggcagggaaccaaacaaaaagatctgctctcatggagctttcgttctaatggagagagacaagacatttgacaaattaaagaaatagaatgtatagcacaccagacagcactaagtatctagcaccttctgtagagagaaagaaacccagatgggtagtcaagaatactggagaaggaggtatgatcttaagtaggataattaggaaggtctcactgagaaggtgctgagccaattcccagggcctcagggagggaaatatgaacaatatatcatctgcctcaataatatataactttctaggaggatattgacattgtaatccaataaattctataattttaaaatctaagatgtgctaattatttaataaatatttttcaacaagtgtgtggaaagtaccattcaaagtatgaaaacattaggaaactaaaggacaaaagttcttgtcctcataagtcttatattttggaggaggacagacaaaataaaaaaaaaacatggttatacataattatctagtgtgttcaaaggtggtaagtgctatggggaaaagtggagcagggttgggggaagacagagttgccatttcaagtagattagatggggtaagcctcatgaaaaaagaccagtgtttgagccaagccctcaagacagtaagagagttagccttgtggataactggagaaagggtagagagatgagaggctatgaagcaatgtgagaaatttttaatgcatagcaggatcgaaggactggtagtggcagattgttggtatctggagcccaggcagagtgaatcagcttgtaagacaagaggtggtggtcagacagggtgatatgtgaaactggaattgtagagaagttgcagttactggtaattacaaggtctaaatttcttaacatggaagcaaagtagctaaatcaaggtggaggacaaaataattagaggagaagagaataaggagctgatgcatcttgtattgcaaagatgatgtgtgtatatacaaaaattgtcaggaattgacataggagtattgttggagaaaattatatcaagcaaggaggcaacattttctaaaaatgagaaagcatctccctgtggttggtaaatgtcagtgaatgcctgcaacaattcaggatggtgggtgacataatgtaagttacaagtgtcaaagctgggggtgggatgattaggggatgagagagggagaagtgcctgtgagtagcagtgaggactcaggaagacacttatacatctccaagctcaaggctgttaggattctgggagaaacatcagcgattactcatgaggtcaggggaagacaagttctcaggggagagccaggtttctgttcaagcaagacaagagaacattcagataagggactgggatatgggcagtccttctggaaatggactatgaatttcagagggcacaggggatgggtttctggagttgtaaaggaataggagataaggagaaaagagggctgtgcagagccttctagggattagaatgtgttgggggaataagggtgcatctgggagtcttgggcttcttgtagaaactggtgcaataaacagggataagtgagattagtctttgggatctcaaggtagatagtggtgatgatactgtcagtggctgaggggcaaggggaggttctgagacttgctcttaattcttagggaaggaagagacaaggtctgaggaagcctgacttagttctgaagtgaggcgttgactctaccccgtttcctgccaaaagcaacgtggactttctctgggtgtcttaagacactcttgactccagatgattaaagtgattgcctgagaagtatataacacctgacgattatacctgaagggggctccacaggcagagaggaggcatgtacattgaccatgacataggactttaggagaaaagcaaaggagagcaccttggagttaatggcaggtagatttgttagaactttatgctatggtctaaatgtttttgcttctccaaaattcatgtgttgaaatctaatcatcaatgtaatggcattaaaggtggggcctttggaaaatgactaggtcatgaagataggaccctggtgaattgtattagtgcacttatgaaaaaggcctgtgggaactcgtctgtcccttctgccatatgaagacacagcaagaaggtgccacctatgaggaaggctccctcgccataccaccacatctgttgctgcctttgtcttggacttgccggattccaaaactgcgagaaataaattctgttatttgtaaattacccaatctaaggtattttgttatggcagcctgaatggactgagatactttactactcaggtggtggaaataattccaggcgttttgttttgttttgacttgattgtttagtagggtagtaatgtgatcactgtatcagcaaaagaaactggcaacaatgtatgtggtgatttttagtggtaaatggtgtttgtaagagattctgagaacgttgttacattaaagcaaatgatcgataaggaaggcctcaactaggatggatccatgggaatggaaatagggagtgagaaatactaaagacagtaaattaaaagcaaaaagtcttggtgactgacaggttgttgaggctgtggtagagagaggagtcaaggttgaccacaaagatttaaatcagaatagatgggaaaataatgtaattaatggaatacatcattcaagtcaggaagaggaacataatgtttgagactcgaagattttgaagttgtggcaggaatctgagtgggttgccaagcagattgttgaaagttcaagacagaagcttgggtgagagtttggaactgaaggtaccaatttggtggtcatgttcaaggaagtgaggcttggaatcttgttagttcatagtcatcaagctgtagagttgagagagcaatgtgaaaatagccaaagacataacaaggggagttgcttgagaatgagagaagtgatagagtgcccactcagtgttgaaagacaggacatttaaacattgctaagtgctagttgctaaatgtaattaagaaatattatttgcctttgagtgagcaattaactagaaagctagaggaaattatcttgataatgaggagaggcatttttctaataagagaacaaagacaattttgacttgaaaagaaggaatattatttagatcttctctataatataatggtaaagttagggtcatatcttaagtgagaggacttggtatgagttcttatggatttgatgagaaagaattaaaacagtgaaagtgaaaacatatgatggaaagtcaacaagaaattaatgaaagcagggtctaggaactagatgaggtgagaaagaaatttggagggaacccaattcttaataggtttctggcagtgccccataaggcagcctcagataatcagatgttgcttaggatgcatcaccccatttgtgcctgacctcctgtttactttcaactccatgttttagagttcttgaatcagtagcctgccttctgtctcagcctctggctcctcttgaatttgttatttattctgcttctctttggtttttcatatctaagaactgttttattgttccgttatccagtgactcctctatagctcatgagaatttcctgctgcagctcctggccccagagattcctaatggctctgtccatggtggaggtagtgaggtgttgggggtgacttgggtaaggcagaataaccttgagcaaggtgatgaatacattgcaaatttagccgtttctggtgctgataacaaagatgggggagcatataaataagagctgtgacctttgaaagaatagagattgataagtgttgcaagatggaagttggggagaatctcataagtagccagtgggaacaaggagaatatgtttgcaaagcactgttggaacatttccccaaggaatgatgaactctgcataaaactaacttttgatgaaggagaaacagtagctggaccatttggggaaatatggagaagatggaataagaattttatagggcaatatggactatagttcataacacagtaccaatataaaattttctgaatttaccacttctactgtgatatattttttcaaatttctaccgatgatattaaactgaacgaatgttaattgaaaattataagatattaaagtattacggaagattatctatcctataagatacagttaacacattttataataattcagagttcctttttgtctgagtctccaaataaagtgaattttagaaaagacaaatatttagtgtcatatttggcattgaggatagaagaggatttactttagagaacaggatataaagtataatattgatgtatagttcaagctatattagtattactattgatcataatattaggttggtgctgaagtaattgcggtttttgacattactttcaatggccaaaaccgcaattactttagcaccaacctaatagtactaattactaagatacttaaacttacattggtatcattacctactccattcaatttcttaggctgccgagagttggcaagaaattgcaagcagaatataataaataagttttgaatttgaaaagattttttattatctcacaaacaagttcaatccatacaaaaaagtattaaaataaattaatctgaatataaaaggatatgtaaatcaaatgccgtatatgccgtatagggataaacaactttaaccactatctaatctgtattaaacaacaacaacaacaacaaaataaaaacataagatgtcactggattttcttctaaaaatcatagtttaatgttttgctatacactggcgggaaagaaatatattccttcattgtgcactggttgtctttttctaacaaatattccatctcagttaatttacagtgctaactggaaataaactttatcgatataatgtacatcaataaactctatttatttaaaatgtcagtggatgagttttgccagatgtatagacctctgaagctacgtaccactacagtcaacgtacagaacccttccacccaccaaagatttgctcatgcctctttgctgacagtgccaaaacacaaaacagggaataatcagtctgcattattggtaactgttttattgaatgtatagggattttggtgccccttttttaaaaaacaaaaacaaaaacaattccctgtattgaagttgttgttgttgttgttgttttgagacggagtttcactcttgtcgcccaggctggagtgcaatggcatgatctcggctcactgcaacctccacctctcaggttgaagcgattctcctgcctcagcctcctgagtagctgagattacaggtgcccgccaccatgtccggctaatttttgtatttttagtagagacggggttttgccatgttggtcaggctggtcttgaactcctgacctcaggtgatctgcccgcctctgcctcccaaagtgctgggattacaggcatgagccactgtgcccagcctttggtggccttttaaaataaatctttcctattataaactgtatcttaaaacagtcccataaactcacagaactgtacatgctataaagcaaatgttctccaccaatcatgtcattgtaagttgcactctacttttcaaactgttttcacagctcagtggaggaacacagcacacaatgaggggaacatttttcctacatcatcaacgaggaagcaaagcctcagcagttagtttatgaagccgaggccagcgaataggcagggttaggacaagaacaagttgccttctcccctgttccagatttggctttcaagacagagctagaaattcacaaatggaaacagcaactccgaacaccacttcctatgctactgcctaattagcatgcagctcagagctgtcccctggcaaaagcctggagaaacatggttgtaaaaggacagctctcccctctgctgaacaagtgccagccagtctgctttatgcactcagtgaggttttcaggctggggctttcacgcgaaaactcagtttccctgtgcatagaaaggaaatgaattctgaaaagggtaccaaagtatttaggagagtctctgactccaaggatggaaaataatcttactagggagaatctaacattcttatctttagagtgggaaaataggattaccttagcactgatgataagaaaagtaatgacatactacttgtattaaagaattttctggaggtactagggattattgctgagtcatcatttaagaactaataatagtactaattagccaggagttttcagtcatactttggaataattttcttttttatgttattctctattccacctaagacagtgtttacaagaaaaggttctgtcatcagaactgggttcaaacttggtctctgtatttaccacctctgtgactttaggtgagacttagcctccctaagctgtagttttccatctgtaaaatgggcatagcagaactttcctcatgggagctttatgaagcttcaggtagatcatttatataaagtgcttggcatagggccaacacagtgtgatcatgtaatagatacttgattttttaaattttctctaattttattgtcctgtatgtatagatttaattttcaagtgcagagtcaaaagatattaaatatatttttgaattttgaaatgtgattaaaggaaaaccaaatcctaagtgacctaaaattcatattgggttttaatttaccggtgtttgttttttacttagcactaaatctcttacaatatagagtgttgctttgctactgtaatcaagttcacacctgcaacgtgactttaagtttaaaagatacaatgtagaaaatgcattcttactatcctagggcattttttttaacctccttaaccatggcatttgaagtttggacatgaataacagtgctttttttttaagttggagaaaggaaacctatacctgccaagagttggaaatgaaaataggaagagcccctggaactctagtgtgttagattgaaaacattatttagaggaacagactgggaaaccagtgaatattttggcttttatagaaagggagtgtgcctcataaacaggacagttggaatgtatggaaaatttccagtgaaaacaagaaacaaagcacatgactaatactgcttttccaagttagacaaatgcagctttaaccagaatttgccactgaggggccttgggggccctccttgaatctggatactttgatccctttttcaagttctaagtctaatgtaggaaaagctgtacagatagatgatatggttttgacccccatctttcttcctgtttctgccgttcttgaaaattcccagcaggtgagtgtcagaagacaaattgaagtattcagctaaataagcaactgcaaaactgaatttattcctcttcaagaactactcttcttgtatgttgagtgaccatttggctgccaagagaaactgctttgcctaggaaataatatggactgaaaaatcagtttcaaacacaaatgaaaaatattccttatgtttggtcatcttctttccacatcaaatatacatgtaaagatgtatataagatataatctgaagataatcaaacagctattaactggatttctgcatttcgcctatccttcaaaaccagcctcaagtctacctttatgttgagagagtgtatctttaactcatggtgttctctttctcctttcacatttcctgtaaactcatcatgaattgccttgtttattgttttgatttctcattcaacaacaccagaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaatcagagctttttcaatgcaaagttgattatgatgggcataaatgaatcataataaaaagttctagtatgatcccatctgactgggcttcttgtgatggcccatttcaacaccatgggtgtcattagtggcttcacaatggttcttcttgtaaattccctcatgacctagagttttgatttatgccatcctagcccactttaagctctgactcatgctgggattgccctaaacagggcagggcagactaatggaatgcattgcattgtcctaacatttcttaacctgcccaaggttgaacatgcttgtttgtttttcttttgctctccaaaaatctttatgctagcgtaaaggcctgttgtaatcacataaattactcactatgtaacaggagaagttgaaatttgtccctgaaacataaagattatatataataaaagccttaaaaacctacctattgagaaccaaagatatttagtgctgtttcctaactggcattacaagaaaattctgctcagtcaggggatactcacctttcaagggacaaggaacatgtaatgaatttaaatttggtttagatctgtgtaataaggaaaagtaagtgaatttggtgatcttgtacctgaggatggcggcattaaaaaaagactattttaacttaatatcatttcattaacttctttaaaaataagctagttcagctgaactacacaatatcagaagaccaagtgtaagaaaacggtaatcggccgggcgcggtggctcacgcctgtaatcccagcactttgggaggccgaggcgggcggatcacgaggtcaggagatcgagaccatcctggctaacacggtgaaaccccgtctctactaaaaatacaaaaattagccaggcgtggtggcgcgcgcctgtagtcccagctacacgggaggctgaggcaggagaatggcgtgaacccgggaggtggagcttgcagtgagccgagatcgcgccactgcactccagcctgggcgacagagcgagactccgtctcaaaaaaaaaaaaaaaaaaaaaaaaaaaggaaaacggtaatctgtgtttgtggaaacatagagatgaattcatctagttatgtatcattatgtaaacatagttacattgccttttgtgataaataggttttggaaatgaagattacttaagaatatatgtagtcaagacttataaaaactcaggaattaaattgtcaaattaacctctacttggaatattatttattaattacacatttactgagtgtattctagtatattgagtgtatgtacaaggctcatatactgggtatataaagaaaatgtatttaagcacctttcctcccaggaactggtagtctagtattcttacttttccaaggaaaaacaaacaaacaaacatgaagaaatatatctctttagtatggatgatctacttcacataaagtaattttatgctggacatttcttttaaaactttacatttattctgttagagtctcttatttatctttcaaaactcagatgaaaattcatcagttaggaattgtgtttatctgcaagtaagagggtctttgaaaacaggacgaagtaagattcgagtaagctttcctttcacatcagacccagttctgagagtaaacgagcagatacagggactccttggtattctgagaggcctgggctccttttctccggttgtgtttagcctcggcttctatgagacaagttccctcaagtctgaatatggctgctgcaggtctggacattacagccatgttccaggcagaaagaggcaggatgggcataaggggaataaaaaggaaaacaagaaaacttttttgaaaactttcacagaagccccattcagaaacttctgcttccatttaaatcatcatcgttagttatgcaatcatcatcattacaagagaaggtgggaattgtggcatttcagttcctctcaatgccaccttcaacaaatttaggattccgttagttaagaacaggcaggcaaacagcaatctgtgtgacaatacactctaatcatttatcaccctctgggggagattattgtatagacattgctagtgccccacccatgctctttttatagggctggtgcacccatccccagctgctctgcattctggccgtttatggctcacagttgtcactttctcaaaggaattgccctccaccaaaaggagccacattgcttagagatgcctggaacatcaacccgctccaaccccactcctccccgtaccaggctgcctgcagccagtgactgtctgatatggggtagaaaacaggccccaggctcccaggtgggacaactttgtgttgtcgtttgggctcaaagctatgggaggggtcaggttgaggccacactcccattgcaccaacgtatatgcttgctgccatgcctcactgcctgtcccagtaaatcacttgctaacaatctctactctagggtctttctcaggggaattaaaacaattgttttttcttgtaatgtcctcattcccccagcttcctcctgagctactatgtaagaattgaacattattgtactacctccttctcttccaaatacacgttcagactatcaaacctaatcactggaccagcaaacagagaaggcaagatagagaggaatccaaactggttttcactaaacataaatactattgtaggtttttctaagtgaaagtagaggcaaaattatttagagaaaatagtttgccccataaagatacttattttcatttccatggtctgaatgcttgtttgctacaagtttgaaacaaattaaacactgtggtgtaggcaaaggagaggaatgtgccagcctaggctgggccacactgcaagagagtagtatttcctgaaagcgtaattcaggagccaactacaaatattttgaatttcatgaatattgttcaattaattctatatgagcacagtttaaataagcattggtggtacttagtaactaaagtttttccacagatgtgttatcattatttgaatgacatctgcttctttgtctatttcaacaaatagatccttgctccccctgttttgagggatcatctcagacactaacttcccggtaatgtatcttctctactacttcagaacctccctactcagatccacctttttcagagagctttctatgtttcctccttttctctcacgcccatttacttaatccctcgtaacatttaactgacttttgttttgtttcctgtaccttattttcaaagaagtaggcctaagcacctactccttccctttatttttgtaggggcctttaggaaacctcaaatcaaaacttggaataactaggtcatggcaagtgattagaatgccaatgtatttatttgttttaatttttatattaaataatagcatatatttctctgcaaaagagagattcagtaatcaagtaatgtattttaaggtatatttacatgactatgatatgtatatctagaaggaggaaaacccagttatactctaaactttactcttaagcatgctcaattcgtctgattttgactgttatcaaagcagaacatgtattaattacaacagtgtttacttgttttattttttaaggaagtagctttatacggttattcaaatttaatttaatttgtatagtaaatgcaattgggaaagggatattgcctggaaaaaaatgcatttctcacaaatcattttgtttaggagtaacagaagaatccagaatgattgattctaaatatcaagtactacagtctttgtcagttgtaattgttctttttgccagataaccatgaacatcctttaaatgttgttgaaattttattgactttactacagaaaaaaactagaaatgtctctaaaaacttgtacttgatccaatcacttgatttatggaaagatcccattctaaacactgaaacttctactgtcctttttagttagttttggggaatttgctggtccattttttcccctgtcacttctatcagctaaatattttcaaaataatatgaatgaatggcatcatcaaaaacaaagaatacctaagtgggtgtcatgaatatgttttttcctgacttttgtgtactctatcctgttgatgatggatatttattatactttatgacagatagctataggggtcatttcacatatgtcataaccatttaattctgggaaataatttaaaaattgttcagcttaaatcaatgttcatgttgcaaaatctgaataaaatgcaggtgttctaagagatcttcagtaagccagtttgtagtgatgccaaaattgtatttgtaatagattggatggatgtgtatatattcaactttatgggcttttaagaatcttttttttactaaataaatgcagtactttttacttaatagccatttttatatattagctgtatttttaaaactttatcacccaagggactttcattttaaagacagcatgttacatttacgacaagtttgaggacacataacatctttctttgtttttttgaacatagagattaatatacacatgaacatacacgtatatatgtgtctatatatatgtgtgtgtatgtgtatatagataatatacccaacatagataatattaattataatgacattacaacagtttctttatcgaatgcctactatgccgtgagcactctgttgggatgctttaccttacttcatcctcacatcagcaatttgatatggttatagttagccctttgttactgcggaggagatggagacttggagagtttaggtaactagcttagtaagtagctgtgctatggaacattggaagtttcctcccagtaactatttagcaatactacctcatcacacctgttgtcaacagttgtaagacaatgagaaaatataagacacacagcacatgctaacaaatccagaaatagaattacttagaatatacacacttattgacaatatgcaattaaatctttttctgatttctgtcaaggcaggttttttttgttatcgttgttgttttgtgttttgttttgtttgtttgttttgagatggagtctcgctctgttgctcaggctggagtgcaatggcatgatcttggctcactgcaacctccgcctcccgagttcaagcaattctcctgcctcagcctcccgagtagctgggactacaggtgtgtgccaccacacccagctaattttttgtatctttagtagagacggggtttcactgtgatacccacatggctcgatctcctgatctcatgatccgcccacctcagcctctcaaagtgctgagactacaggtgtgagccaccattcctggcctacctggttactttctctagatgggagatagcaatgtgacataaaactgccccaggggctccagaactgctggtacagttatacttctaaagcactaggccccaaaccaatttttctcagatttccagatgataaaaatattagcatcatttttttctttttttttttgtgagtcacaatggatgtcaactttctaaccctttttatttctattttcttcctgctctttcctgaaaattttcacacagctatagcaaggcaaagaaagtagctgggactacaggcatgtgccaccacacctgggtagtttttgtatttttagtagagacagggtttcaccatattggtcaggctggtctcgaactcctgaactcaggtgatccacccacctcggcctcccaaagtgctgggattacaggcatgagccactgcgcccagccagcagtattttttttaaacttttattttagatacagagtgtacatgtgcaggtttgttacctggtatattgcatgatgctgaggtttagggtactaatgatccgatctcccagatactaagcatagtacctgacagtttttcaacccttgctcccctccctactttcaccctctagtagttgtcagtgtctactattcccatgtttatgtccacatgtacccaatgtttagctctcacttataagtggtaacatgtgttgttcggttttctgtttctgagttaatttggttaggataatgacctccagctacatccactgtgctgcaaaggacatgattttgctctttcttatggctgtgttgtgttccatgttgtacatgtaccacattttctttatccagcccaccattgaagggcacctaggttgattccatgtctttgctatcgtggatagcactaaggcagtacattttttttttaataacatgggctttatgaggcactgagaactaaaacaaatgagcacaagaggaggatctgaggatctgtgctttagcacattataatacttcttccattggcttaagaatttccattgggatcaataaaaaataatccttattaaaatgcagtgttcgaatataaagaataaggtgcatattgcaacatcactaggcaaatagctgaacaagcagcaactgcaatcataaagtgggaaaacccactcaggcacaacctctaatgaggtgtcagtgcagtgctgagggctgctagggaaccattgctggaaagtagttttcttgtaatgttggatgggagggcaaatgaactaggtagacccagaagctgaagacagactgtccgtgtctgtaaacagcagtcatgctttgttgtatatgcagtgtagagatttttactttcacagaagggtgtgtttgtatgtgtgttgtgggaggggagggaaggagagagagtgtgtgtgtgtgtgggagagagagaagaaattcctagcacacactgactaatagcattcagtatactttgaacattcagtgaaaagaattcctgtaattgttgatattggtatatttggtattttacttacttgcatatttttaaattagaaagaaaattcttaaaatgctgcatgccaaagtgtatctggcatgtcttctgtgaagtataaccatgacactctccagaaataatgtttgacactcttcccatgcagttcaatttatgaccttcctctagtcctgcagaaccatgtggccacctcctccagatccatttatgggatcttttttcctgtagctatgtagaacctgagaaatgtaagccctggaacctgggaagtattgacaggaccaacatttctctctctctgggtcatcatcgttaggtgtctgaaatatgagattagagatgggaactagaactttttaaagaaaagaatcagaatacaaagaaaacagattttcacttgtgaatttgtttttgccatgtgtactatggaagtaggagccttatctgagcttgaaactaggtactaggttaacttagaacagagtcagacaattgttagaaacaaagactggagtcctagattccacagcttcccttccatgagactacagtcctttaattttttttttttttttttttttacttgagtagcgttggggtacaagtggtttttgattacgtggatgaattgtatggtgatgaagtctgggctcttattgtttctatcagccaaattgtgtacattacacaataggtaatttttcatccctcagccctctcccaaacccttcttctgagtttccaatgtccattaaaccattttgtatgtctttgggtacctatagcttagctctcacttgtaagtaacacgtactgtttggtttttcattcctgggctactttgcctaggataatggcctccaattccatccaagttgctgcaaaggacattatttttttacggctgagtggtattccatggtgtgtgtatatatatatataccagattttctttgtgcactcttccactgatgggcacttagattgattccatatgtttgccattgtgaattgtactgtgataaacatgtaaacacaggtgtctttttgatatgatgacttcttttcctttgagtagatacccaatggtaggactgctgaatcaaatggtagatctacttttgcaactgcagtcttttttttttttttttttttggagttttttcaattatattattatatataatcacttggaaaaaacgttcctttttttttcacaaccttgccagcatctgttgtttcttgactttttaataattgccattctgactgccataagatggtatctccttgtggttttgatttgcatttctctaatgatcggtgatgttgagctttttttcatatgtttattagccacatgaatgtcttctcttgagaagtgtctgtccgtgttctttatccactttttgagattgcagtcttaactgccaacacaaaagtcttacctgttgagtgaaactcttggtcaagtctgaactgaaatagacttaatttcatgtttcagttgagtcaaggctacaagttggcgaaagtcaaattaggtctgtgtcttagttcatctgtactgctaaaacaaaatatctgtgactgggtaatttacaaacaatacaaatttccttcttacagctctggaggctggggagtccaggattaaggtgccaacatccagtgtcttgtgagggacttcttgctgtgtccttacatgatggaagcgcagaaggacaaagagagctaaaagctttggagccttaatcccattcagaagggtggggccctcatgatctaatcacctcctaaaggccccagctcttaatactattgcattagaggctaaggttcaacatatgaatttggggggacacactcagaccacagcagtttgcaaatgtggttaatgtctacacctaaattggttttctttctggaaacaaaactaaaaaggtcactcacttttctgaacattttagtagtaagcagattttacagtttggcagcctacaacagatggaaaatttttaggctaaggaattttcatactctgggtagccaagctggtggtaaaggaagcacaaaatattagagttcactttagttctgtgagttccaggccaggtctagaaagatttgtgaagtgaagaagttttggacaatgtatacacaaagttgatataaagtgaaggacaaggcatagaaggagatacatagaggagataatagaacattaaaggtattagggaaagatgtttcctgcttactccattgagtgtctggggaaatacagggaagggtgctccatactaccccagttagcacttctaactgcaaacacaggagtaaacacagttcctccctctctactcttctcctactaccttcccctctcatccccttccacctccaggtcagaactgcttttatcttgtatttccagaatgttggggaaagttgagagagaaagaaaaaaagagaaaacggttggaatatggctagctagagattctgtggtctctattccctttaaaattaccatgtccatgtccatgtgtgattgggcacatacacacatgtgcatgagtgtgcacatgcacacagttttcttttatatgtaatacattttttaaagggatgaacttggattagaagaaagaaaacgagatggcaaagagagatactaaatgtgactgcctctggggagcaatccttaaatatgccctcttcctccacccctactcatccctctctaaagcagagtgagaggcaccttttccctgttcttctagcactttggtgaaatctctctgtgcatcttatactatgtgatactgtttgcttatatatgtctcttctcttcttgtctgtgatccacctatatccgggatgtcccttttgtttactttgagtgagatggacagatcacaccgtgacttccagtgtccttagaacatcttatgttaaagaatagactgtaggaagtctgagattgttctactaaaaactcatgataaaatgatgtatgactcattctgtatcatagtttgtgttttaacctatactaatgagccttattttaattgtttcagcagttagtggatggagggataaaggtaaataatttctaggcactactatgttattaaaatattatggacatgtgcaggaatctatggaaatgtgaattggtcatgatcttagatcttaagtcctccaatctaagaaattaaattaactaaaacaactcattcagtttaaccactttaattctaaaatactaaatcatgccagtatgtctggttctggtattcctcaagccaaaatcatcaatattaacacaattagaattcccaagttaattactttatatgcccatcaagattgtttctcagaaaattcattcactgtgatttaatgtgaatttatatgttgagatttatgtctataaacaataatttttgtaggaaaaactctagaatgcaaagcacctatttgtttcagagaataggaaatacagtgaaacttactaaactttctaaaaaatgtggaaggtccttgtcctctactattgcagcagaattgaagccagacccccaaacctgaccaaaatcagatttttgtcactcttctttctcccaaattcataactaaatcataattatccaggtatctattaattacaatgagccggtcgactctttccaataaattatatatctttgttgtcagatttttgtaataaaaggtcctcttgtttcagtttttcatttgtttcaattgttcatttgtttcattttagtctagaattatatacgctttctattttgagagtaaattataactgttttctccttcattgcagaagacaatagatgtgcatcttcaaatgcagcatcctgtgccaggtgccttgcgctgggtccagaatgtggatggtgtgttcaagaggtgtgccattttttttttctttttctcatggttgacttgagctatagcatgacttcattttcctaatattctgtgccttgaaggtgcatcaggaaaaataaagatactgctgaacataaggaaaattttatttggttttatgcttggaaacagcatatctggctgaatataaaataaatcataacatttttattaggaaaattatggtaattttgaaatgaagtgcaaaccattttatgttttccatgtgttctatagagagaattggcaaccacagctagtaacttttgatagttaagtaggctttggtgtggaattcttgcttcagcttgaggcattaggttatgtatcctgttgttcaaaataagtgtttttctgttctaccaagagaaacgaatcctaataacaaaattcttagtaaaacaattacaatgcattccatctttcttggctctagggttgttttgtgttttcttcttttgtcagtaatctggagttagaactgcctgtatctagtaaattgcactgaagaagcgatctgctaatctggggtttcttcttgtatgagattgcctaaataattttacatttacttatgtagctcctgggaattggaacaaacaaacaggtctttaatggctttttgcttgacatggagataagtctctagcttttgtctcctctgacttaacaactgtgcctactgttatccttccaacctcctttattacttcttggagaaaaaagaaagttataaggtagcaacagatggtggatatcactttcttctaggaagcaagtcagaatagaggcaggggaggggttcaagaaacagtaggcatgtctgaaagtaagtctccctactgatagcctaaaggcttcccagatggactctgggctccaccagtgagaaaaccagatgtcattcatgaactagaaagtggttcatcagaacccgtgaagccaggcatgtcatagagaggacaacttcagagtttctgggtccgatcccatcactgcctgtgagccaaatgaccaaaagaattcactttattctagcatctccctttcctcgtctctataacctcaaatttggtgtctgcttccaggtttttctctgtcaagaatgtttcatggcttgttatttcctgaccccaaaccagtacttcattttagatttttactgcttcactaaggaaaatccttagagccctgaagtttgtgccaacttgctgtcaactgctgaatgctttagtgagggtagtttggaagagccttcaaaagatagtacagaagcccagttgtcagccacatgtaacatgttagccatagaacatcaggcttcagagggaccccttctccctgtcacacctttgactggaagaaaataatctggagagtcacagctctgggaatagctgtcagtcctgccatagaaggagggattttgagtattcggaggaatcagttgtctgatagaaagagctaagtcaaggagaaaggaggtggctgctggaggggagaaggaaaacctgtcactgttggcaacattcttcagatgggatcttagggaaaacggtcagaaactcacttgggtgctcatgttcccaaatattctatatagcgcagtgcagcctagtttatgtattgaaagagcaggctctgaagaaacactgagttggattcaaatcctagttccaccagtttctaatgttataaacttgcacatattacctaatcactttgaacctcagatttccatacctctaaaatggaaatacaaattgaacccgcctcacagtcttgtgaggatgaaatgaagcaatgtgggaagcactgggcacagaggcatggcttaagaaatgggatttaggactatatatagaactttgacaaggttctggaacaactcattcacggttaggaaactaggaggattgcctgcattaataacataacctcaggggaagcagccagttttaggactcagccactatccatgccattaacaggagctgtccactccctgcaggctgacctgacgtcattgagaggaagaatgtattatttaattttggaagatccctcaccctttaggtgcggatgtgactgatgccaatgattcctcaaccagcaaggctggaaggagaggcaagggagaggcaggctttttttttttttttctccccatgattaggttagataaatggtaacaacgtaaacctggcttgaataattttcaaggctaatcaaaagtaaaacgtctctagaaaatttagacaggatgtatccagtttgcttgcactattatgtagcatgttaatctgccattccatatactttgctttctctttccttctacactacataagtaattggaaaataattaggatagaaacagcatcatcaatattacctagtttaatgccccatgttcctttctaacatctatggaagacatgatatgtcttgaagaattcccttcctctcctacctgttgtgtctgatgcagagtgtcatgcgtagtgagagttcagagcgtaggctcggagcatagttatactttcacagcatatatgataggaaaagtttcactgtcaaagggaatatgatagaattctctcacttctgtgcaaattgctatgtttggaagtcaaaaagacccaggcgtgggtaggaaaaaaaaagttttcatatatatatatccccagaatactatattaaattgatgaaaataacaaccaataaaaagccaaccaggtcaggcgcagtggctcacacctgtaattctagcactttgggaggccgaggcaggcagatcacctaaggtcaggagtttgagaccagcctggccaacatggtaaaaccccatctctacaaaagatacaatagttagctgggcgtggtggtgtgtgcctgtagtcccagctactcgggaggctgaggcaagagaatttttagaacctgggagatggaggtggcagtgagccgagatcgtgccactgcactccagcctggatcaggagggagactctgtctccgacacagaaaaaaaaagccaaccagagaaacttcagtctgagcttttccttctcaaataggttttagatgcagaaagttggagtaggatttttgcttgtgtttttcttgtagaaatagtaaaaacataaggattagaagaaattaaaatgatataaaataccaaaaatgcaatatttgctatgtcattttctttggatgtaattgatatacactaaaaacatcagtgattttctttcttttaaacaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggtttggtcattttcaaataaatctataatgattcttaacttgaaattgcaatttactttaatttgctcatttttaatattatgtggcaggcagtattgttcttgtagaaaccacagtggactcagaatcaagaaattagaattctagtctttatagtgcctgcagccagctgtgtgtcttcggacactgcaaacctgaccacactatattctaattatgtgttctgttcacataatctgatcaggttgtgatgtaattgtgtttttctactctactgcgagccctaggagcaaggggacatgtttattccactctctttttccaatgcctagcagagcactagcatgtagtaagtactctgtaagtatttgttagcttgattgatcctttttggaagggatcttccaaaattaaatcaatcaagcaatcaatatttttgtgatttaatcacaaccaacttgtgattaaaagtttattacaaagttcttagagactttgtaatagacttttaatcacaaagctgcaattcatgattatcataattaccttgggcagttttgtgatggcccctgagattagtatacaccttttctcctatacctcttttgtacttccccttccttcacagtgtatttcacagtttggcctatgttgtaggccactggacattattcgctttcactttccttcagtgctacagaatcctggtgtaaaaactacatgtagtaagataaatcaaggtacacagatgcgcaccactcaattggatgcatgtagtttaacgcagttcacaattgtatccaatccttcatcatttcattgtgggtggtcctgtcctgtcattaatttttaaataaccattcttgacacactcccttccccattccagaactgtgctatttcttccagactctgattatcagaaaaacaaaatccattactttcttggccctgggcatattcccagtttccaattaaaactgtgctctttcccatattaaataatgacacagcccagtatggacattgtgagcaacagttggaaaggaatatacaaaaatgaaagtaattagattggtaagattatagctcttcccaccttccattgcaaaaaattatttagtgtcgtaaataaattcttttttagaaaaagagagacagggtgaaacaaaaattgtacgttctcgtacacctaattccaattgaatacatccactaaactctgcccttagatattcctataattacacatgcctctctcttgcctgtgttttcttttgcctttatcttagtactagaaagtttgaacattttccgtaagctgttaaccatctttatctctcttttttgtgtaatttgtgtctccatacaaatatgcctatttttctaattgaatgccaattttcagcagcttatatataaagcttaacctatatcatttgcctctaataaatatgactacattcttaaaaatgtcttactcttttttaaattcttgagatttgaaaattataagctgcattttatttatttatttttgttatgctccttcgtgcacactgaatataagctgtattttaacgttatagttgcccaaccatctttaatgattttttttaattttactgttatcctactaggtttgtaatcccagtttttctgatctatatgagcctgagattatgcctaacatcccccatttcttatgcatttccatatccctagcaaaactataatctagggcctttcccattgttaatctacctgattcttcaggatcttaatccaggccatcgcccctttcagcacacatgtaattcaattatatttcagctttctgactcaaatgagtctgaaaatacttcccagttcacacctgaatttaagagtaagttgttaatatcatctttcctgcaaatctttcagaattctcaattcctgcctcttcactcttcattttccttcaacaggattttcaaaacagcagaactgaaaaacccacaccttaatatttgcacatgaagtaaataggaattatataatagaatagaaaaataataaacagtctcttagtctgtttggctgctataacaaagtacgttgattgggtggcatacacaacagaaatttattttctcatggttctaggggatggaaagtccaagatcaagaggctagtagatatggttcctggtgagaggtctcatcctggcttgctacgtccacacagggcagagagaaagtgatcaagagagagaacacacatgcaaaagagtgagagagtgaaagctctccagtatctcttcttagaagtgcactaatcccatcatgtcggctccatcctcatgacctcatctaaacctaatcatatctctcagagaccccctattcaaatactgtcacattggaggttagggctccaacatatgaatttttcggaacacaattcagtcgatagcatttgatacataaataatattttcaaaagcccatggaatatttttagaaatgaattacactttaggcaggaaaacacaattctaaaaataaaactgttcttatatgccaatatctacaagcatggtgtaataaaattttaagtcaatacaaaataataaataaatattaaataacagcaagtttcagagaagcctctcctaaataattctatctccaagaataaattgaaactctagtcctataagccaataatagcagtaacaaacacttcaaaatatacaggttgttattgatgatgttgttacaaaaattcacaactttaagtgcttttattattaaagaaaaatgaatccagatgaactaagcatccaaagatataagaagaagataaacaaaaaaaacataagaaaaacagagaaaagagttcctaaatttaaaaacaaagcaaaattaatgaaatgcaaaataggaaaaaaagaataaaatggatgtataaatccagagaaccagagagctggttctctgtaaagtctaataaaatagataaattgttggcaaatctaattaagaaaagagggcaaaaaatcaaataacctaattatgtaaaccataattatagaaaaaaattcagaaagaagcctttaagaaatattaagcacaaaaatctataataaactgtttaagtcttgagataattttctaggaaaatatgtctaaaattgactcaagatagagaaccctaagaaacctaatatacaagaagtttaaaaagttataaatgtttataattataaaaattataattacctcccttaataagaaatactccctaaaaacattaggtctaaatgctttcatgagcagaaatgtttcatgttcattcaaatattgaaggaatacattatctctgtggtatataaacttttacactactttatttatttatttacttttttattattattattattattattattattattttgagacggagtctccctctgtcacccaggctggaatacagtggtgcgatctcagctcgctgcaacctctgcctcctgggttcaagtaattctcctgcctcagccccctgaatagctgagattacaggagcctgccaccatgcctggcaaatttgttttgtatttttagtagagacagggtttcaccatgttggccagactggtcttgaactcctcgactcaggtgatccaccagcctcggcttcccaaagtgctgggatttcaggagtgagccatcgagcccggcctaaactcttacatcactttaggggatgcctagaagctacttaattattacaaggttagtataaccctattatcaaattcttaataaaattttagcaaatcaaattaactgtatgtgataagaagaacaatatcaccaaacaaataggcttaagctagaaaaccaaagatagttgatttttggaattgatgtatttttatgatgttagtttgccaaaaagagataaaacatattgttatctcaatagataataaaaaataattcaataaaatttagtgcccatttccggcaaaaccaaaatcgaagaatactcccttaggatatgttaaaatccttctcaaaagtatacataaatatgattacatttttaaaaatgaaataagagttataaacattttgaaaagataaagcaaaattatcatgctatggaaaatccaagcaaatcaaatgaaactaactattgaatatttttaaattttactctggcaggttgttttttaaaatattcaaaaatcagtgaatttcctttgtaatattaaatataatgaagaaaaatgatcaattgtgtgattatctcataaaagcaacctagaatgtaaactgtttaggaataaacttttaaaaaagtataagatccattgtgctacctaatagaaaatacgaataaatggagaagaattttatgctcctgaatataatatcataacaatgacagttctctatatagtctataagtataacaaagtccaagtgaatcaataaatgtaagacaatcaatcccagtcaaatttgaatgcagttttttaaaacacatcttcactgaaacttattatgcatgtatctttgtatataaccgcatatttatttagcatgcattcctggcagtagatctgctaggtcaaatgtatgacaatgtatttactttttaatgtagattgttacattattcacacaaaaaattcgatgttcagtttagcctttcattagtcaaccatgcctgctttcattctttttaatgtctgctatttgtttagtccattagctgttttcttttgcctttttcctagaactagaaagtttgaacatttttcctaaggtattaatcatcttcatctctctttttttgtgtgtgatttctgtctccatacaaatatgcctatttttctaattgaatgctaattttcagaggtttattatatattatttgcctctaataactataactatattcttttaaatgtcttgctcttttttaaatacataagtttgaaaattataagttgcattttttctactggtatgttacaaataatttatacacttcaatgagtttagcttgttcttttttatagatataatgatgatttggtccttctgagactataaatgaacagttcaaaagttggaaaattgtttcagtgctgtagacaagcaatgatagtggtaatgacacaggagaaaactaggtaaacttgagagagaatggagaggtggaatccacaggagttggtgattgataggccatgtgggactcccaggatctggcaagcaacttagtgtggtagggaaatctgtatgaatgaagtggtgttgatttaaactgggatgtcttgagttgagagagagagacttaagctatatgaggctgaagctcaggggagagataggggttggagatagaagagaaacaggagacatcaacaggagatggtaagtgaacgcagtggggaagagatcatggggagtaggagagtgaaaaaagagaaataattttatgtcagtcattgtggagcttgattttattaaatttcccattactatttgaatttctatgtgcaaattagcataattgtctaacgtgtgtaagtcatctttccaacatagttgtgagctccatgaggcagaactagtttataacccccatatatagcaaatatttattaaattaaactgaaaatatgttcttaaaaaatgaatttgacatcaaagacatatccgtcttagggcataatatataaagctaaatgttggcaaccccagatatatagaaacatactccatgatgtgaaagtccttttcaccatgagatgaatcagaatcaagggcttgatataatgcatacctaagtggaaaatgcattgagctcttaatattaattttgatttatcactttattcttctctgataaaaatttatgacttccaatgtagcatctgttaagaatttttcatgaatatatttattacatcatgtactgactagggtttcttaaaaaatgttagtaggactatattttaattggatgttttaaatgacatttaaaaatgacattttctttacttttcacttcttataatatactttttcttattttcacttatgaatcttatggaaaatgataacagaaatagactattggtcctagttgatgttctctaaggaaactggatattaactctttaggaaaataggacagagaagggaattctctaattctaattcagaaataatacaatgtatatgataaggattagtttaacctatatttcattaacttaagaaaatgtttcaaacttggttcgttttaataatgtgcaaaaagaatcttctaatttagtgtagatttagtaagattttccagatatgcttcacctgtttcttaatttcaaaatttagaaaacaaaacagaacttgcacattttctctccaccccctggcacacattcctcactttatttcccacagaaattaggaaatgtactggagtctgtaccttgccattataaactggtcccatttgggggcccttctccttcccctgctgaagtataatgaatagaaattggcttatcattcttccacttacagctttccacattttctcttggttttaaaatttcatcttaagcagatcatttttttacttatcttttcctagtgtgcagtcatgttcgttgtgcccagtacatcagagatgctcacaccattctttgagtagtttaaaaactcattttaaccactttttattctttgtattcaaaccaatcactggcaatagctctaagtaggtcatcaactctcctccatgtcttctttctaattctgccacagactcacttcttcccgttaaaattaatggaaggaaatgagtgtctgagttcttagaatctcaaaaggcatgaggataaagctttcctggagataatataagtggtggcaggaagatttgggagccagatgatactcttttcctcttagagaaactctgtggaagctctgcctatactgtgggaaataaattctagacgctggcttctttctgtagtaaacatgtgggccctttaaaatgttgaaccaaaatgtgcttcaaatatagtttagttataaaacatttatgggggagtatgtatgtgccaactacagaggcttcagagatgaagaaacagttcttaccctagtgttgcttagaatctagtagtagtaagtaataattactaacatatgcatttactatataggcaatactagggtaaatattttacatagattaccttatttagtagctcttagctgctaaaaaaaaaaaaaaagataaagatgtccagtctagagtctcataattgtatggtaaacactaaaatggtggtatgatccagttgccatggaaacacaggggcggggccctcagctcagtttaggaaggagcagattactgagtggtgtctttaactggtaattacatgaagaagaagaggttgggccaccacaggcagaggaaggaccacaggcagggcacaggagtatgcatttgtaggctgtatatggggaagtaaagcagatttgtcttgctagagctaaagatgtagacaagagtaagtattatgtaggaacttcgatctgacatgtttagccattgggcattggccatctggtggagagctgttgacaaaaaataagtaatttggattttaaaaggatcgactcggtggtatagataatgatggctggaaaatgagacgatagaggtagacatatgaagaggttatggaaataatccaggcaaaaagacaatgaagggcaaggatggataggagtatatcccagtattctggcatgctagagttcaattgaaatgtttaacttgatgaataataggtaaggaaagtgagtgaaaactaaactactagattcttaactcttaaacccttcactgggtcaaaagtaatgagtttgaacatagtgtcgaaattaacctgattctaccttgtgtttgaaattctacattcataaaggaaaaaaaaaaggaaatgttatggtcggtcccaaattatagtcaattataactattttcctcaaagttggtcttacctatgtttagtggtaagaattgattgtttaatataggaaaaaagacctaaaattggtgagataatgtgattcaaattccaaaaaaaaaaggaaaattagatagctctgcattcagaagaattgaatgatattttaaagacattcacataaacacacacccaaatagattcttcacatttacttgtattccaaaaacagaaaactattgaaaagaatgaaggatggcaacaaagtacatgaacaaaaaaacaactgaagcatcaccagaattttgttttctgttgtagaaacttacttaggttactttctgagactggcaaagaaagataccagaaatttaaagtaatcattaccctttatcttcaacacccaaaccccctaaaatgacaagaacagctataattaatttaatgtgaaattaaaaagggaacactgacatatcatctattaatattcaatacaaatattaacccatggtgccttgcaactaaaaatatctggagagcacatgccaggttaagtttaatctttatataacaaattcagttacatataactgtttataatacctgatagttggaatagcccagatagtggtaaagtattaatagaaatatattcaacatggcttgtgcaaaattaataaaattctttaggtaaaatggctttgaaaatcatatattatgcttgaggaggagtgaatgtgggagggggttattgtcatggggcttgtcctacttgggaggaaggaggaaaagtgaggagcaatcattccccttcccttccttcccctccctaacatttccaggctctgtttaaaaccaatggatattgccattaagcacgtgatgaaactgagggtgctgtccctgtcagggcagggatccatggtctatcaggacatttctgctgtccttttcatatagccacgtccccatgccaactagagttcctttggtactaactctgaaaccactgatgggaagtggagattttcctggaaaccctgaaatgggtcatagcacttcattaattaaatcatttccagggtcactctaagcccatgttttgtaccctattccatttctcctccaaaattatgcccaggcatcttgtccaaaatagtttataagtggctctatgatgagatcacgtacaaaggttaagtgggggtgttaactagggacacaatatccacagtgctgcaaaaaggtatttctatgtcctcttactgtggaatactgatgcctaggacacctgcccccaagagtcttctcctttatttataattatatgatccaaagccaacttgagagcatattatgaggactatctcaaactaatgggcatgacatggtaatccaagcttgacccctttggtttcctccttatcaagcagagcacgatttggggtcagcctagctaggtctatttaccttgaattgactacttaaagctagaccctcacagcaagctcaagggtcttgcagtgtaaaaatatcaattattattcttgctagcgattactaaaaggcctgtgtatggaaatactcttttcctctttattagaaacttctctaccaaggcctcagctgactccggtatacgtgctaaggccagaatttatagaatccaaaatcgagccacagcagcccacactctcacaccccaaccatttggcagtgctttctcacagcctctcttctttgctgaggccagcgagaccggaatttgcttgctaggctatgagcagctggtttctgctgagggcccttgtgtggctagcatttggttggagggccctgaacagcttacctccaaggactgggcttttgctgatgctgtacaggccctggttgtttgctgaggtcaccaacctatacctttgctgggtccctggcacaatatgctgaccatctattacatctagcagtacctctgaaaacagccatttatctttagacagagccaccataaactgcaacgattcaccaagataaaaataccatgataccatgtggccggtttacaaaaacaatcttttttaaatctacaaagatagcaacacttttcatcaacagcagttcacctagagagagtcgacactttttgtctgagtgaaaaacaaaaccaaaaaaacgctgatccacacatcaaggttcaagtccctgaacatgaaccgctctcccagtagtgttgaatttctacttctcatcgatctggcccagtgtaccagtgtctaacattcccctgaatttaatttctccactcaaattgcagaacactgccacaggaacagttctttctgtcaacagaagcccaaaagcagagcagaatataggatatgctctcaggaggcagcctagcttctgaaggcaagggatgagagaatggactgggctgggccatgtgtgccctatttctcctttcaaatatgggccaaaacctaggagcattacactaaaggggttgcctgcacagaaaaagcaaattaggaatgagtagtccctttctccataattattattatataccagcaaaaccttattattttgaatacagtaggtaatttggctgaaaaacatctgatttgtgaaataatcgaaaagaaaatattgctattttatgctaacaccaaaaatataatttgataaattagaaggttctttaaataggtaaattatgtatacaaatgaatgtttattttaaaaatgttttccattcggaatattcttatggaaaaataatgacttacaaagcatttacttaatagtttaaaaaagtaaaatttacaaattacaaattgcttacatttaaatagatgccttttcaccatatacttgaaattaaaagtagaggtaccaactctatagagggttaggggggacaacccaagtccttgtatcaaatagtaatatgacagagaactaaataaaattgtagttccctgcggggactaccgacatttgtccttgtggcagccccctctcctcatccagttgttttgcccaaggtgggtgcctcgctcatgggccccctcctcagcatgtgttcattgaacacctaccgtgtgttggacaaatgctgacccctaccttccccaggtcctccatgtggcactgcagggcaccattctttagcccactgtctcattccttcacttggctaactgatgggaagaatcttaccaactaactagtgatgaggtactaattattttgaatagcttgttgtactacacagtaccagagttttctcatctcctgtgtaaatacactttaacccagaggaataaatttatgcctttatccaataggagatcacctttttttaaagataccttcccagttttcctcaagtcattccacacgtacatccccctcactgtcttgagatcgaatgccgcttgctggtttgcactgtgtttttctagctactaaggcaatggaggttcatataatgatacaataccctgttacatttatatggagctggcccatttgttattatccctattcagcctatagaattgtgggaaatgaactgtaggatttggagaccaataaattggtatggttttcaaattgccttataattatactagaataataattatactataattattataattacactagcatattccaaattttatgtgcaaatttgtgatgattgtgctaggtgctagaatgtgactaatttattaagagcttatcctgaaaagtttaaaatgaagactacatgatgtttttcttctattgaactaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcaggtatctagggtttgatgtggatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcaccaaaaaaaacaaaaaaacaaacaaaaaaccctacctaatgttagtaactttgaatgaagcttcaatagttaggctgccatgtatataaatacctctttggaaattctgtatttttattttttgattgctccaaaattgctgaattatgatttgacacattttaaagagtttgtgccaacacgtcatctatctctccattactgtactgtgactggggataatgatgttgtctccgatgtgactacaaagaaatctcagttatcacaaagaaagtgggtcaaaagatgagaatttgattgcttagaaagagccttttttcttatcattttagatttctgattctaaataacatatgtcccactatgaaagaagaattagccttaaaaatacaagtgtctcacacaatattgccattagcctgtggaattttcagaaaaataaatctgtatggatcttttttcacaaaagactttatctttcttgcttctacaaattgcttagattactttacaatacacattccaatttaccgaaacagctctgtcatctgttgtaccggaacaggattgatgcatccatcaatggagtttcataagccttcttgaggtgaatgtacaggaggaatcattcttactttctgggtatcatagattctcaaaataattttaatgaatattgattgttcatcaataattccaccaagcatcactttaaaaattagtgcagtattaaaaaaaactaatatcatatttcaactaaattcctcaaaagcattttccagaagtgtttctcagctgttcaatgataagaaatcactgcacattcttatattcaccttaaaaattcacagcgcagattaaatattgaaagcctttaactgtcctatattaaaaaacatgtttaatcatctttatttttttgaataccaaatgcttatagtcttatttcctatttgcaaagaaattgtcatcagcattgagcttatctctaattttataagcatagattttcgtcgtataaagtttccctggcacaaaagaagtactcccttttcacacaactgtacaattttactgttaagtattccagaatgcttaagaagagcaaaataaactttacacttcttcttttcccacacagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaagtaagacgtttcacatgatcgagtgtttgctaagatgccaaactttcaaagaatttagacgttttattttctctttgatttgtggagtgaaaacgtagtgtagaagaaaacatatcttactatctcttactcctcaccaaggtgattcatttcggtatgtgtttgggacagaggggctaaattcagggagggatttaaataggaaaagacaaaagggaaagaataggttatgaacgcgaaaattctttccaaaagggctgcttttctcatgcgccacactccaaggaggaactagaagtagactgttgccctcctcacttcagcttgttctcctactttttttttttttgagacggagtctcgctctgtcgcccaggctggagtgcagtggcgccatctcggctcactgcaagctccgcctcccgggttcacgccattctcctgcctcagcctcccgagcagctgggactacaggcgcccgccaccacacccggctagttttttgtatttttagtagagacggggtttcaccgtgttagccaggatggtctcgatttcctgacctcatgatccgcccgcctcggcctcccaaggtgctgggattacaggcatgagccaccgtgcctggcctctcctactttttaatctatattgttcttcctccagtggaacactagaaatctctagccaggaactagtgtggtcacatggctgtgggaaaatagaggatgtacaaataaaagttaaagctatttacgcagcagcgttgtacccacgcacatcgttctagcctgacttactgttcgtcaactcaaacgtaatgtttacttgaggtaaaaaccacagtacacatctgtgttattgtacaaagtctaattacatgtttatttttaagagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggtaatgcagcagtaaccgcttagtagatatgactcttttggttaaagtacaattttaaattggcaactcaactatttttgtaccaggaaattacctacaaaagaaagatacagaacaaggataagccatgagagagaatttatggaacagtgcaatctataaatactgatcaataaaatatatgaataaaacagtttgacagtttctagtagctgactctttgatgaatgacaaagcactgtataatttttgaaaataaaaatgatacaagattttactttttatgtaattctaagacaggggaaaaaagtatacctttgctttatacaaatagaccaggtctacggggtcgatatctacaaacattttaaggaggaaacctcacagtacaataggtagaaactaaatagaaaccagggaaaaaagacaagagagaaagagagtcaaacaaagcaggctttctctgttttgtactttacctctctgcatcttatctatttaaggtctctttttaaatcagtgactatctggcttgcttcctgagggttagtataagctctgaatcatatatttaatataatcacctagaaccatatcttccctggcattatctaattctagttgtgaagaatcaacagtccaaagcatcatttacttctgatgttgacacttatttatatattcttgcatatgttaaaacagaacctctccaactttctcagttcatgagaccctagtctctcagtgattttattccatgacacccgtgggtcaaaagaaatacctaatagttctgtttttttaagtggttaagtccaaataactcaactatttatgtcttaacaacttagtatctccttaaaaataatacaaatgtatcaagtgtagagatacatgtttcagttttagtaagtaacttcagaaattttcaaatcctgaaatcagattggtcatcactaccctgatttcttcttccgtgttgattttcaagttgaccagcttggtaaagattaatgtcatttaaaagaatagaacgaaatgtaatcttaaaactatgaactccctccaactagttcttcattggtacctgatacatgctgaatgtcactgtatttctcttgaagatttaaattatttcctgccacccttgggagtgtgctgcagtgcaccaagacacctcacacacagtttgggaatcacagtatcagaagcatgaaaattatgctgaaatttgtgtggttcccatgggtaaattttaagtagatcaccagttcatctgcaataccctaccagatctgttgaaattctagagtggcaattgtattaccatatgaaacaggttcaacacttggtcattttagtttcttgaaagtagtatcaaaatataaagattttaaaaggtaactagagattgaattcaaaaattcaagaattggagttattccaatagtgtctttccataattctcttctactcagccttatttcactttgacagacccacctacttctacttagtcatttcttatctatctttccttctatttaacctcttttgattgatggtagagttctaatttatttattggggagtaggagagggtacaggaagaattattctattgtgagacaaagagaaggtttttatttttttaagaagaaaataacaatgacattattctcaaattgtattattcttttgaagttttgccaagtcactgaagtcatctctccataattgtatttaaaaggatactattgctcatctagggaggatttcctaggcaaagaaatgctgtcataattttaggcatataccatgttatagaaccttatggaaataagttataagtccagtggaattttagatagggcttggattcttatgacatcaggaaattggatgattacatcaagaccttttaccttcttggtcattgttcccagtatttaaaggagtgacccttccacatgtcactgctgtagtatattgagtaatccaaggaataatgtgtttgttaacaccttagaaggatacttttattttatttaccccaggtctttgttttaaaggattatcttcctaaaaattctcattcccttcatttgtagggtcactgcctacatattaggtaaaagaagctgaagcattttgattgatcccttggccatgaatttatacattcaagatgtgctcctgctttggaatgttctatattgaaagctaccttgactttgactctaggcatatttatttgtgcatttcaaaatgacctctatcctcccctatttggccattatggaggaattttaaattttgtttaagacaagtaatcaaacactttgcttcttggctttatctccagcagccaatgccaataatgttgaatggtatctgagtttcttgattcaagagtcttggggtttgtatttataaaaggaaacaactgattaaaaaaccctttatatgtctaaattacatgggacagagttctgttgcttatacatatagctatttcctgaaggtcaatgtgaaccctagactaataacaactgccattttattgagtatgtattcaactgaaagcactgtagcaatcactctgcatacagcatcaaatttatctttacaacaactctataaggtagtcataattagcctccttttacaaacagcaggactgagggtcagaaaagctaagtaagttgcctgagaataaacagctaaaacattaataaattgcagagttggccctagtctgtctcaatcttatattaaaatctgcattctttactttgccacagtctgtcgactgaaatgcagaagaaaaagaaaaataatgttcttgttgtcatttcttgtctttctggttgcagtcttatgaaagtataaccagatgatttgacttgcataagttgtaaaacaacatataaaataatttatatttacacattgtgatatttgtatatggttgctggcaaatgatgttacactattgaataaattacattttccactgctttttcatcaagatcaagtgccagaataaaaaactgtagcaatagtatagttttatgatttatccagtgataatgacaatttgaaatgtgacattctttctaaaatggcagatgttaatacaaaaattattaatgatgtagtagactattaatactgagggtttggaatttcaccctgtctccccacccagcttctccagggttatttctacccttagtcagagccctcccagaaactgttcacccaccccttggtggaggccaagaatagcatgaaggtcttcagtaacaatgaaagaagaccaaggaacaagtatgtggaggtcatccaatgaaccttatcaatgggattttcagatggtgatgtgactcacagttttaaatagcgagattcaaattggcaagatcctaccacattcctattgtatgtactagtgcataccatatattcactagtatttactggtttaggcttggtgtttttccatgcagccttttatatgcctcatcacattatggccagtgattctttatccctcctatcatatacctcctcagaatccccttactgctggcttcatagttcattccttttcctgcaggctcatttggataggctagctgctgagtcgatcagcatcttatagcatggaggcagaattgcagaaggcctatcaggcattaaacagttttgctttctcactggcaaaaatagtcaacactgtgcctctcctcatgcaactttaacatgtacttgacttttaagtatgccatttaggaagctttctttttactatgaatcttatctacttggaattatacttaatttttccaggactgcagatgaataaagagagcttaagaagctactttgctaatgtaatccataactttgctacctgagttaacaaacgttcataacactattacatttattctttctgaaagggatatttctgacattttcaaagtctggaaaacatttataactaatgttgagatcagacagaattccatgtgaggagataattgtgatcttttaataaagagatctgttaattttgtttgctgtttcccgacagagacgtggccttttctacttcagaaaatgttaaatctttttctgcttctcaggtttgtctcagatgcatactaataaaaatgcaaattcatggaacacttattttgtgccaggtatggaatacaactagaaagttttaagtccatgtgcagcttttaaaaacgattgttccatcttttggggcatcgaaagactacaaagtacctgatttcagcttgctgaatgatctgcttcaaattgtaaacactatgagaacattttttttttttttgagacggaatctcactgtgtcgcccaggctggagtacagtggcaccatcttggctcactgtaacctccgcctcccaggttcaagcgattctcctgcctcagcctcccgagtagctgggactacaggcgcgtgccaccacacctggctaatttttttttttttttttttttttttggattttttagtagagacggggtttcactgtgttagccaggctggtctaaatctcctgacctcatgatccacctgccttggcctcccaaagtgctgggattacaggcgtgagccactgcgcctggcctgagaacattttaatagtaattttataggagaactaatttgaatgcttctcatattctcaaaaagagtggcctggaaaggatctctgcaaacaatatttagtaggaattgttttaactgaaagcaaaattgcatgtagaaatcacctgtgccagactcaaagtagcctggctctgcttgtgtaatgcctttcaaatggggtaaaattatggtttgcaaaagtgacacaataaaattcaactttgataaaaatttttatagaatggaatattctcattaaattagatgttgtaggtaagtcatacttaagcagaaagctttttgttgccattattattgaaaaacttacaaaaatcaatgcatacccttcttcagtaaatagggtatcgtgattacaactgatgtcatatttgccaggagccacaaactcaaacatctgcagggccaggtaagaaagataagcaagtgacataggtcaaggaaagcacatccaagagcatatcttgcctttaggaaaggcctccaaaactctcttattaagcagtcatttgttaaaaactgtcttttcttgagcagacctatggtgtttgtctctttatgttcagttaacagcattcaacattccagtgaaatgtagatattgctttacttctactttataaatgaggagggaaaaaggtgctaaagagatcagcatcttgtctggaatcacacacccttatatagcagtgtccatagtagactttaagctgtttgacatgaaccgctactcatcattggtcttaataattacagaacagtaagtgaaggctttacgaagttaacctatttaatctccaccatctgagtggtagatactagtgtttatacctgctttatacctatggaaactgaatcccagcaaggttcagacagctgcccagtgtcacatagctagtagtcgcagagccagaagttgaagcccagatgatctgttttcagagcccctgctggtggtgtggttctcaactggagtgattttaccctccagaggacaatttcatcaagttatgacattttgactgtcataactgtggaaagagggtgctactggcacctgttgtgttgagaccagggtgctgttaaacatcctacaatgcacaggacagcccctttgtcaaataaaaaatatatccagcccaaactgtcaatagcactactcttgagaaaccctggtctatgcagttatcacagtgcaactatgtagatacaaaattaactatcaggacagatgttgactgacacatcattgaaagtttcatctctaaataaatgtctgctatctgattacttctatgctatttgcctctttcctctaaaaaatcacgcagataaaaggtttttatttaagttgtttggtttttatatcttattacaatattccatactataaattctatattctattataaaaatttatattatggatctcacttgtataaagagaatcttaaatgcttttttatccacgtagatatacacattattaaaattctcccatacatctgtacacagttatctctttacccaaaattgcccccaatgaatctttcttacgtcttctttccttctgacatttataagttacttcccacagccttaattacttagcagctgtcttggcacattgctttccttctcccttttgcccctgaagtgcttgttatctctattaattattttcagagtttacagaaacaatatgtaatgggttagacagagagggagttggagttcaggagcagtgatgtcaccagaacaggagagttggctgagagggagcgtgtctcctgctagtgaaataaaagataaaatacttttttgaagataggctgcttcatgaaggaaaggggaaggggcttaggcaatggtcattaatccacaggtcttctgtcaacagtggtttatttaaacatctgttatacatttgtaatttttaaatatctgccttgaggtacttggaattttcttttaaaagagatttctctctagggctcaaaaaatctgtttttgtaggcttgaaaattcgactaatctttttttttcttttttttattatactttaagttctgggatacatatgcagaatgtgcaggtttgttacctatgtatacacgtgccatggtggtttgctgtaaccatcaacccatcatctacattaggtatttctcctaatgttatccctcctctagccccccaacccctgacaggccctggtgtatgatgttcccctccctgtgtccatgtgttctcattgttcatctcccacttatgagtgagaacatgcggtgtttgtttttctgttttcctttgttagtttgctgagaatgatggtttccagctttatccatgtccctgcaaaggacatgaactcacccttttttatggcttcatagtattccgtggtgtatatgtgccacattttctttatccagtctatcattgatgggcatttgggttggttccaagtctttgctattgtgaacagtattgaaatgcatgtgtctttatagtagaatgatatataatcctttgggtatatacccagtaatgggattgctgggtccaatgatatttctggttctagatccttgaggaatcaccacactgtcttccacaatggttgaactaatttacactcccaccaacagtgtaaaagcattcctatttttccaaatcctctccagtatctgttgtttcctgactttttaatgatcgccattctaactggcctgagatggtatctcattgtggttttgatttgcatttctctaatgaccacgactgatcttcttaataagcttctgaccaaactagaactttctagatttaagttttatgtacatttggtcaaagtgacttcctgtttttggaaaggggaagagattaagaagtcttcaaaagctgcttacattttagagtgccacttaaatactgattttatgtcagttaagtaaaagctggttgaaaacatgtattaaattgtccttaaaatacaaatgtttccaaaaattaagaagggtgaatgcttagcaagctgtgactatcttgtcaaagcaaaaatacttgaaaagcagttgttgtcattaaaaaatatttccaatacagacagatttaccttgcctctgcttgttctctttattcactagcattatgcaaactgtcatcaatctattttaagattatgcctttcattaggaacaagtaataagaatttagctggcagaatttgtgtttttggagttttttttttttccattgctttacaattatattcttaagaattgctctgagaaaaacttttcctatgcagacctacgtgttaatactttttaagcttcttcattagttggtttcatatcatgtgtaaaggcaactcatgaaaatttgatttgtttctatcacaacaattatagatgacagagaaataaagtgttatttgttacttagaacttacgttataagtgaaactagttagtctagcccttttaccaagttcacatagttgtcacaatacggaaatgtttaccaagttggtttaacaggatttttccttaaagaaaatacagttaacattggagagtgcagtgggaagcaaaaactatggagtaatttgaacttaaatgttatgatactaattgggctcagttacatactaatctttggcttatgccattaggcaccagtgaatgaggagagactactgccagtgaactttaacatcatctctctgataagtatctagctatgaacttgttattcgagacaatcattttaatttctagaagagtatttatagaaaaaatattaccaataatatacctaactatataactctagatagtcatttatgtaatcatcagatttctcatgttctctaaactaaattttatttcaattttcctactcttctctaactttctcattaccacaaagagtgccacagttggcacaacataaattttatttatcaaagtaaagcaggtataaaatatatcatacaacaaaaatattgagcataatgataagttgagaaatctgtaatctataccttgtataagcagttgaaataagaatcagaattgctattagttttgatcacttactgcatgcaagaaaatgcactaaatagttcacatactattattatctttttaatcttgccagcaatcatggaaggcaggtatcattcacatattacagaagatggaattgagaacttttgttgtaaggtgacaaacctaggacttgagtagagcatttcctgcttctaaagagcgttactatatcatgttatatatatatgttatataactatatcatgttatatatcaaatgtgtatatatagtatatgtggatgtttgaatgtgtatgtgtatatatatgtttataggcatatacatatacatgcatacatatttgcagttcaatacttgttactgaatttcaccttagaatgtgattgccactaacgtgtctctatttctgaatattaaattatctgtcagttacaccatttggagtccagtgttaatctaaagaggtgctgttcactctttgttagttagttgaattcagctctcttcatctttttaagttacaggtttttatgggacttttgtctataaaatattttaatacatggatattgatgttatgttttcaaaaatttaaatgtctttagtaaaaccatagtccttcccaggtacatttttatgtaagtcatacagttttcttcatactagatgtttgaataggatggagctatgaaatttcattcccttatttattttattattcattacaggaacacccctcactaggccaactttcagagaaattaatagacaacaacattaatgtcatctttgcagttcaaggaaaacaatttcattggtataaggtatgttaactctgaaaatgttaaaattaaatttttttcattggtaattgaaattaagacatttctttagaaccacagataaggattctggaattattatactttgtacaatctaaattctatattgtattactaaagtatcctttacaatgtcttcacttagcatttaagcataaattctatttaggtttgtaacatctagaaccaaatctgagaactgagaattgtattggatacacttgagtccagcctgatgcttagggtggtctcaaatgtgacaatggtggagaagacttatcaggcaaaaagtagttcacaatccgtctttgcatcttgcatgtctagagtgcttcttcttattctggtacatgagcatatcctcataataggttaaagttagagaatatcagcttaattctaaatagcactgacacacctagctttggtctaggtcattcaataacggaccaaaaggggccatcgaagtgtctgagccagtcaaagccttcacacataagaataatcttggtggtgtctggagtcttttgggccaggtgagaccctcaagcaaaatagacagcaactgtgtcacactggaggtgccatggaccccccagcatagaactgttcctctgcaaccctgttatagctttcttttcacaatctttaaggctctttcttcctagaaactctcttgttctcattttcatgaagctatgacaccctaattttcattgtgcatctctgtttacttggtctccctcatctcctttgctatctttgtttctcccatctgctccctaattatacatttcccctcagtggccagtccccagtgccctctacttatttttaaaaactgcagagaaattacattttcttggcttcaataaatacttgaacccatttccatttgccacaagctggtgttccccctaccagtttccctattacctacctaccttatctgaaagcactactttaatcgtaacacttcttcctttagaaatctatggtgaagctttatttatttatttagggtaaatgtatggagtacaagtgcaagtttgttacatgtgtagattgtgtagtggtgaagtcagggctttcagggtgtctgtcactcgaatagcacacattgtacccattaagtgatttctcatcatccaccccactcccaggccctcacccttccaagtctccattatctatcattctacatcatgtatacacattatttagctcccacttatgggtgagaacatgtgctatttttctttctgtgtctgacttagtgaaactttatttaattccttgtttacccaaatgtatataccatggaaccactttttaaggtaacaacaaactaacatctgcagaagtaggactctggccaaaattaaatggcccaaaccactttattagcaatcgtaacagcttccacttattgtatacttaactattgtcaggcattgagtttgtaaatacttattaatctaatcctcttagcaactcataaaaatgaggacagtcatcttaatatgcccattttaaagatgaggaatcatattttgggaggctaaatatttgcccaagggtttctaacaacccaaatcctctgctcttaacctctaagcttaatagtttactttgaaataccatgcagctttttatagcttttgcttcctctttgctgtttctctaacattatttcttggcagcattattggctctagcagtttcttcctattcctttaaaaatttgccattaactgataaaccataaaaccaggtttattattaactaaattatgcacaaagtcagaatcaactggctccaaagcctgggaagctccggtgtgagccccatgcatgcccctgtagtcacctcctttgactgcctagagatcttttttatcaatcacctttcacctgggttctaacaacctcatggctgataatccatcctccatctggctgccagagtgatctattgaaatcacaagtgtgaccacagtactcccttgagtaaaagtttcagcggtgccctctgaattagaggaccaaatctctaaggtggcacatgaggccatgtctctgcttgcctttctggcctcattgccccactgttccttgccttgcagggatgcttctcatccctccagccatgcttctaatcctcctgtgcacaaacactcagccaggctgattctctcctctgtgcctttgttcttgctgcccaccctcgcttctcatgtctggaagcccttctccctcattactttattaactcttactcatactttaaggcatggcttataagtcatctcctccagaaaacagtccttggcaaccttccccagctctcaaatgctggccaggtatccctttcattagggtctgtgcacatctctattgtttcacgtgttcacatgtacagtgtttagtgaagaaattgtcatttatatgcttgtgagatccttaagggtggaaactatgtgacctagtgatttggcatctccaaagtgtataaagtaggagctcaataaaagtctaataaatgaatttttaaaatctataaatgatacatttttccttatgacttgagatgccaagttgttagtgtctaagtaatggctggcatccagcaggaacttaaggatatttgtgaataggataaaatgcaagaataaatggatttcaaaactttttaccatctgatttcctataagtacgtgccctttagtcagattggcttttttctatttttgcttcatcttcgattcatgcagacctttaaagcctttgctcattctccctaaaaatacctacggtcttctccataataagcagcatgcatcaagaacacataccccatgaagtttccacttgtgactatgatttttcctaactaaagaagttttgggaaatgctgcattaaataatgttaaatcatttctagattgcaggcctactctgaaacttttaatttgcaaatgtgcattttatgtttctaagtggaagaaaccatatgcagaacttcccaagctcatttgccctcaaaacttttgtatgtttaaaatctcttgggctttacattccatggaagaaatttgggagatgctcatctgcatttcgattggatttttaggtcatcaggtacagtgattccggatgcacacacagtcatgcacatgtacagacacacacaaccactacatgggtatatgttctggctgctctactaggttgcttatatttttcttgtgtcttataggttttcattcatttaatggttcaccttcaactgataactacaaaaatatttactatttgttggttgctaacccattacatactattgtcattgtttaaatgctactgatatgttttataggatcttctacccctcttgccaggcaccattgctggtgaaatagaatcaaaggctgcaaacctcaataatttggtagtggaagcctatcaggtatgtatatattagatacaattttttaaataaaatttttacctcaatttctgtgacaaggtacaaagtagtgccatgtcatctcgagaggaggagtagaaagcatattagattaggaattaggaatctgaagttcatccctggccctaccactaactagctttttgctttgggaaagtcatttctgctttctgtgcctcacttttctcattgacagtcaacagagattgggctagaggctatctaaatttccttctacatccagtgctcagtgaatcatcaagtcatagctatagaatgtacattattaccatgaaattgcgtcatttcctatgccgtaatgataaagtagaagtccacagttacgtaaggcaataatctgccagggcagttaaactatctgggatatagcaattattaagaggagtcggttgggatctctatgatcaaccacttgattgttcaacaattattttagcatttttatcaaaagagtttgattaaaagaatcaccttagtagatactctgttttcttgagttgatggttgtatgctgtcatcagtcctatgaagagtgaatgcctcaatgcaaagaatttaaagaaacatctgttctttcaacctgcgtcattcctgaatagaaccacctctgttaagatgttgtgaaaatagtgactgctacttttttaccactaagatccagtcactttacatacatgacctcattcagtcctcacacctgacctataaagcaggtggttagtacccacattgtatattagtagaaaccaagactcaggaaagtgaaacaaacttatcaaaggttgttcaactaataagcagaagaaagtgggatcagaatccaggtgttcctttacttcaagcctcaggtgcttcctcctctgcgataccacctgtttttcattgttttacagtgtgtcaaaagatatgctttatgctaccttgaatttatgggccaactatagagtctctttcccaaattctctgactcccttcctaacacgcagagtttaatagttaaattatagccaaagcattgtggaaaaacctctcgtttctcttctcgttttctccagacagcaccttcctttagcttgggcacaaaagagaaaggcaggaagtagacacaatatatgaaatgaagaacttaggccgggcgcggtggctcatgcctgtaatcccagcactttgggaggccgaggcaggtggatcacgaggtcaggagattgacaccatcctggctaacacggtgaaaccctgtctctactaaaaaaaaattagcagggcatggtggcgggcgcctgtagtcccagctactcgggaggctgaggcaggagaatggcttgaacccaggaggcggagcttgcaatgagccgagattgcgccactgcactccagcctgggcgacagagcaagactccatctcaaaaaaaaaaaaaaattaagaacttgtttaaactttcatcttctaaaaggaaaataaatcttgcttgatttgttttcactgaggatagttttctatgtctgaaaagtacgttgagtaaaataaggaagagcatcttaaattacatctttctcactgttacaaaaaagaacagtgagactgaagagggacttatcacagaaaatcaaatgtgtctacaattcattcccatcagtagtctgttcccaagaataatcaaaataagacaagagcttatgctgtaagaaaccactctaaattctttagtatgaacccatttattactccaaaaaaagtatataaatttacagatttttacctgtgtgtcagactgccccagtggcaaaggagacagcaacatttggttattttgcctagcataggtatgcaatgccttagtccagtgtagttctcatcaaccgtaaacagtggaaaaataatattaaatccaacaaaaacttactggggctaactactctccttaagttggaattctgttattattttatatatgtttatattatcaaaaatcttctaaactttcattttgtcttcacagtccaacagaatcaattcacaatccattgaagaattatatagaatctgcctctgtacctattagatactaaaagggaagctcaagattatgtctggggttggatttctgaatccccaaactgggcaaaattttaaggatttgtcttcacatcaggcttgaaaaacattggcctaactagctaagatcttttccttttctttctttttttttttttttagatggaattttactctgtcttgcccaggctggagtgcagtggcgagatcttgactcactgcaacctccacctcccaggttcaagtgattgtcctgcctcaagctccagagtagctgggattacaggcgtatcacgcacacccggctaatttttgtatttttagtagatgcagggtttcaccatgttagccacgctggtctggaactgctgatctcaagtgagccacctgcctcagcctcccaaagagctgggattacaggcgtgagccaccacaccaggccaactaagatcttaagagaagcagaattttagaagggtaaactgaggatgctcattgcgttaggcatttccttctgatctgctggttttccacatatgaacatctttgtataccactggaagtttatattgatttaccaagattatacaattaattgttgcagtgtgtatgagctctctggaagacatagtcttacctactgtaaataatatttactttgagaaattagaggaaagtctcttgttctaaagatacgctaccagaattccatgatcaattatttgtcagtaagcacgtgtttctttgttgattataccattgaagaagagaaatcactcaagtaaagaattagaagccactggaaattatttttcttttcataacccgctgctcactctctttctttaggcacatacttcgtttttccttttttttgtttgttttttttttggcaagtgaaggatttttgcatgtggtagactcttagttgtatggaataaaatgcacacagatctgaagtatacattaaaggtagctggatcctttggaatttgaagattgtaatgaaagaaattagtgtgtgcctgccacacaataggcattaaatagatatttattgaatgagtgtatacatgggtgaataaatgaatgaatggttttctgcccagtaagaggccctattttggtattaaggattgcagcaagcttgactgacacaaacaagtcccaaggacttgggaaaaattctaagccattcttggagagccttatagaactatatctgtccagtaattcttgctccttcagtgtagaaatggcctccctaaaatgtacttgtcaattctgtgtcaataagtcattttagctatcatgatagtctcaattgtttgaaacaaaaatatttctttagcagctttatatggcagaagcattttccacattttaaggtgtcaagatttaccctttgtgatgatatatgtgttctcaaggtttaattacactttatcataaaatatagttattactggattaaaaatgactgttttgttaacagactgataaatatctttgaagggctcaaaatgcagtcatggaaatatgtaaaaaaaatagaacaatttgaatgcagataatctaatccttcagtatttcttatgtatttcaaatataattgggtcattatgtggaaacactgtttttattcatccttttatagaaacagcctctttgatctagttaaaattaaatctataatgatttaataagcttgactctgctttgttgctgacatttgaaactactctcgtatgtaatttaaaaataatgtctctgcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagtatgtgggtgtgcatttttcccttttaaaataaactaagttgtttggcgtactttcttacagaaaaagcaaaccattctgaaaaattttacttactactgactctaagaatcttatttatacttcaaggaaactttcattgtctctcctcaaagttcctacttgttttagctcagctgattgttctctccaactctcaggttttaatatgtatatgtgtgtgcgtgtgtgtgtaatatgaaacaatcatgtatcaatagtaactttaaacttaggcgtcatgaccggtataaattaggaaatcacatattctcaaataagtagtgtctgtacttataataatgataatgcctttttgatttcatattcacaaactctcaaagtaaatgtaaaattgaaagtcacatatcacagaaaagaatgggaatgatagaacagttgataaaggctaagaatttcaaaatctttcactttgtgattgccccagtacactcataattatctaaattatctagaaggaggtagggaaatttattaagaacaatacaaaatgggaagagtcatcatttaccaaaaaaaaaaaaatgggatgtaaaggagagagatccagattgtaacagtatcaggaaacagcaccagaggagatagagattctccaaggattggcacaacggagagagtaacacaaagaaacatactctttaagggagtctttgctgggtgaagtgattttgagtgagtcatttacgtcatgaggcattgtctcatgtttaaatgaatgacttggactagtagatttccaaccccttttaatctaaagtgcaatgatgattaattatgtaatgtcatgctatagaaaaaaagaaaaagttattgaaagtgatagaagattctaaaaatgaataaaagagactcttctctttagttagaatatgtttttctatcttaggaattttagagctgtgtattttaaattaattattgcaagtttctaattctgtggtttcttctatgatcactccgtggattttgttcaaaggacatcatataccagtttgcaaaatgcactttggcttttcattaaaactacagagaaaactttttactagcaaatatagcactaagttactttatgaaaaaacgcttactgtcttagaaatagttatttccttcaaaatgtcattttggaagaatggtttttcttagcttttacattgttttttttcttttcatttgcttacatgccatctttccttcattttcaattgagtagtataaatagtttaactctcaggaatagtcatatgacctcttaattatagaaaccccagagtatgatctactgttagagatggcagtggccacattaacttatgtatctgttaagcttcagcattctcaaagacaaaagcattttaagcataacaccaactgtattgattttaatattatggaacaaattctaatgtttcatgtatatataagccaaatttagatactttatattattatatcgtagatatatattccaaccaaaaagctcagcgcaaattaattttaaattgtaatggatctcaatccaacgtgaaagaaatataccttcttatttaccaaagtacctaaagatggtaaggtgagccaacaaatataaatagacatattaaatcaattgtgttgtgcaaaaagaagaaatagagaaaaagaaaacatttgaccaattcctgccagcacagctccttagttctgggctatcttcttccatggagacaaatagataacctgtgttgaggtcttaagatttgcaaatgagagtcctaaacatttttctttcgagtaacatcagagaaagccacaggttttcctccactgaaaccctgtataaactaaaatttaactccgaaactttacttgggctcctagaaaataggaacaaaattaaaactgttcatttgaacatcttatctcagggttttgatttttatttatttatttatttttgagatagagtctcgctgtgtcactcaagctgtagtgcagtggtgcaatctcggctcactgcaacctctgtcttccgggttcaagcaattctcctgcctcagcctccctcccaagtagctgagactacaggtgcgcgccaccatgctcagctaatttttgaatttttagtagagatagggtttcaccatgttggctaggctgatctcgaactcctgacctcaagtgatccaaccgcctaagcctcccaaagtgctgggattacaggtgtgagccaccacgccaggcctcatctcagggttttaaaccagtagagcagaagccctttactttggtttatgtgatctatctctagtgtcaaatattcaataccccacattttaatggctgagtttagaaaatggcctattctttctcatgtttgctaagaaattaatcatcagtgatggggtagatgcttcagataggcttgcactcaagtctatttaatggtgcaatatagggattagtagttattatattctttaaccctcaagttcattcattggaaaataaatgactttaaaaagagatgttgcatatatatgaaagagattacatgtgtttcttttacaaatatcgttaatttctctaagatggtttcttatcaattcagttattaacagatataatattggtaataaaaataattaaggtatataaatatatttcctttttcctcctaaatttaggttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctggtgagtataaatatatacaggcagcttttacttgtcactattacaccagcatagatgttaaagtgtctttaaatcacatgtttataaattagcaaaactgaatctgaatttgttattcaaagtttcaaagtccatgaaattagggcatggcaacagatttatagtacgtgattttgatatttatatcttaacctattttatacaggaaatgcttcaaaataaaaacctaaaattaattgttattctcatgctttccttgatcttggaaagaaatataccagaaaaggaaatgctgatgatatctgacacattttccagaagaatcagagtattcttctagaaggatctgattcattctggtaaatggtcactccctccaacttgctcagaggattttatttctgtcaggatgatggggagtgagctataagagtatacttttcattcatatgaaaatccttaatgcattattataaatggtattctaagctggcagtaatttaagcctctccagtttattttgggccaccaccagcaacaaaactgccaaaggacagcattcttcaagaaaatactgccttactaagtaatctaaaagattcgtccttgaggccacacacagaccaaattttaaacatgaaataaattaaaataaaaatacgaagatcactcttgggccattcaatttactgccacctacaggttagattccacaaaatctaatcaacattagcaaactaaaacaaaatactgtttttaaatgaattaaataaactacctgtcatctgagttctgtgataattttcctgtgacaatgtgctaaatttactcattgagaaaaacatctttttagtatttgcattttagtaaataaatatgtgttaaattattgacgaatggaaacgtcatcataagcatatgggacgtaacaaacctataaaaaataaatgctataatgtagtctcagctgaaaatttggcctgtatcacctaaatgtgcaatggaaaattgtctttttattctgtaacatacatagaatatcttaatatacaaacatttattcaactgtaactgacatcatgggtaggatggattatagatgactttagaatgaaccagcagttgtctactgtattttatagggaggaaaaatattattttacagtgaagagaaagaattttctgaagtcacgtcccacagctgtcaatctctcaagagggtttcaaatacatttgagtatttgtcccagtctctgtttgcagtgaaatatcgaatgtactagcttttctatatgagtatgatactactgacccacaagcagttgagaatctgctttgaattgtttctgtgtaagtgcagactgtaactgacatgtactttctccactagtctcctttgggaataaaaacacatgttcacaggcctgctggcggggagtcagcataagcctgcacagcacagagggcttggccgacatttgtctggcctggacctcattagttttacacttagcaaattgagctggtcctacagtagaatctgtggaacaattaccctgtgaggtgctcagcaataaaagaagagagagagggagctaagaaaggaaaggaagggagagagatagaaggaaggaagggagggaaggaaggaggaaggaagggagagagggagaaaagaggaaggttggtttgtggctagataagcttcagaattcctatatcatcatgtgaaatgtacccccttttgacgatttctagtgcacattggcatattaagttttggacacttttactgtctaaaatccatttaactatgtgtaactatgttttcttcaccccacatgcataatgttcccccaccacacacaccatctttctttctttttttcatttaccatctaagaactgctcacagtatagaggaggatctgctctgctaacttactaaatagtgcactgaggatgtgaatgcaattgttcaacttctcaagagacctgatctttaaacatggcactagcagtactgaagcactagaaaagtttgcctcacagtcctgcaaagttatcctaggccttcagcaacatcagaagactgagagaataggtgatggaagccatatcaaatacctgtatcttttctaatttcaagtcaggcagttaacattactttggcctttgcagtttcttgatatgtgtgtttttaatgtaaaacggaatatgcaatgacattcaagtagtctggcagccactgaagcaggggtgcccttcgtgcttgttagcggagtgcattagcatggggagattatctacagtagaacagctttgaaaacagaccctcctaaatccagcactgtttgtgtcagaccaatgaaaaagtgatgctgttcccattcattggactgtcagtgcgtttccatggagatgatacaggaatccatggttgaaaactctttacaaagtcagtgatccagataacataggtcctgcggtgtcttcctcacagggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggtatgatttctttgactccaaacatacacaaagaatagctacttttgtccttttttgttctgacttccttaatcttaaacgttgccagatacattgtgaccaccatgctaaaaaagaattaaatgagaaatgctatgaattagaagacttgaattcaaatctttgacccctggatagctgtggaagcatcagagtatatctggacactcactaccttagctttttttgaaattagaggttgcctgctacccagcttactatttagtaagcgtgtgatctcggacaagttgttataattttctgtgcctcagtttcctgatatcaaaagtgaggatagtaataataccttgctgtatatctgtgaaagtatcaaatgattcatataaaaaaactcacctttgtacttgatgcatggcaatcatagaataaatgttagctgttactgctatgttttatatttaatatatatatatattttttttttgtgacagagtctcactctgtcgcccggctggagtgcagtgacatgtcactgcaagctccgcctcccgggttcacgccattctcttgcctcagcctcccgagtagctgggactacaggtgcccgccaccacgccgggctaattttttttttttttgtatttttagtagagacggggtttcaccgtgttagccaggatggtctcaatctcctgacctcgtgatccacccacctcggcctcccaaagtgctgggattacaggcgtgagccactgcgcccggccttatttttaatattttaatgataaagaacaatggtgtctgtgacacaccctagaaataagtgatatataaatgaaaggttatatattaaatgaaggtgacattactgttttgtgccaataaatttttcagtaacaatttgagatctgcacaaagacttctaatctaaacactgtaacttccagtttgttttattcaacattttaaaccattgactttctcagattagtagctcaagtaagttttttagaattatgcatggtaatttatttaaatcatttggaaatgcaatccttcgatgtaatgatggagttagttctaatgaacataatcaaaatttgaattgtttctgcattgttattttgtctttttttttcttgcagaaaatattatagtccaccacctttttaaagaataaatattttcacttctgtttccccttgcaggaattgtatgcaatgccttcaccctcacaatttgtctcaggctatacttgatcagtgcaaaacctcatgtgctctcatggaacaacagcattatgtcgaccaaacttcaggtaggccaaagcttaataatcaaagcacagaagagtgtctgtagaggatgatgttcccccaaaagacccataattaaccatgctaaagaaaggactgggccgggtgtggtggctcacacctgtaatcccagcattttgggaggccaaggcgggtggatcacctgaggtcaggagttccagatcagcctggccaacgtggtgaaaccccgtctctactaaaaatacaaaattggccaggcgcagtggcgggcacctgtagtcccacctactcaggaggcataggcaggagaatcccttgaatccgggaggcggaggttgcaatgagctgagatcatgccattgcattgcagcctgggcaacaagagagaaaccccatttaaaaaaaaaaaaagaggactgagggctttatttttaaattatgaaacattgctttattctttataacaataataaatgtgtgtttttgtgtcatcttctaccttagatacttccttcatgttcactggctcacttaatgtcatacaactctttgagattggtataatctccatgttatagatggggaaactgaggctcagggaaattttgtatgagggctgctgtctcttaactagtaatgttaagatacatgtcttagatcaagatcttcaaactaaaagttccatacacttttcattatgtcacatttataatcattcatccttaagctatatttttatcaaaatgaaaagtactaggaaggaatggcccttttgaagttacatattttgtaaaagcagatcatcattacttaggatttttttggcttcacctgaaacatgaaagcaaatattgattagacatgaggaagttcagaactagaagcaagtttggattatgaaggaaaattatggctccacagattttatctgttactgaaatgagtttacatggggaactcatatttctggttcactgaggccttgacagccaatttatttggatgcctttccatggaagtacgttgcatgggaattcagctgtgtagatgagaggggaaaactaaccactcagccacaccatagcaagcatactcagtggttatagggtaccatctctgggagatttaaaaaactgaatcgcaaactcattatattgtatacattaatatgtgcagtttttgtatatcaatgatacttaataaagctgtttaaaaaaaaaaaacaacaaaagcaaaacaaaacaaaagttatttagaacccagaaccttactttgcacaggggtaaggtgtggaactccacgggcattagaaactaaccttgaaattatatctttattaaacattcccattgcaactattatttcaagtctctcccacctgtaagaaaaatcccagctcttagagagactgcacaaaagagtaaactttctccagagttttgtttcctttttccctcacatccacactgatcttaccccataatgaacttggctctgaaaaaagccccatgtgctgccagctggagctgcggcaatcactccagaaagccaagtgcctttctaataaatagggccttactatcaacatgtcatttattatgttaagtaaacactactttgacttaagtgttgttacaaaaagtattctcttaaagctccttaggaaaagccccggcctgacctaaactaaggaaagcatgggctaggcatgaatgtttgaccactcatagcatttaaatatgcatgcagatttgagctctgaaaatgccctctgttctaacctattagaaatatttctaaaatgtgtcagtagctaggggctgcccctcccttcacaactattgtgcaaggagagggaaagggcatttgttaggcacctctattatctatccactcagttgcacttaaaggctgttctttcagtctctctggctgagctcccaccaggcgagaagccagtaagtgggatcaagccacgtgccccctctgatgatctgccttagctgattgagtagtcctaaatcaaccagaggaaatgacagtctgtcagaacaaaaggcatgtatgttatgagcccgaagtcactgtggaggcctcaaaagacaccaattttgagcagaatattttggattctctctctgtgagacctgtagcaacagagacctgcactggcatttggtgtttccattccagttgtagcactgggatagcctttgacctttctttcaaagtaccttatcacaaaaaaaaaaaaaaaaaaataggcttaattaagtcttcccacttgagaggaaccctttcccttatcactgagcttggccttattcaaaaacatacttagtcctcactggaaattctgacccaaatcacccaggattggttgggcggtccactatgctaagccttggcaggtcacctccgtagtggccctctcagggacaccttggaactttggatgaggttcccaaactctggagagtagggaggggaacacatgccactttagccacaaagtaattttatgaatctggggcagctggtgagttccatggactacttgcctattgtgcaaccatcttcctgttagattagggtaatgcctctggcaacaacagagcctgtagactttcaagcaccagatctttggctgtgagggtgtgccaaagatctggtgctaaaatgagatccagcatgcccctcctcttaacacaacatttctttttccagctagtaattatttgtcctaagcattatttattcttaaaatacacagtgcatgtttagaggcaaatggaataggtgtagttaacagactagtaaaaagtaaattaatgaaaatgaagaatgatattttcatgttgtcccaaattggacactcctatttcctggagaagccgtgtataataagaatgaaaatttacacttcaatttctgaagaaatatttattcacctattggagtagttttgattttagcttctgcagatgtttactttattttccattactggcatggaacaaatgaagaccaagcataacaagagaaacatatcctaaggcccagaactgctcaataattttttaaaatcctcttttccatttagtgatcaacagtacgtaccacaaaaactagtcctctttctgtcttggatcaaattatgcttggttatgggacatggacatattccagttaatacaattaaagaatcaagctgcaatggaataatgtgattgaataccttaatcatggctatttcccaaaggagggttttctattgaaaatattttcatagtaaacgcgcaagaaaaattagagagctttttgttttgaatcaaaggtaatttcaatcccgatttgaaaatggagatttgcaaatatctttggcactattaattgaagtgtgaacattatttacttgatagactctttgatttacttattccaatttttaatccatttatttgtttgcttcattacagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggtcagtgaattctaaaaaagaactgctaacagtatgttattgcctagttacaatatttaggcccttagttaataataatatttcttctctattaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagcttttttttttttttttttttttttgagacggagtttcactcttgtcacccaggctggagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgacta

SEQ ID NO: 16041 - DNA, 87644 bp, Human
ttaatctatggttcagagtcagtgacattgcctctctgaagcaggttttccaaacgaaaacgacaatgaaagccccaattcataagactgcaaaatgtcttcatttatcttggtgaactgggaggaggaggggacctgaggatagagacagtatatacgtaaatgtaagaagcacttttgagctttctatattgtacacgatggggaaaaagcacgttgttcagggatctctggctcattgtataagatggggtagacaataccatgtaattctttattcgaattgctttgtcttgctgcatggctttgtcatcagctgattttgcaattaccttaacaagcaaaggaaatgccagtcaagttcagcatctgggacctcctcaccattgcaacatgtcaggcctcaggcaggagacaaaaatgcccaaggctgagtgtgaagcccaggtaagaagtgagacaatggctttgagcctggggtgtaagcatgccttgttcccaaggccagtatttacatgtggggtcacttccacctttggtacagttaatcaggcgctgattacgttccatggcatcatcctgacttcaggactttgtaggaaagctgaggcaggacactgctcaagtgcatttgacagtaagatgctttgtgcagccagatgttaattccacttgcccttacgcttgcttacgctacaccgtaagcggggctgacccttatggagctgggcttttcttcgcccggagactcttgtcagataaggcttagaactccgccaaccacttaggcttttaggcaaaacgcgatgcaacccttcttagaaggcgggtcactgctctgcaccagctgccagccagagagacaacaaataaaaatggaagatccttctccgtgagaaaacaggcctcggactcaaagcagggggcctgaggggaaggtgagcaaagaaaggcaaggcgagggcgctgcttcaagaagccgggttcattcaaaccccgaggacagcaaaccccgcctccccacgccgccgcccgctcaatcgccgagcgctccgggtgtgagctcgccccgcggggagcggcttggagccgaggaggcggcggcagaggtggtttgggcagccccgcgcggcggataggcccaggcaaacaacacccattccccctcctcctcgctcagttcaactcccactcggccccggccacgccctgccgccaccgccccctcgggcagctttccgctcggcagccaggcctcggtcgggggcgggagagaggcggtgcctcgaagaaggcaccgcgaccgccggaaactacgagtaccgacagccttcgcggtagtgccccaccccctttctcccaccactcagcgcgcgtcaccctgggctcagccaatggagacagagccagggaaaaagggcgcccgggtccggatgcgcctcaggaaagccatgctccctgcgcgggggcagcgggcagttcacccagcgcgccgacctgttggtggtccgcgcgcgcccacgtccgccgctctcgcttgcctggatcaagggccctacttttttctttagtggcaattggagggattgctggagggggtttttgagtggagggcgctgggaaatgagtagggggcgggatatcctgagacaacaagtttggctgtatggagggcctaccggcagcgctcctgagctagaacgccgagagaaagagcgccagaggagccagggaggaggagaagagctgctaaaggaataaccccgagaaagggggtggagaggaggcggccccagcgccccggcccccggcaggtcggcggccaatccgctgggggaaggggtggagagtcggaggctccggcggagagaggccgaggggggtggggagtcggccaggctcgcaccgccctggccccgcccccgacccgcgccgccgcccgcgccgcgcgccgccgctgtcaatcaagggcgagtcagccgggctcgggcggagagaggagctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcggtacgtattctccacccccctcagtctccttcgccgcctccctctctccctccctccccagaccctgctcggttctcccccctcccccggggccgctgagatgctttaaggggaggaggagagggcgggagggaatcggggagggaaggagggttgtgttttgtcttaatgtctgagagagaacaacctccttctgggtgttgctctggagccgatgggtcgggtttcaaaccacgttttgtgatatccccctcctcccttccctccttctcccccaccccctgccggtgtgcgtggatcgcgggtttatggagattaatgttcggggggaggggggagaagaggagaggaagaagacgaataataataatcctaataacctgttgtcgtgtgtgtgtggtgggggggtttgttgcagatcagaagaaggaggaggaggaggaggcggcagcggcagcggcgatggctacagaaggagggaaaacctctgagccagagaataacaataaaaaacccaaaacctcaggctcccaggtaaaagcaaacaaattaaaaaaattcatcacgacacattaggagagagagggagttatgccctttgaatgtccagaagtaacagaataaaatgtttatccactcaaagcatctttctgagagtgtggaacttaaattgtaaattcatcaagttttcacctctttgagggtataacgctgtttaaaattacatcaggaattcagactataagaaaacggtgtgtgtgttgccaagggcattttgagtttaggaacataacactttacaaagttgtaaagaaatttccttttatttaaacttgatattataggacttgcttccttattcatatagttcttatctacttttgttcgtatttctttttgatttctgctgcttcctaaattgttatgtagagctgtcaaaataagtaaccccctggcaactactggcctccactaaatccgcccactttttttcccccccctctcctttaccgtcccattttgggtaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtaagttctgacatctttttaagtaccttttaaatagtttttcataacaattattgcttttctctcctaattctaaggtttgacgtagacctctgaagtaaacacacaatcataaggaaccagaaatagcaatattatactaacaaacatagctctgtagtaatcaatgtgacatgttcacttttgtagattttataataatgtgttaaatttgttagttttttaaaaagtattgttttatgggacagagctttctgattagaatcataattgccttctgtaatttagtggtcttatttgagtacattccagctcttcagaaagaaccctagtcgaaatgatatttatctcttctttgagggaaagtagttttaaactgaattggtatatataattgtgagtctgttgaacttttaattctgtggtgtaataaggctaacttttttttagtggaagttatttctcaagcttcagcatcttgtcgcccatgcttttgtgttttattacactggttttaaactagatactgatgcagttgagagataattttaagttgtaaattgtttggttaacttttatgcctacttttatgctactatcaggatttgaatgaataatccttcatttataaaattatatttaattaaatcatggtcattgtgtgatttgtagatgtttaatgtaaggttggtggaaagcaatgaaaaatgttgacagtaaaatgtcactaatttgaattaattgtggtaaagttatttttaaacctattgtaaaagcagttgttatttgttatgcatataaatagttccttctgaagtacttgggaagtagttttaatcttttttggaccagtcttattgtacctaataacttttgttttctagtaattaaacccttttcattgattctgatttgatgaaaacctcgttgtgttttagtgcctttgatacttccagaccttgttagttaaatatttctattttgataatgtgggataaataagtttatcacttttgaatgatctttcttgaaacaagttgcagaaaaattacgctagggttcttcttttatggttaatacctgaagtaggcatatatatgtaaaattgtaaattgccagataaagccttctgattcaggagaaccgagattatattttttatctagataccagtgcttctaggccagcgctatccagcagaactgtctgtgatgttggaaatgtttatgttttctatctacctagctacatgtggctgttaagcagttaaatgtgtgtggggcaactgaggaactgaattttaaattttatttaattttaatttaagtagccacatgtggctagtggcaaggacagtcatctagttagtgtttccattgcggtactttttctcctaaaactattacagcgtaattacataaatgtttctctggattacaatccttaacttgctttatttctactcctttgctaaaaactttgacaataattgtagtatttcagaaaagtgtttttggtgggttgaatgacagtttgcattgtcaaagcagaagttacttcacttccatttcatcttgcttattaagcattagtgagttgtgattaattaagagaattaacttataatttaggttagaagtaatcaatttttctgctctctagttgataacttttgcaatccagaggtttttcccttagccattgtgagggtaaagaaatgttttggccaaccaaacttagattaacttgaatggtgcattaaaataaacacaggatccagtttttggtactgtaagttttgaattgtgggggtcaagggatttgcctttcaaacaaactttccaggtgattgtaaaactcactgaagtggctgggtgtggtggctcatccctgtaatcccaacactttgggaggccagggtgggaggattgcttgagcccactagttcaagaccagcctgggcaacatagggagaccccgtctctacaaaaaatttaaaaaaattagctgggtgtggtggcacacctgtggtctcagcgtcttgggaggctgaagtaggaggatcgcttgtacccgggggatccaggctgcggtgagctgtgattgcctcactgcactcccacctgagtgacagagcgagaccctctctcaaacaaacaaactcactgaagtttgagaatcaagtgtctggtcatcagcagtgaaccagaagacagaatatggaagcaagtgggggtgttgagctagttcgtttgtgcctcagagaacagattttggtggcaactacaactttttagtttttatttcacaagtgtgtattgagatggctactgtatgctgaacactgccaataggtgtggttattccttcattttcagggataattttttcacttaaaggatttacatgatttgggtggttctgttttaagtagaggaggaaatttgaactctacatagttggattcttttccccctgaaaccaaagatttaaaattttgtcgatgttgtttatgttctaataaatatgctcaatccttttaaaaagacagcagtctgacaaagaccagaagtgtaccttgcttgatgtctgcaagtcaatacagttaatctaggcctagtttgcagattttaccccattgcctagcttagtaggtgcttgacaaatgctctttgaactaaggtataaaagatgatggagaaaatagcactttgtaattaggagtaatgccttggaatggttttaatgaagctaatgaaacaactttgttttcattaatttcttttggctttgcatttgtaagacactaagagtgggccgggtgcagtggcacacgcctgtaatcccagtactttgggaggtcaaggcaggtggatcacctgaggttgggagttcgagaccagcctgaccaacatggagaaaccctgtctctactaaaaatacagaattagctgggcgtggtggcacatgcccgtagtcccagctactcaggaggctgaggcaggagaatcacttgaacccaggaggtggaggttgttgcagtgagccgagatcgcgccattgcacttcagcctgggcaacaagaacgaaactccatctcaaaaaaaaaagaaagaaaaaaaagacacaaagagtgagacaccaggaacttttctgtcttgacaagggggagaaggagcaataagtacccatatcgcccttttataaatgagccctgaaagttcagatcttttactttgtgtccccattcatctgtaagtactttcttggtcggttcatgttgttccccaggagaatggtattgtttaatttgtggggaaaattttgctcgaaatttttatgagaagccttgaaaaattagtagctttgacggaatgtaattgctagctcaaggacaatgagctaaaactctccaccatccactattctcattttactcttcaggagattaagggaagtctagatgacatgaacagaaaaaagtaaaatcatacaaggtaaatctaatgaaaccagtacttgaagctggggagcttcatacttcgttttatgaaatgagaatgttagcaacaacctagggggatcctcttcccattaacaacgtgttcagtataatgtgtttctgtgctttggtctcagctgtaaatcctgaccttcatgctaagcattagttagaattgtagtaggaactaaatatgtgtatgctctgcatactttttgttttgttattgggattctaaatttaacttaaaatttttttacttttacttttaaaaaaaatagatttagggggtacaagtgcggttgtgttacatggatatattgcatagtggagaagtctgggattttagtgtacccatcaccgaaatagtgaaccttgtacccaacaggtatttttttccaccctcaccctgccctccaccttttgtagtccgcagtgtctgttattccacctgtatgtccatgtgtaatcattttttttttttttttagctcccacttgtaagtgtgaacgtgctgagtttgacttcaaaggaaaagcagaaaccttactttaagctcaaagacaactaattgtacctctggcttaagctcctttattttaactaagtgaggagagttaactacctgttttcacaatgtcttctactagtcaaagagccctaaataaagtgaatttcaggtgttacatttccttaaagactttagagctatgtaggaacaattgatagctaaatctgtaattaacttggagtggtccacaatgtgacttatttttggcagtaatcatcatatgtagtaacagagatcatactgtaggccttttgattgatgaatgaatatttctttgtcaattttagtggaaattaacaatattatgctggttctcccacagaggaagttcagacttaataataagatactgctgacccttcaagaacttgactctcttacctaatttctttacttctccaaggaattaaaatatgaaacctggggatatagtatgaaaccagaaatgggaggaccaattcttcattattggtaaaaataggtaccaaagaaaataattaaaatttatatttaattttaaaactgaattcaatccagtaaaattaacttcttacactgatctttttttccagagctactaaaggtggaaaattggcttgaggtttaatgcaaatatggctttcctttgccatatatgttttattaatttggatttccctaatgggcatctgtatatatacatactcatgtactcctgtgtttggctagtcttttttcagaggagtcagatttactccagtaatcttatttctttaaaatcttctaatactgtttgttatagattggaattcattattagaaacttaaatcttgtattcaatacgaatgacttaggttctgaactaccaagctggctttacctattgaatgattttttcatggaagatgaaaagtactcaaagtagagccacattaattttgtaaaagggcattttttttttttttaagaaggacttcaggatagattagcaaaggaaaatagagttttttgtttgtttgcatttgagatggagtctcgttctgtcgcccaggctggagtgcagtggcacgatatctgttccaacctccacctcctgggttcaagtgattctccggcctcagctccccaagtagcagggactacaggcacatgtcaccacgcctggctaatttttgtatttttagtagaggtggagttttgccatgttggccaggctggtctcgaactcttgacctcaggtgatctccccacctcagcctcccaaagtgctgggattacaggcatgaggcactgtgtctggctgaaaatagagttttaatcatctgcttttcaaattctgaatcggaatatataatgagtaatacttagggaatattggggcaggcatgaaagcaggttgaggatattggggcaggcatgaaagcactcacagctctaaatttacttaatcaagaaggaagatagggaatggtgctacgcatagatcttgtagaaataacagacttacaaaatgatagaattgtaggtggaaagaatcttggagattatggctcagcagttgtaaccttttgatactgctgctaaagtctatttataaaggcattttgtgtttttactgtttgaagtgaaagcagaaatatgggtcgaagattctgcactgctacattaagtcaatccttacacagtaaggattgacagtaacgggggaacctggcctaatatcagagtgtacacatatatgtgctcttctgtacttttctgatgcggatttgagttaagattggctgttaagattggatgttcataatgcttgtcattttgctacctagtgaaggagcaaattgtggcaaaggaaacctgttgaaccacaaattgcttatttaagtgtgtggtgagatgagggcttaatgaaattgtagttactaaggtaacttaaaaataaatgagcctctttctcccaccttctttccttagccctattttagaaatgaagaaattgaagcccagaaaggttaaatgaccctcttatatttgatggcaaagtgagggctagaatcttgacttctcctccagttgtctttctactgcatttttgggtttgctttttggaagtcaagatgataaaaatggatgttatcctagggtcagaaggaactttcagattcagtttcaggctagtatcaataacttaaaatttatgctgcatggtaaaaagtgtcagaagatttggcatgaataacacctcaattttttaaaacattcttaacttcagacaaatgagcttgataaccgtccttagcaaagtccttgaatgaattattgagtagttggctcttgagcattttaaaaaagaaccgaggaatcactgggagccactatgggttcactaagaaactaggttcatatcttctttctttaggatttccagatgagtatccaaaggaaataatgttaacataatttatcttgattttagtattgatagttgtggcctctttgaaggctcatagctggttgcacaattgaatgaaaagtggtaattattattcacctccttacgaggtctcacactatggcatggggttctaattttgatgtagtttgacatttttttttcaaataccaggttgaaggatggctgaatttactgaattcaaatatgagacaaagctgggaggtggtgcttatatgatagaactgagattcagagtgatcttaataggctgaaatggtgggccagaattagtaagatacatttaacaggtaagatcctctccttaagatggagggaattacatacctacaaggtaaaaaacctggcttggcaggaggacctgtgaaaatgatttgggatgtattggcttaaaatgaactgagagtagaataaagcttctgtaccttgtgcttgtgagatacttctgcaatattgtgcgcagtaccgggtggcacattttaaatgggacattgacagactcgcaaatgtatcaagaaggattcccagaatgaagaatgtggaaaacatttcgtactagcaataatcaaagaacggagttttatctttaaaagaaaacaagaaattgtgacagctgtctttagatatatgaggggctttttttttttttctaacgtagttctataattttgtttggccctggaaaaacatatgtatatgcacacacaaagacagactagagttacacaacagtggaatggtttgtttcattaagtagtgatcattcattaaagattggatgttcatcggtcaaagattttgtagactgcagaagaatttcttgtaccatatagaaaatttgcttaaactataaactctgagtcttcttctaattctaaaatttaaggtctatgaaattagaatatatattttatttcgttctgggtacttccatccagcacatggccagagttctctgtaagtcttaaacttacatgattaagtctttagggatttttgtgagggagattgtgggtgatatttaccattttttttcatagaggctgtatgagggtgaattctattaagcaataaatgtagcactgtaattcataaattaatatatttctgttcattcttaaatttactgtgtacttaggtgctatttttctatgtcgtttcctcttttatttggtgaataccaaaacgttagtattttaaacatatgctttagttctgacactgaatttgtagttacgatatgttatctcggtatagtagtctcctcttatctgtgggttctgttacctgtggtcaactatggtccaaaaatgttaaatggaatattctagaaaaaaacaatttacaagttttaaattacatgcctttctgagtagtgtggtgaaatctcagtctgtccagggtgaatgggaatcttctctttgtccagttataccctctgtatatgctaacaagtcacttagtaaccttctcaactgctgtggtatcacagtgtgttcaagtatttttactttacatatttatggcctgaaagtgcaaaagtagtaatgctggcaatttggatatatccaagataagccaaatatatgccaaagagaagttgttatctcatactttgtgtaatttataaattaaactttatcacaggtatgtatgtatgtatgtatgaaaaaacaatatgtatagggttcaggccatggtttcagggatccagtgggggtcttggaacatattcccccctctgataaggggggactgctctagctctttaaccatagttgtgtttctgatactgtcactttagtgtgaacaatgtgattactttttcttgagtggaaattagagaacaattggaaaatctaggatcctaaaagagcccaaattgtgggaagcactcacagctgtaaatttgtcagttttccctacagagcaagcaaatctgtatgcctttttttttaagttatttatgctgatcttttatttgtataaatttgttgggtgcaagtacaattttgttacatcgatatgttgtatagtggcgaaggcagggcttttagtgtgtgcatcactgcaggaatgtacactgtacccattaagtaatttctcattccctactcccctcacaccctcctttcttttctttcctttttttttttttccatgaacagtcctgctgcagtagtccctttcttcatggctcagaatatctggtacaaaggtgttttttgaaaatgtttgaggccaagtgcaatggctcatcctggaatctcagtactttggaaggctgagggaggaggatcacgtgagcccaggagcttgagaccagcctgggcaacatagtgagactgtacctctacgaaaaaaggaaaaagtaaaaaatcagctggatgtggtggcccatgtttgtagtcccagccactcaggtggctgaggcaggaggattgcttgaactcaagagttctgtttaaggttatagtaagctatgattgtcactgcactccagtctgggtgagagagtgagaccttgtctcttaaaaatatgtctctctgtatgtaaaatgtttaagacgcaagaatctttcgaatagaaaaagtgataattcagatttatgaagcttctcttttcctcagggatgataataaagttaaggaggtaagaaatacctgtgcttgatcagaggtatggttcttatagtaggtttattattcgtgcagaccacatgtacttagaggcttcgtagagcacaacactaagaattaaaactcacatttttgcttgggtactccccgcccccaccaattagttgtaccactctgggcaaacatcataattgtagttccattcctttttttcatttgcaaaatagtgatattagttcctaccttctttacctcatagagtctcaaagattaggtaagttaatatgtatgaaaaggctttgaataatgtaaagaaaactgtatgcaggaggtggtaacttggtgacatctctacgtagtgacacccactagaagaatgtgaagtagtaaagtgggggaatgagatattttaggtatggatattagcttgagttatatgtcagaggtaaacgagaaatttgtataagaggaatttcagaaagctttggtaaagtgcaagcaagggtgaggtgaggtgtatggagagaggtgtattaacaggtggaaaagaagtggtgtggccaggcgtggtggttcacacctgtaatcccagcactttgggaggccgaggcaggcagatcacttgagctcaggagtttgagaccagcttgggaaacatggtgaaacctgtctctactaaaaatacaaaaattagctgggcatagtggtgcatgcctgtagtcccatctactctgggaggccgaggtgggagaattgcatgagcctgaaagtcgaaggttgcagtgagctgagatcgtgccactgcacttcagtctgggcaacagaacgggaccctgtctcaaaacaacaacaacaacaacaacaacaacaacaacaacagcagcaaacaggtggtgtatttcagtatagtaagaactaaatgtctgctgtctgattaacccttgttaggttctgaagatactaactaaacctgtcttaaaatgatgcttgtgttcaggagaaagatttacatacatgaaaccattatatggcagctgcaactacatatgagagtttatacgtaagtactgggttttgaggcatggaaaacaagtgtgagagctcagaagtcagtgaggttagtggggagtaaacaagaaaggctttttctggtggagataggacttgaaataggccttaaagattggtttggaaagtggacatttgagactttgggggtgacaggtgaagagtgaggatggcttgagtcaagctgctaaacttggaatgagcttgatggggaccaaagattggaaaagcacaaagctatcatgtggaagcttttaactaacacagggaatgatgggttctcttctgtgtgcttcctagaggcttagtggtctcacagagtagctcagggtttgccaaccaaacagccttccactcctgcatcagccacacaagtgtgttttttgaaccatttcctaacattttgtttcaagaagagattgtgccaaaataataataataaataaatttgaaaaacttgaatctagtggattggagatattgagtaaaaatatttgcaatgcaaatgatacttatgagagtgtttctttgtagataaaagtgtagaaaagttagaaagcaggagctcagataaaaggatgttgttgcagtaatttagttatgaattcacagtggtccctagaaaggctgtggtagtgaagtaaatggttactaaatataaaaaacagcttgttgaacttttctaggacctacactggtgacgtgaaagacatggtaagggattaggtaaaaacatcaggttggtttgttcttttcccctgctctgtatcaagcatggtaataggcattgagaaactaaagatgaagtgagacatgttttctgccctcataggatatattatctgttgtgggagacacactgtacttctctgcttctaggacatgctttttacattttatttttatttcattttatgtgtgtgtgtgtttgtgtgtgtgtgtgtgtgtgtgtgtgtgtgtattttttttttttttttttgaaacggagtcttgttctgtcacccaggctggagtgcagtgccacaatctcggctcgctgcagcctctgcctcccaggttcaagtgattctcctccctcagcctcccaagtagctgagattacaggcacccgccaccacgcccagccaatttttgtatttttagcagagaggggagtttcgccatgttggccaggctggtcttgaactcctgacctcaggtgatccacccgcctcagccttcctaaatgctgggattacaggcgtaagccaccacgcctgggcccattttaaatctataaaattaaaacacaccttgtaatcaaaggcatgtcatagtttaattagcagaacttttttctttcttatgatcatttgcatcttagactcaatagtacatgatagatatcatctaatatctatatatgtcatacatatagctaattaaattactttgtggtgtttggtttatacaagctgtgaatgaagtgttaatagaatcccagaagaaggaagaactagttctgcttgtagggttctgggaatgttttcatggaaagggtgataactggagctgagactcaaaggatgactaaaaagtttaccatatcagaaggaagaaaagggccacttcaggttatgttggatttcacatgcaatttttgaaattcaagtagttttttgttttgttttgtttttgagacggagtcccactctgtcgcctaggctagagtgcagtggcacgatcttggctcactgcagcctctgccttccgggttcaagtgattctcctgcctcagcctcctgagtagctgagattacaggcgcctgccatcacacccagctaatttttctatttttagtagagatggggtttcaccaggttggccaggctgttcttgaactcctgacctcaggtgatccacccaccttggcctcccaaagtgctgggattacaggtttaagccaccatgcctggctcaattagtattttgtaaacattacaaaattgagaattagctcaaggagtgttcatataaaagttgaattgtgagcctcatgtgagtagagtctgtgttatatatgtaagtatgtgtattaatttataattctattttttctcacaccttgatgagcattgcttagtatctgtcattctgatactgaaccagaagaaaggacacaggtggagaactttgatttcataggagaatgggatggacagatccttggaatagactcaagatatatattaaaggagtgagagagtttacgatcgtaaaaggaaaagtgatgagtaaacggaaataaagggaatttaaatctgattgcttcatatgttttggtagacagttgaaggtaagaatcttaccagttaggggatactttgagaagaaattgaaggtatgtaaaatttccaggttgattctgtccctctgatattattatgtagatgccttttaatgtggccagtcagaaggggtttagtacagttctgtaataatgagtcaagtcaccatagctttttgttcacagaagcggagctgcttttgcacaggcgtataggaacgagatagtgatctgtgctttggtaagtgggtatctgtgcctggtgtggggctgggaaaggggtggaaaatccttgctctggtctagttggggatatctatgccagggagttgaaggagaagagagaagaggaagagactaggtgaatatgatgacaagtactaacgggatttatataagagaaagaaatacttaaaagtggtttgtgaattctgcaggtttttccaaatatttaaatctacatatgaaccaggttgagacaaatctttgacagatgtcataaatactacaaactataacatgcttgttgaagcaaactttattatttctgattttgttagtataggtttttaaagttaaagcgtatttttattttcagaatttctctcacctgttgttgttattggtaggttgtcactgcctttactgattttaattatagggcaagtaaatggttttaatatccccttgttagactttcatctattacctgtactccctactggcagactgcatccatgaattcagtcagcaagtaaatactcagcatctgtattgtgcggcttgatatgttccttagatgattgaataacatgggactgaactcctgcttccataatattccagtggggagagaaattatgcagttttctttaatgaatgaaacaagaagtaaaagggtacttctttgaaccttatgtttgttttatattttggctgacatttactgcacgtttatagtataccagataatgcatgcagcacttgatctattaacttatttaatcttcagaatacactgtaaggtaagtattgctgacatctctcctttcaggtataaaaactgaggcctatagaggttaaataatttgctcatggccacatagtgaatgatggaaccagagtctaaacgtacttgtactattaccacttactgccctgaattgtgtactctctgtatactgtagtgtttgttttctgtgatcatttatggactcagtttattgtttgtctcttatatgccactgtttaagcactttatgtgtattaactgtttatttttcacaatcctatgaagaaggtggtggtggtgacctcaaattatagaacaggaaaccaaggctatcagaggttaatttacttggccaagatcatatagccagtaagttagggtgctagtaagtaaaaattctttataaaacaagtccgggtgaataggactgtaatctccctttacagctaaccactactactttaagtattttattgtaattactgtaatatgctcaataagaaacagattcctagatctttagctgagtgctccactccttgtgttcttttgggggtttgaggtacatatgccacaaagggaattagaaagaaagtttttattactttgatggactgtgttgattgggaatttgaggctagtaataacatctccctgactaaatatttgtgtatcacaaactaattttgaataaatgaaaaaacacagattctaagaatataagcgcaataagagtatgtattcttttttccctttcttttattttttgaagaaaagggcccaaaagagggagtcttgtattttgttttcattaatagttgtaaaaccccaaaaagaatataccttgtaaggcttaaatttcatgacttgcttcttgatgaggatgtgagatgtcattagataggaatttatgcccattttctgaaggaaataacattaagaaaacccagagaccctaagaattagtatatgtgtagaatttatgttctttagctaatcctgcatgtaatttttatgtagcattagcttagttgacagggttggtcctgcaactttattgttttctgctggataaataatatttagtatctgccattgtatacatcgcatattgttctaggtgctggggaaacaaaacagacatgttctttattcatggagactatactttgttctgggtgagttttgttttatcttgatcttagattattgctgtttttagtagatgagaaaatcaaggcttagaaagtttaaataatttgcctaaggttacagaattgatacatggcgggtgttgagaaaagaacccagagtttgtgtggcttcaaaattttttctgctgtttcatcacaaatccttgaggccaaggaaatcatggtttccctgaaaagttttaaaaggattttctctctttttttagtaacaagctaccaaagagaattgaagaccaatttacattttgcaagagtttgatacatcagagtgcattcacaatatacgaaaatagaatagttaatttagtccgtatttccaaaacatatgatcgagttcattttgtgtatcttatgtgtatgtgtgtgtgtgtgtgtgtgtgtgtgtgtgtgtgtgtgtgtgcacgcatatgtaggtagatatatatgtgtgtgtgtgtgtgtggtgtgtgcatacttagtgtatatgtttactcattataaacacattcagggaaaacttaaagggattatattctatacctattcatcaccttccttgttctcccgcaccttcactataattaaggataccagctcatatggggatatttctaaaaattagcccacctcttcatactcctatccttaccctaagccacaaagaaaacgtgattgttgaaatcaaagtacttagacagttttcagcactttaaaaatgattctttggcagctgtctgaactggtagtggtaactatgtataattttcaaactggaaagcaaacatgtttcattccataagtggtttgtgatgagcagagtgtaactatgacatatttaaaaaaaaaaagagctctgtgctaggtagcagtttgtctctgccattaaacaattttgtaacctttgggaatggaggtcttggtttttttcttttgtacagtgaatgtatgtgtgtgtagtgtgtttcgtaaaatgaaatacttgaggtactttcatttagtgttaggattctataggtactttcatttagtgttagaattctataaagcacaaatatgtaggtactaaatcagcttaattttatttcactgagccagtgggaaagctcaggaaaaatactatttactaatattgctagttttaaaatcaaattgatttctttttaaactgtgaatggagcatgttcatatacgggtttgtttgttttgacaaattcttttttttttttctttccccaagcctgggttccaaaaaatgttttgacagattcttgaagccaaatctaatattgactctaacgctattctccattaaagaagtttagtctctaggtttaagtcatttttaggattcacagaatgttttagaatatggttcattcactagcgcccttgtgactagccacatgtccagccttcagcaacagcaaagatgggggccaggtccctaaacccttgggcatgtagattgccatctgggacctcatctgactattcagaatgcccttgccagcggatacagaccttgaagatgcctagttagaaaccagctgccctttaaagccatagtgtgtgattgcttaggcctgagattctctagcttacaagcagtataaccctgtaatatagagctcttctgttcaatattacctcctaacctttccaaaacccaatactttataccaaagattttaccatagtccttgctgccttcttgccatctcactttgggtaaccatcctaacctacctaaccattttattaccttagcaccttatgacttggacttctggttagtgtgccccagggacagtagttgtaaaatctagaaatttagtagaagagttagatggatctttgtatttcagtttcaaaggagacaactttctaatattctagaaggtgaagaatatcataactgatttatagtccaagaggtctcattagaacagtggaaactatttgctggagctgttgaattttctgttagagtattaaggcagggagaataccattttcagcctcacaactactggcatgcatagagtttaatgttggattctagctgctgtcttgggaagaaagtactttttttgagacagagtcttgctctgtggtccaggctggaatgcagtggcgtgatctcagctcactgcaacctccacctcccaggttcaagcgattctcttgtgtcagcctcccaagtagctgggactgcaggcatgtgctaccacacccggctaatttttgtattgttactagagatggggtttcaccatcttggctagcctgggcttgaattcctgacctcaagtgatcctctcgcttcggcctcccaaagtgctgggattacaggcatgaaccactgtgcctggcctggaagaaagtacttctttacataataggattgcattaaagtcaaaggatgcatttacagaatgaccccccgtgaagaattttttgaattaaataacaataaaatacaggaatttaaaatataatatttgcttggatttcattttgtaggttaatctaaattttttgaaccactttaacaaatatttagttacccatgattactgagaaataaaagagctgttttggaagtaatgtcttagaaagtttagttgaggtctagctcactactattatacagaaattttttaaaaaagaaaattgtgctttctagtaccactggcaagtactcttagtaaagaatttgtgtttcattaattattaagaatcctactgttttttaatgtaatattaggccattcttattaaagatcattgagcagtcaatcctcagtggttaggaatagctatttgtttctacatgataattatatagatttaacttaaaatgaaggtgacattgtggtgctggtgaaaatagaaatggacaagaatgagacgtgggttcaattccctgttcttttagttactgtctgtgatgtgggaatctcctttagctttcacaagcctcagtaataaacacctataaaatgaagatagcctgcctactagacaggatttttctgaggattaaatggagtaatatgtgtgacaatgtattgtaaatgccagagtactgataggtgtaaagtattattacatcgttttgtttacctttactcttttcttctaaattattatgtgtgtatgtttaacattttacagtcttattttctattacattgtcgtttttacatctgtaacatataacaatgctggtatatagtgcatgttcagtaaatagccaatggaaatgagactcctctattacttggcttgattgagtatattaacccttttattttatgtattatgctttgacatctgaggtctgctgactttggaaggactacctcttccggggttaaccatttcctaaagacaattctcctgcaaatgcttttttcaaaacacacaccaaccaatccagagcctgcatcctaaccacctcctatattaggttctcatactttagaccacctgctctaatcaccccccagggcgaggtaccaaacaactagggacagcccctgtgccccacggtcttctaaagttattcaaactagccaaccctaagcctgtttaccctgctttgcctgttccttgtggtggaaaccacaataaaggatctcgccaacagtttctactcctgcttttgtctcctaactgacccgtatgctccacatcctatggcaggttgtgccgcctcctcttgggaactgtaacaaacttatcttttcagtggcaatcaattttctattaatacactatcttttaaaactttgggctactgattttttttcaatccttgtggcaaagaatcttattattaagaaagtattaaatactgttagatttaaagctttttttggaagtaacttgaagagattcagaatggtactgaaatacatatgcgtgtataggtaaatatgtacatatgtttaagtatacgtgtgtgtatatatacatgcatatgtataatgtatgtgtataaaaaaactttaaacttgatttggaagatgacaaattctcatctataagctccctttacagatcatctttggttctgctctctttgtttataaatggaaaaactaaggcccagtgtgaatatatggtttacccaaatcacacctttagttattggcaaaccaggataacctaggtctgattccttcaggcttaagtagacattcaaatgtaagcattttttattgggaaaaaaattataggcaagtcttttcttcttgcctttctcaagggaataaggtattaattttgttttctcctatcccaagtggcagtggttcggttgctaggtaattgttccaattgatacagtttctccatctagcaaaactaaaatttaaaatttaatatagttatttatattttattttataaaactatttttaataatagatcccagagacttattttatgtcccacatctacccatttgtatctcaacttgtttttatgtttttttcttactttgttttatttggcttttgctgttagatttgtaagcttggaaacttgcagcagcctttaagccaggtacttcattgtaaagattttccaggatttctgtttttatggtaaatttgactgggtcaaatagtcatattgtgaacagagccaacatgagaaattgctgactagggatatcaataatttatagtgaaacaaaaatgatttaggaaatttggtggattttttaaagtgatttttgtttttttaattttagggggcttttttggtgggcatagtaatattgaggtaaatatacatgctttggggtgcaataggtttctgttatattctctttcattgggccttcatataagtattggatccagtttggtgttccacattttaaggaagagggagatgaagcctgagaagtggcttaaaaatggtcctccatacagccacttgtgatagttctccatttcctcagaagattgaacaaattgtgatataattatggtggaagaagaaatttaggttaaggaaatacattcttaataatgcaagtgcttaaacaggatataacttagtaaggaagttaactctctgcccaggaaaatctttcatatactacatactagcttgttactagaattgcatgtcattttgttagtggtcgtgaatccatacaggtctgcagcaacctcagttcttgcctcctcagaagaaagaatttaaccaaggggcataaggcagagggagagactaaggcacgttttagagcaggagtgaaagtttattaaaaagttttagggcaggaatgaaaggaagtaaagtacatggaaatgggccaagcgggcgacatgagagtcaagtgtgtggtttgacctttgacttggggtcttatatgttggtgtgtttctgaggttgtgttacttcttgcatgattcttcccttgggttgggctgtccagatgtgcagtggcctgccagcacttgggaggggctgcacgtgcagtgtgtttgttgaagttttatgcatgctctcttgagctgttttttcccttaccagtctagtgctcatatatcagttaaactctgccgtttgcctcttagtgtgtatgcttgagctcactcgtccaactcctgagatcttatcaggaagctgctgattgccagcttcaggtgtttctagctactgagagactgcctttccctgttgctggctgtgaccaattactatattagagcgacagtttaacaactgcctgaccacctgatattcttggttgcggggttagggggtgctttctgtcctgctcacatctgactacctactgtaacatttcctcccttaagagtccaagaccccagttctttggggaaaatggatggtcagtcttctgtaactgcttcttgctgacagggatgatggtggttgttctgtaggtcttggcctcttgctggctgtcagggcagggtggctctgtgggttgatgaaagctgaattcagccaggtccaagggagacaggggcaggattttgcctctgtcatgtcccactgatgggcagtctaggagtcccctatagaagggtgactcttggatattgagaggatggtattctttactgaggatcatctggagctggatggcctgaaggtgagaggagacaaatcagattattagatttagaagacagaggccaaaaacgacaagtagagatgttaagacaaaataaggggatgaggacagattaaagaattctgagaattctgagactcccaacatgccaggcaggtggctgcagtcatgccagctgtagtcatgccggctgagacctgggtgcgtggggttgctaaccaattccgatacatgcccagaattagaatattgacccagatttttacattacccatcccttttatttcttctgagctgtagccagagatcactggttggttcacaggaatgagcagagttattctaaatggcagaaaaaaacttaataacaactgatgagactaaaatttgataacagtagtaccatagttcttgaaacatgatttttctcttcagttctcatttttattaagaacaaattatgataggactgatttgtttgcaaaataagctttagttctgttatacttggcctaatgagttgcataaagcacagcaagaataattatttgccatataggctccttttaaaattggctttgatggaacttccttccataaggagtctcagataaggctttttaaaaccttaagcccagctatcagttggtgccatcaaatacctgtatgaattggacaaattccccttgtcttgcttggggctcctgggcctgtcaaaagtgacattctttacttgccacaggtcgggaatcctgtacagggactgtgttgacaatgtatgagttcagttttccagaggggcttttcttggctttataagtcaattttgattcttaaaggaaagcatgccattccagtcaaaaccttggtaaaataaccagtttctccaattgtgtcctgttgcaaaagaaaacagattttattgcacttatgcaaataactatattgccattagttaagaatactcacaagtagtttccaaattctgcagaaatctgagagaagtatgttccaaattttgtttataggagtatactttactcattatttttttttttttttttgagacagagtctcactctgtcacccaggctggagtgcagtggcacgatctgagctcactgcagtctccacctccgaggttcaagcgattctcctgcctcagcctccttagtagctgggtctacaggcacctgccaccgcactggctaatttttatatttttagtagagacggtttcaccacattggccaggctggtcttgaactcctgaccttgtgatctgcctgcctgggcctcccaaagagctgggattacaggtgtgagccaccgtgcccgacctactcaattgttaaaagctgtaaatagctcaaaagttttcttggcgttgaaaaacaaagaattagcaatgttttaagcaaaaagtcataaaaggattattttagtcttctattagttcagtccatgcagttaactcctgttctgctttatattcatgaacatttcagctttcatgagagtcctgaaaggtttttttctttatcctatgtcacaatctccagttatcagaaacctgcatttaagcctatcagtaattataaaaccaccttttaaagaggattaaaacaaggtaacaattatctgtggatgataaaaagtcttagggcagccacagccagacacaattgaaaaggaaatttgttagcctctgtggcatgcaataatttaacttaacaattataattattactgataatgtatgcctagtcatatcagaattgtaggagtttcacataattctggaacccataccaataacacacttacacaaatacagcccaaagaaagctggatttcacctttgcattggtgtactattgatgtcaaacccagttcttaataaaaccttatagacaaatctattcaatcttaatcagtttgccctcattttgtaagattgtcatagaccttttataaccctttacaatttttttgttaaagaccagaagaatgctctaagaaaactgtgttatgcttttattccaatgtttaatttatgaatagtctgaatagtacccctttaatgttagctaacgtgttcacacaggatttcttttacaagattaatatttcacacatctgccacgacttgctcaaacctttagctttatcctatctaacttaaaataattctttaactccctaaactaggccaaaaaaatctatattcccatgccttcttatgatattttaccaaaagtacattttactttacttacatgttttacatgtaaaactctttttttcagtagtctcaagtacatgttacatggttaactcttagcagcttttactttggatgaaaacctggtaagtaagaaattctaattatgtactaggtgtggagcctaggacaccagacagaagtgtagataaggtctgactctttccagcatagctagggggcatggctaactctgtgtgtcttcaggccttatgtagctttaaagcagacaagttgtccagttaagagtcatagtagaagtttaggaagcatttagtgggcttaataacctttacaattatataacatttctttataaattcccttttactaactttttttttttttacaacttacacagaccatctacaacatacttggactctctcacttggcttgaacatccctctttttatacaaccattttactttaggacaatagtttaccatacaagatcctttctcatataaaatatcttttctttttaaccttccttaccaaaaatacctctttacctttataacctttgaattagataaaagtcattttccttctattaggaagttatggtttgttgctgtgtgagtcctatgaagggggagcagatgaggttatctatatactgtagaagttatccaccctcaaaagactgcttggttagatttttactaaggcttttcccaatacatgtgggctctctctaaacctctgaggtaggactttccagttgaagttattggttaaagatttaggtagctttctgaagagaaatggggctattagacagatgaattcacaggttgggcacccatctttgaaagtaagtttttgccccaaaagggtgtgaatcttttctttttagggaaggggtgccatacgcccccattacctgacaggatttggaggagagttgatcagagcaggacattagcacagagtaggcagcttttgaacccaaaagggaaatttataatttttacttgccacatctagagtttcccttggctttgtactgttgatggcaacaatgtctgatttggaagccagccagagcagagagccccttcagctcaagagtgtcaggagttgagattttgtcttgggggtgggggcgtgcttcaaccctcaggaatgtcctgttccagtggctgagcttgtggcagaggggtcaagctgtgcagggatttttccctgattatcccattggggaagtttgacttccagtagcctggcttcccacaccacttgcaattaactgaaggagtaggcttttgtagtttttgtccagtttatttttaggccaaacagtattacaaaggaaaactagttttttgttttaaggtttgaaggatcaaacttttcccagttttttgaggatgcatccatggggcatgtcctggggtatggaaacatgattacccatctgtgaagagagatcagaggaggaaaaagaaaaagaaagcgtcccctcttactttcctatatcctgaataggacatcccccattcgtccttagggttccataatgaactggtcttaccatgtactcttaacctttgtagtgtcttgtcacaattacccatttgagaacattggagacaccaatatgaacagggccccccagttcatccttggggttacggaatgaacctgtcttactgtgtacctatcattgtgccttcaaccctgttctaatggtaatctgttagcctggaaccaaccttcatctctgtcttatgggtctcttttgtctgcagtcttgggccagcctatatctttgtcttcataaccttagagtgactctcacttgcagcattttagcaacaaaatgatgatctcttttctcagattcccattttccgtgttctttaagtagatgagaagcctgcttttccagctaactgccacaaggggctggacttccctcccttcaaatatgaccctgaagatcttggtgcatattgggaagggcatggaagtaattcgtgaaatggaggctacaggaggaagtgggaagaagctagaggaatactcatggaaagccttcatatgcttgcaaaaacagcagcccttggatttgagggggcaacatttattggccctcttgacctaaaggaggaacctctggagcacttggggcttggggtgagaactcacaaatggcaaaagaagaattttctctcctcccaaagggttgctaactccaaaaaagcaagtgggtaaggtctttaaagggcctcagagtgaagccctatgcaggcaggcaaactgcttcaaaagacactggaaaacttggccctggggcattaacaggaacaaaaggtgtatggtaagtcataaggagctcgcagagccagggttccgattagtgtttgtctcagcaatgtgccaacagacaggaagagttggaggtcatctgagctggtagggtaaaaacaagtataaatctcagggaatatccatccacaagggagcccctgtctgctgccaagcacacagcaagagctgcggacacatgaataacagggagtgtgtgtttaagaagtcaggtggcatgcaaagtgaaaacgaagaggcagatgtgcccctgaggcaggcagtctggcgggtgtgcaaggccatttcagattacccacagggaaaacaggagaaaaggtggtgtgagtttttgggaaagagccgattttagttgaaaaagcagaggaaatcctagacagcacacggtcttaggctttagccctaccattctcacaagccgcctgtcagtgatatgtctgggatttcctctgctttttcaaataaaatgtctcaggtctgcctgatgtagaccccaaggtctttcccatccccacaagctatctgtcagggtgaactgagagatcagcccagtggagggggagcagagccactgtggccaagaggaatagttctgggggttggttagtaagcaggagagtgaaaggaagaggaaaacttcctacaggggttgaatgcctccagcctaagaaggaaggcatagaggtatcttaccactgggaaacatatctgagtcacatgtcaccaaagtatgtatctgctccccagggagcctataacttcctaaataaaataagatttttttatatattgagtaaagcatttagcaactttattttataatataaccttttatcataggagaatgataaagaataatctggtccctgccagatttcctttttcttgccaactcttatacttggtctagcatgaggccctgagatgctcttattgccccaactttcagcttttgtaatggaaaacatacatagttatttagctaagtaatggttcgttatactacctctgacacttcaatagtgctatcatcttcgcttcctccagtgtatagattgtgccttgcatgtggttggtgcttaatgaatactttactgagtagatgaagctctgttgaaaaaaaacttgctttgtatttaattatttggttccattttttatacatttatagtttttactatatctagaaataagaacaattgcatgttcctttccttttcagaatcatctagagtaagcaggccaagagtgtttttgataattaacagaccattgtctgctaagatgatgaagcacattgagtttttcaaagaaaccaacaacatagcaatataaaataataattaaatcccccagtgtgacaaaggggtaagcggtatgaccatgacccactgttatttttttttcaataggggtgtgtgtgtgtgtatgcatgtgtgtgtttgtgtttaggagttggggtcttgctctgttggccaagacgggagtgcagtcgcacatatgtagaaataatcttgaactatcttagctatgagcaattaatgtaatgaaatacaattaatgtatttctaaaatgtactaattttagaaatagtaacataggtattgtaaattcatggtcttttgggggtttattgtgatgaaattaaaaggctaaattactcttaagagtttttataactttcgaagaagaaatgttggggtcatgtattaaaaggatttggctttgattatagctttacagtgaagttcatttcttgtctgaccacgtctttaaattatttaaataagtcttttccatcaagtgcagttttcctgtcaaggtttatgtctttttttggggggtggggtggggatggagtctcactctgttgcccaggctggagtgcaatggcacagtcttggctcactgcaaactccgcctcctgggttcaagcaattcttccgccccagcctcccgagtagctgggattacaggcaactgccatcatgcctggctaatttttgtaaagacaaggtttcaccatgttggccaggctggtcttgaactcctgacctcaggtgatccacctgcctcggcctcccaaagtgctgggagtacagccgtgagccactgcgtccggccagtttatgtctataaatgagtttttaaaaatcatactgtgaattcatcacataagtgaatgaaaccttttctttgcctgtgttctcatctcttctcccttcaccacagaaatgccaaaagtcatttgtgtccaagaaaattaatataataatttttttaaatcctccttttccccaaataagtgctcatactcttttcaccttaattggaggtgaaaagctgaattccctactactgaagatagatctggattgcttggtagaatatgcaagatggttcttaggtggcacccccttcccgctcccctccccccacacacgatattagagaaaaatctgtggccagttcatttacacttgaatgtagaaatctagtatttcctgattgctcaatttgctgtttagagatgcagcttaaaatagccatctatggagttagactgatccatgacagcttaacagtgttggaccaacctctcttggccctaaactatgcagctattttaagctatgaccctaacaactgacagggcatactgtaccctcttagcactgagcattagttctgtatttccagagctagactgatttaaacttctatagaattaaagctatcattgtaatgttttgggaattgttttgttttgttttgttttgagtgagagtctcactctgtcaccaggctggagtgcagtggcgcgatctcagctcactgcaacctccgcctcccggattcaagcgattctcctgcctcagcttcctgggtagctggtactacaggcatgtactaccacgcccggctaactttttgtatttttagtagagacagggtttcactgtgttagccaggctggtatcgatctcctgaccttgtgatccacctgcctcagcctcctaaagtgctgggattacaggtgtgagccaccgtgttttggaaattcttatacccacccacacaagctgccagcttgccatggtatatcagatttcattaaaataaatactatggcagaggggaaagatactaaccataaactctttgtgttttacccaggtaatatattttgagcattacttctttggatgaactgcctgtaaaacagaaaagtcccaagaatcgtttgatgatcactgtaataagattatactgtttttagatggttagtacactaatacctgattctgtgattgcctttgctcatattttctgctctcatggaagattgctttttaccgttatttcctgttttatccatttaattgttagtggtcctgtttactaactttgtcctcttaccacttctcaactgcatatccatttctttgggacttattccttaaattcctactaagtctaagcacaaggctaagttctgagagcataaaggtagaagcctttgccttccaaaaggttatgttccagttgaggagacagaatattcattaaaataaaaggtaatgcatagaagtaatacaagtggcatatgctaaaagagagatgaatggtaaaagatggtaatactaaaattaagagcaggatgaatcttctgagagccagggcagaaataaaagactccatgaaacctggtaggcttgaactaattctttgagaaaaggagagccctaacaggaataaagaaggaaggcattgtacaaaagatagtgtgtccggaattggtgggttcttggtctcaatgacttccaagaatgaagccacggacccttgcggtgagtgttaacagttcttaaaggcggcatgtccagagtttgttccttctgatgtggggatgtgttcgaagtttcttccttttggtgggtttatggtcttactggctcaggattgaagctgcagaccttcgcgatgagtgttacagctcttaaggcagtgagtctggagtcgttttttcctcccggtgggttcgtggtctcgctggcttcaggagtgaagctgcagaccttcgcggtgagtgttacagctcataaaggcagtgtggacccaaagagtgagcagcagcaagatttattgcgaagagcaaaagaacaaagcttccacagtatggaaggggacccgagcgggttgccactgctggctcgggcagcctgcttttattttcttatctggccccacccacatcctgctgattggcccattttacagagagccgattggtctgttttacagagcgctgattggtccattttgacacggtgctgattggtgcgtttacaatccctgagctagacacaaaagttctccacgtcaccactagattagctacatacagagtgtagattggtgtatttacaaaccctgagctagacacagaatgctgattggtgcatttacaaaccttgagctagacacagagtgctgattgctgcatttacaaaccttcagctagacacagagtgccgattggtgcattcacaatcccttagctagacataaagattctccaagtccccaccaagattagctagacacagctgattggtgcatttccaaaccttgagctagacacagagtgctgattggtgtgtttacaaaccttgagctagatacagagtgctgattggtgtatttacaatcccctagctagacgtaaaggttgtctaagtccccaccagactcaggagccctgctggcttcacccagtggatttcgcaccagggctgcaggtggagctgcctgccagtcccgtgccatgcgcccgcactcctcagcccttgggcagtcgatgggaccgggtgccatggagcagggggcggtgcttgttggggagactcaggccgtgcaggagcccacgggggttgggggagactcaggctgtgcaggagcccacggctgggtgggggtagactcaggcatggtggactgcagatcctgagccctgcctcgcggggaggcagctaaggcctggcgagaaatcgagcgcagcgccagtgggccagtactgctgggggacccggcgcatcctccgcagctgctgacccaggtgttaagcccctcactgccgggggccagcagggccggccggcaggccagccgctccaagtgcagggcccgccaagcccacacccacccggaactctagctggcctgcaaacaccgcgcgcagccccggttgccacccgtgcctctccctccacacctccccgcaagccgagggagccagctgcagcctcggccagcccggagaagggctcccacgatgcagcggtgggctgaagggctcctcaagcgcagccagaatgggcgccgaggccgaggaggcaccgagagtgagccagggctgccagcacgctgtcacctctcaataggaagttggaatatgctttgtataagaaagaatggatagacctttaaagttctagtggagactttgaggagaatgttagaaaatgaagttcacaaggttggtagaagtttggttgtagaatgacgatgtcagaccaaggacaggtgaaaagggtatgtgaatgtgtatatttttgaggggtaggggacaggaagtttcatttataaagcagtgttttagttttagttttttttttttttttttgaagacaggatctcactctgttacccaggcagtgcagtggtgtgatcttggcttgctgcaacctccacctcccaggctgaagcaatccgcccacctcagcctcccaagtagctgggactacaggtgtgctgccaccaggcccagctaatttttgtattttgtagagatggggttttgccatgttgcccaagctagttttgttttttaacagacgtaggagaaatggggaagccagtttcgggaccatagtattgactcagatatcagtgatgggaagtctgaacttgagtgtaaagtatgtggttctcaagagtcttaaaaaaataaaaataaaaaagaatttgatgtatgaatggagagaggaaaaatattttaagggtaattctgtagagtttgaatctggatgaccatgaaagtgcttgtgccattgaaagaaatgacttccagaaaatgaaagtgatgaacctgaattttgatatttgttaataagtctgagctaatagtatgttgaaagtgtctagtttgtatctggagattggtcctgagaagagatcagaatcagcagtctagatatgaaagtcttttgcatggagatggtgtagaaattatggcagtgtatgaaattgaggcagacagttttgagtttgaattgcagaattatgagaactgaacttagggttacacctggtctttgggggccaaaagcagaaagttaagaaaagtgagaaccatcagagaaatagaaagagaacagggtagtatgtcagcagctaagaggaatctcagatggtattgaatgttgacttgagagtattgagaaaagttcagcaggttttgtgtttgaatcatttgataagacctaagaactgtgctgttcaatatgaaagccgttggtcacatgtggcttataaacctaaaattaattaaaattaaaaacttatttcctcagttgcattaactacatttaaagtgctaattaccacatgtggcaagaggctatcatattggacagcactgataaataacttttctttttttttttttttgagacagggtctgtcacccaagtgaaagtgcttctaaaatgagattttaaaaaggtgagtcaatgtttggagaaccagtcagatgctgataatagaagggagaataaagatacttttgggtgacttctcagtaaattaggaggcaaaatcatctacagattgtaaggtgcaaggaaaggggaatgaggatttgaggacagagggaaaaaaattggaacagccaatgaagggctatgtacattgccagcataggatgaatgaaaggttaccaagcaacagtgatggctcaggtaatgtaaagtttagggctttattagccctcctgtaatctctttccttggtgtttagcagcctaagaacaccagaaagtggatgataagaattaccatcaggtgtggcagaagttcagcgagacacaagggattaccacggatgctaagcgaagccagaggagggttggattgagagtgtgtccacataactagggaacaaagtgaggatgaagattgagttcaaaaataaacggagtgaaagggacaggaagttaaatatcgtggttggagaagagatagtgccaagcctgacttcttggaggaagagcagttctagttgaagacagagtttgagctgggttgtgtctgtaggagacatctgaatgtagaactgattttttttccaaacctgcttcctctccggggttcccctatttctgttaatgggatcatcatcactcaaattagaatacttatagatttatttgatctttatcaattaattatcttaaaagtttatagttctaaggttcaagtcttagtttagccacttaaatcttgatcaagtgtttctctaggtctgactgtcctcatctgtaaaatggcagaaatcatgttactttagtgggataagatatgtaaagtactttgcacagtgcttagaacacagaaaagatttcactaagtgctagcaactatttattatgataattattatttattcttatatctgattcattcccttgtcagggcgctctcttttttttttttttttttttgagatggagtctagttctgtcacccaggctggagtgcatggcctcccgggttcatgccgttctcctgccttagcctcccgagtagctgggactacaggcacccaccaccacgcccagctaattttttgtatttttagtggagacagggtttcactgtgttagccaggatggtctcgatctcctgacctcatgatccgcccacctcggcctcccaaagtgctgggattacaggcgtgagccactgcgcccggccagtcagggctctctttcagagcctcgtgatctggaaggtaaaatagcttctttcctaactggtatctctgcctctacgttttcacatgtttattttgttcttgacatttcagagttttcctaaaactgagatctgatacacccctgctccgtttgtcacaatctttgtttaaaaatctattttctattttttttttttttttagagatggggtcttactgtgttgccctggctagactcaaactcctgggctcaggcagttctccagtctcagccttctgagtagctgggaccacaggtgtgcaccactgtgccaagcttcctcacaaccttcataggcttccaattgcagacttttcaagttataaaaactgtcaagaggtaatagagcccaatgtagaataaaagttggtgatagaggctatagcaatgcattactactatggtgactcattgtacatctaaaggaccggaagtagctttaaaactttttaagactatttacaatttcacatagaattagccagattttccttttttgatttatttttcaccatcaacttaggcaagtatggttcaacgtagaatgagggaaaattagaaaattttttttgttttgttttaaatatggcaaattctgtttaaagaaagtattcatatctttctagggttttccggctaggaaggatttcctcaacataaacagagttgagaatagttgacagttatctggagcaagattagaataaatagaaataactaggtaccaaagagggtgtatatctttgttttcctaagcttttctctccaacaccaaatgactagagttgcctttccttcctagctcagggagtttcaaaagagcaataccttcaagcatcagaattgatagacaggtgttactgtgtttacctctaactccctgttgcctgcaaagtccaaataatatcctagtgcttaaggagagaatatagccaaccagaaaagagtgtagggctctggattcaggctgacctaggttcacatcttagctttgccacttaatagcagctatgtaatcttgggaaatatgcataacctccccaaatcttagaagacagcattagacaaagtataggtgtaaaatagtttagttcgattatagccatttagtaaattgagtaagtgcgagtgattattgtgtggcaggtattctggattggggatgggaaggatgggcataataccttaacaaggattccctctctcctaccctagaaagtcccttctttaagaagttgacagcctggacaacatagcaagaccttgtcacaataaaaaatttagctgggtatggtggcacttgcctgttgtcctactggagagggctgaggcgggatgattgcttgagcctaggggtttgagattacagtgagctatgattgcactactgcactgcaggctgggcaacagagcaagaccctgtctcttaaaaaaaaaaggtttaattaaggcccttcctgatctatccttccaaccctatctttagccccctcacctccttgaactttaatctccagtggtatgctgtctcagggttatgtctttaaatatagccttcccactgccttcccatttgcctttattctttccacctgtcagtggattcatctcctctgtgaagccttcattgtttctttttgacagtaaatcactgtcctctctgttaagtaggcattttatgcacatttttgttattgtgcatattataattatttatttgagtgtgtcttccctacaggtgagggcttctggtcagatcttatttatcatttctccagcagcattaagcacatagcaggtactcagtagaagtttgctgtatgaataaatctcacttctatactaagtccacatccaaagtgctaggacttaaggaaatgtgaatggctgttaagtatttgtacttaatacatttgcagtttgttttactggagttaacattcctcttgagtgtttatcatattccagacattatgctaagacgtgtgctatatacactatttcagtcaactcccacagctcccaggtcctcaaaggaagaaactgcagggagaatcagaactcagaaacaggtctgcttgacccaaaagttctactttcggctctactaaactgttgcgcctgttcagtaactcaatattggttcacagattgtacataacccatagtatgttgatagtcctggaagtcattggctaatggggttcaccttcatttaagagatacagaaggtactcggttatttcttaatattttcatttatagttcatctacaggaaaacatgtcattgaagctcttccataaggcaaagaagtattttgtaattaataagcataattttcaaatctaggattttttttttttttaccaccagtgtaccatggaatctctctagtcatatgtctgtcaaaactgtcacagcctattcccaaatgtatgtagctctcttttcaaaggctttaattcagtcatatagtttctgtttttgtggagactcatgtagtttttatagggatcacacaaatgtaccatattttaatttttcatatgttttgttatagctgtttataatgatatgaatgagaggcataaatgttagttgagttattccagtgctgagtttcagtggatttcttaatctcagcattattgacattttaggccaggtaattctttgtttttggggtctgttttgtgcattgtaagatgtttagcagcatcccaggcctctactcactatataccagtaatctcacactttgtgacaaccaaaaatgtctccagacattgctgagtatctcctggaaggcaaaattaccttcatttgggaaccactggcttaaaggtacttagagccaacaaaagtagaattaaaaaaaaatttttttttaaatctagttacctttaaaaaaacaactttatttatatatatccataccatattatacaacaacttcaagtgtatattcaatggcttttggtatattgatagagttttgcagctatcaccacaatctagttttagaacatttatatgacctcataaagaaacccttattagcagtcattccccatttctcctttctatcctccccagccctaagcatatttggttatctttttatgtttaggaatatacatcctgcttgcttattttaagtcagatcattatgtaaaccaaatcctattttagagtgtgtttattgaaagttatttgcaatgttaggagacatattttttgagaggaccttagacattttcttaggcagattccaagtttaatctgtaaaggaagtcaatctaggtaggctcagttaagaatcattttagtattattcagaacagaaaaaatcccactgccccccatggcaagttttgtatcatagaaatcaacagcttttgtttttcctgatcagttatattagaaaaccttgttccctaggttatatgcacaaaacataattaagaaacacatgtactttgaacctgctgtatgattattattaaataggtcaatttcagtttattggttggtgagtttatttataggtagatagataaatagttttgtttttcaaatttgcggatctgtcttacttacagagtaatgttacttactatttactataagaaaaaaccttgcaaatcgtcttttccaaaagaagaaataaggcacagttggattattttgtgtacacacacgcatctgttttaaattgtgttcatttctgtccctattcctaagctaacagcaccttattttaattactgtagctacctacatatctttattctactattctgctttttcagacttttcttagctgatttttcacatgtcaaattagcagactttcatggaaaagtttcgaattaaatttgtgattgcattcacttcctagaataattttggaagaattgacacatttagtttaatgattcttcctatccaagaacatatatttctctcttttgaggtcttgttttatatcctttattaaatcttcctcaagatcttgcatattactaattagattgatttctcagatatttgtggttattgttgctattatgaatggaattttttttttttctttttcaattgtttgttgctgatatggttgggaactgttgcttttttatgttgctcttgtatttggccatctcgctgatgtacagatgtcatattataataatttgttgatttttctatagttttctaagtaatataattatatcttttgtaaatcatgacagtttcgttacttccttttaagtctttatttcttatatagatctgttatttcttgccttactacattggcttagaccttaaggaaatgtacagtattagaggtgagagcagtaatcacttctattagaaactacagtgagatatccaattttttgtttattaaatgattttatacattttactgaatttctcatgctccatgagatgaaacagcattctcccatacttctggtggaaatgtaaatgaatgcagctctttatatatactcctgtaattttataatctagatagtcttacaaatgtttcatgtcctttgatttagtaatctcacttctaggactatcccttggaaataataaacaatattttagttcaagttgctcattactttatgttacttataataagtatttggaaataaatatctaacagtacagtaatggctttgtaaattatggtatatgatgaaatattgcacaactattaaaataatttgtaatattaataacttagaagtacttatattactaaataagtaaaagaggataatacagaatttttatatagtaaagttgtatcagcatcaaaatacattgaacaaagattaaaacagaacttagatcatcacatcaaaatgataatagtggtaatctatgggtaattactttctggatgatttcatttcctcattcatagttttctatggtgagcatgctttgttcttaaaatcagaagaaaaagaaacttaaagtgtatgtgtttgtaatactaaactatttattttcatcaaaataggtagaaagggagaaatcttagcctattccctaaatggcaagtttagttataatttttttttttttttttttgagacggagtcttgctctgtcgcccaggctggagtgcagtggtgagatctccactcactgcaacctccgcctcccggatccaagtgattctcttgcctcagcctaccaagtagctgggactacaggtgcccgccaccacacccggctaatttttttgtatttttagtagagacaagatttcaccatattggccaggctaggactagttggtctcaaactcctgaccttgtgatccacctacctcggcctcccaaagtgctgcaattacagtcatgagccaccatgctgggcctataattttttagagttaatatttttataatactcttttcaaaaaaaaaacaccttgctgaatgtagatagcaaatgtcataggagaaatctgatacctgagagagtagtacatagtttcagaaccaaggttgagagttatgctctgggatctgcttctaaatgatctgactgccatatcagtgagtcagggaggaagtgtagcagatatccacttgatttggtttcttactgtcttgtcacccatgtgcatgtgtattgtaaactagctgtcatttagcagccctgtgatatactgctggccgagtttcgtaagaaagcttctatgtttgtatagattttagattatcattcgctttatttaagaaacattcattaagtactttcagtgtgtcaggaaccttggtagccaaaggacaaatgacataaaaaccacacagatggcctctttcttgagcagcttttgttggaaataatttatgactaatattatgatggagtgagatggtgtcttactagtaagaccagaaatacttaaattctaattcaaccaattcttgagatcccttagggagctaggtataccaaaattcaagttagaatttgttggcttaggcataggcccctgcctcacaatccagagaactaggttattctatatggaatatgcctttttcctttaccagctaaacctgactttcctttctacgtgttagcttaaattcaagtcgtctcaaattttactactctactaaggcaaaaaactactggtactaaaagaaaatgagcaagaaatgtccaacaagctagatcttgttgaatagttagcaattcagatgtcttactacctaccaacaaactgtccccctccattaccttggcccagtttctatatttggaaaaaaaaaaaaaaaaaaaagcagaacaaaaaaggaataagaaagatggcttggctgctccaagcagccttggaatgttttacctctggtaatgtggaagaaaaataaaagaacggccatcctcagtctgtttcaccataatgtgtagttacaataccaagaaattttgagttattaaaaaaattattttacaaagcagtttcattggtaagaaggattaaagactaaaatctgtaagatgaatagacttttgtcagaccaagggagatggaggtttggggtgggagaatgtgttggattccagctatattattcaaatgctcggagacacagaacattagagaagacaggagttcactgtaggtgatggtgagagtgggcatggagcaggagtgccaagagatgaagttataaaactaagcaggagttagatcatgaagaactttatgtactatgctaagaaatactgaccttattgtgaatgtatggagggcccattggctttttggggagctaggtctgcaatatgaatattagaaggggcaaaactggtgataagggcttgcactagtgtacaagcaataggtatggtgaaaatggagacatttgagatattttgaagaggtagacttaacagggacttatgatcaacatagataatgtatatggtggaaagagaatagctttttgagttggataagtgtgggttcaaatcccagctctgtcacttttccattttaggatcttggatgttttacatacccctgagaaccttagttttctcatcttaattgggacagtaagctgggtgccatggcttgtgcctatagtcccagctacttgggaggctgaggcaggaggatcacttgaggtcaggagtttgagtgtagcgtgggcaacatagtgagacataatctctaaaagaattttaaaaattaactaggtgtggtggcatgcatctgtagtcccaactactcaggaggctgaggcaggaggattgcttgagtccaagagttagaggctacagtaagccatgattgtgccgctgtactctagcctgggcaagagagcaagactccatttattaaaaataaaaatttgggacagtaatatttagcccatagggatgtgaaacaatatatggaaaacatccagtaaagtgccttaccacatagtagatataaaacaatagttgctcttgttgtcagggtgaaggagatagagaggaatcaagaatgacttccaaattttctatttgaatggtgaaaaagagctatattaggaaagtgggctaagctatctggttcttagattgcttgtgaggattcaggtggaagtgttcactggcagttgatagtaagagtatgacacttctgagtggaaggcacagatctgtgagttaatcagcttacacatagcagtaaaagttatgaaagtagatgaggtcccccaagaagagagttagaatgagaagtcagaaccctggagagtggcctaggaagagtagagggtgtattttgtttgattgtttgtttgtttgtttgtttttgagagggactttctctgtcacccaggctgaagttgaagtacagtggtgccatcacggctcactgaagtcttgatccccagggctcaagtgatcctctcacctcagcacctcattctcatgagtagccaggactacaggcacatgccaccatgcctggctaattttttaatttttttaagagatggcatctcactgcgttgcctaggttggtcttgaactcctgggctcaagcagtcctcctgcctcggcctcccaaagtgcggggattacaggtgtgagccactgcacctggctgataaatcttttcagaaagtgacataaatttagatttaagtgctgattttaaaaaattgctaaggccatgcatggtggtgcatgcctgtaatctcagctacttgggagaccaaggcaggagaattgcttgagccctggagttcaagactggtctgaacagcagagtgagacccccatctcttaaaaaaaaagaaaaaaaaaagcaaccaaacaaaaaggagctaacagagaagaaggggtttctgaaatgtaggaagttagctcacagagtcaaaattgaataaggatggagtggcgagtggtgtcaaatgcagcagagcagtcctgtaatggtcactgaaaaaatgcacaatagatttggtcattagaaggaagactgtgaaccaggagctgagtaagtccttgtggtagagtgctttgaatgccagactttggtcggtggaagaatgattaaatgttattgagcacgaaagtgagatgatcagaacactacttttttatttttctggcagcagtgtgaaggatgagaaaggagggaaagctcaatttaggttggtagaggcacagattgaacaagggcttggatcaagatgataatcttgcttggaaacaggttagcgtaagagctgttaggcagtagtgtcttcaaaatttggtcatcactggatgtaatgagtaaagaagtagcctaaaagatgacattttaaggttttcagtgtggataacaaggagaataggggtagcatttactgaaacagggacattagcagaagcaagactggaagatgaaatcattttttatttttaaactttgatttattaagcatatgctattgagtggcactgttattgagttattaggcactgttacggtactagagatacagcagtgaacataataggcaagatccctactttcatggcactttaccttcagaagtgaggtgaagaccaaattataaaaggacaaagtaatttaagacaaataagacaaaactaggtgatgatacagtgatatattgaggggagcttttagatgggatggtcaggaatggcatttctaaagaggagagatttgaactcagaccagaatattacaaaggaatcaactatgcaaagatctgggtgcaaaggcatccccacttagactggagagtatatgcaaagtccctaagaaggaaatgagcttgatttatttgagggccagaagagaggccagtatatcaggtgcagagtgagcaagggagagactaatagagatgagctctgagaagtcaatagaattaaacttaagtggggcctcggaggtcttgctctggagtttggtggcttactgatggcagtggaaataaagcagtatgttgaacttagctgtctgtgaaacatctagatgaagtcaattaacgggcttcaatatacaaactcaaatataatttgcctctgttattcattgaaataactttccaagttgtttaggcattgaacaaagaaatgctcacaatatggaggcttgaggagtgtgtcaaggacatggtcaggggaccagagggatcaggaatctctagcagttcttccccacccctcacccccagacttagctttgacttgaaactcatctagcagttctttaccaaaataaaggtcatcttaaatattattgcgacctttaaagtaatgactgttatataaatgttatgagaaaagtagtcagagaatcacggccaaaaatacctgtgtcttcaggggatgtaaagggtacttaccaacttaaaatacctgcagctccatagggaccatgctgtagattttgtatagtgcttgttcagacagtactctcatttctagaaatgcattttttgcagtaaacaaagtgtgtgtatcactgtgcttcttggtacacaagtagtttgaatagattttgtagccaaggtcatccttaagccatctagttttactgaatacatgttcaaaaacactgaaacaaaataattataccttttgtttatgtattgctttataatttatatagcctttacccctggaaaatcaacttgatcctcaggaacagctctttaaagtagatagggagcagaaattttatggaagtcagtgttactattttagagttgaggaaactgaggatctctgagtgcacagtcataaatttacaactctcacttcacttgcattgctttacttaccacaccatgctaattcaaaggtgtacaaaaatgtaaattttagtagagggtttgtatccttactaaaacagtgacaaaataaattttttaatgtgcatgttagttatgggtgctaccagaaggattaacggtgctgtggatacgcagaggagagtgagattgactttggctgggagagtcagaggtttaattttgtttagaaaatgtgtactgttttcttacttggtactttttattgcctcttcttggttgccccatacatttaaggtactacatgtgcagctttgaaataacctcccccaccctttttttgttttttgttttttgtttttttttttgagacagagtctcactcttgacgcccaggctggagtgcagtggcacaatttcggctcactgaaacctctgcctcccgggttcaagcgattctgctgcctcagcttcccaagtagctgggactacaggtgtgtgctaccacacctggctaattttttgtatttttaatagagatggggtttcaccgtgttagctaggatggtctccatctcctgacctcgtgttccacctgcctcagcctccaaaagtgctgggattacaggcctgagccaccacgcctggcctgaaagaaacccttttattttgtatgcaggaccggtatgtttgtttctgctagcatattttattgttattttgagacagagtctcgctctgtcgcccaggctgcacagtctcagctcactgcaagctctgcctcccaggttcatgccattctccttcctaagcctcctgagtagcgagtagctgggactacaggcgcccgccaccacgcccggctaattttttgtatttttagtagaggctgggtttcaccatgttagccaggatggtctcgatctcctgaccttgtgatctgacatctcagcctcccaaagtgacatattttattcttgtattgccactgaactcagcagagatgaattggtaacagtagctaccatgtaatgagcaattccgtgccagcactctggtagaggatttgtaaatttacttaatacttacatcaactttctgaggtagaaacattctttcataaattggtattttcttttcagtccattcacatacttgttattcccacacctgatggagagaatgtagaactgtgtgaaagaaaagataattataaggcattgtaggccgggcacggtggctcacacctgtaattccagcactttgggaggccaaagcaggtgaatcacctgaggtcaggagtttgagaccagcctggcaaacatggcaaaaccctgtctctactaaaaatacaaaaaaaattagctgggcatggtggcacacgcctgtcatcccagctactagggaggctgaagaagaagaattgcttgaacccaggaggtggaggttgcagtgagccgagatcgtgctactgcactccagcctgggcgacagagcaagactccatctcaaaaaaaaaaaaaaaaaaaaaaagcattgtatttcaggataatgttaagccatgccaatagatttttttattgttgttttattgtgcattatttattatatttttcccaaagtgaagaagccaagctggtatatatactaatctgagtgatgaagtctaagctatataacatgaatgaataaagtaataatatcttaaatgtctttttatgattacagtgacagtatgtagtaatcttgggtggttttgcatttcaaaaaccactttatgtatacactaaaaaaagtcgaatcaataaagagatgtttatttaaactatttaggaatgcaagatgtccataaaacttaatcctttgtttagtgacttttcactcctgtattttcttgttatgataagatatgttgcttaccgtggaaatggtaataaagctttgtgtttatataacatcttttaggatctcaaaatgcttttagactatctcatgtatcctcatagtattttagtgagtaggtaagtggcaagtattatcttcattttacagatggagagagaaattaagccacaaagtgagttaaatgatgtatgtatatagttccgttatctagatacataggcaacctgagccactaaagtaagaatactatattttagaaggattgacatagtataagccattaaccccttagtttttgtactttacacagattgttagaaaaaatttattatgcacatagatttttttttttaatcctttctttaggtgtagaaaacattacaatacttcttttttttcttcctttttaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaaggtaaatgctgtatttttcaactgtgtctatttggaaggcataaaacagcagttaaaaccaagtaattggctgggaatgatggtcactagaacttcattacctttgtagcctagaagttgatatataatattagaaagggaattaagttgggctattttaggaatgaaatttgagcggtcctccgccttgttccttacacttttaaaaaatattttttctttcttccccacccctcccccaccccaacaagatggagtgtcactctgctgcctaggctggagtgcagtggtgcaatctcagctcactgcaatctctgcctcccgggttcaagcgattctcctgcctcagccttccgagtagctgggattaagtacaggtgcccgccaccacacccggctagtttttgtatttttagtagaggcggggtttcaccatgtgggccaggctggtctcgaactcctgacctcaggtgatccacccacctcagccccccaagtgctgggattacaggtgtgagccccctcgcccagcccattttttttctttttcataaaatatttacgtaactttattgatataaaactcattcgtacaccatacagttcacgaatttaaagtgtacaattcagtggtttttaatatattcagagctgtgtagacatgactacaatcaattttagagtgttttcatcatccccagaataaattctgtatcttttttaagcatcacccccttatcccaatccttccatcctagacaactaatttctgtctttatagatttgccttttctggacaattcatataaatggaatcatggtcttttgtgactggtttcttttagcataatgttttcaaggttcaaccatattacagtatgatcaatacttcattcctttttagggacaaataatattccactctatggatatacaatatttttgtttatcctgtcaattgaaggacatttggttttatccacccactggccgttatgaataatactgcagtaaacatttgtgtagaactgtttgtgtgggcatatgttttcatttctcttgtatttatatgaaattacctagaaatggatttttgggtcatattgtaattctatgtttaaccatttgaggaacttaccgactgttttccaaagtggctgtaccatttaacatttccatcaatagggtatgaaggttccagtctctctagatcattgccagtacttgtcattatctgactttatgattaaagctatcctagtgaagtcatatgtcactgcagttttgtttttactgatactaatgatattgagcatcttttcttgttcttattggccatgtttgtatctttggagaaatgtttatttggatcttttgcccattttaaattatattatttatttttcattatggaattgtctctttatatattctacatacaaattccttatcagatatacaatttgaaaatattgtctcctggctgggcgcagtggctcacgcctgtaatcccagcacttcgggaggccaaggcaggtggatcacctgaggtcaggagttcaagaccagcctgaccggcatggagaaaccttgtctcactgaaaatacaaaattagccaagcatggtagcgcatgcttgtaatcccagcaactcgggaggctgagggaggagaattgcttgaacccaggaggcggaggttgcagtgagccgagatcgcgccactgcactccagcctgggtgaaagagcgaaactccatctcaaaaaaaaaaaaagaaagaaaaaagaaaaatattgtctcccattgtgtgaattgtctgtatactttcttgatagtgcctttgcaccaaagttttaattttgaagtctagagttttctattttcctttattgcttctgcttttggtattgtatctaagaattcattgccaaatccgaagtcattaagattcctagttgttttttttttttaagataattttatagtttttactcttacatttaggtctgtgattaatttggggttaatttttacgtatggtgttaggtaagggttcatcaagcaccagttgttgaaaagactgtcctttctccgttgaatgttcttggcacccatgtcaaaaattagttgaccatagaacatggatttatttctggactttcagttgtattccattgatctatatgactatctttatgtcagtaccacactatcttgagtactttggatttgtaataacttttgaaatcgagaaatgtgagtcctgcagctttgttattcttcaaaattgtactgactctttcgggacacttgcaattccatgtgaattttagaatcagtttgtcagtttctataaagaaaccagatggtattctgatggaaattgcattgaatctgtagatcactttggggacggttgccagcttaacaatattacatcttttggtctatgcacatgggaagtatttctggttgtttaatctttaacttctttcatcaatgttttatagttttcagagtatacattttgtacttttgttaaattccaattttatttctgatgctattataagttgaactgttttcttgattgttcaagtatgtagaaatacattttttaatgtattaatcttttatcctgcaacttttgctgaactttttgattagttataacagtttttttgtttgtttgtttgtttgtttgtttagtagagtctttaggatttctgtgtataaggtcatggaatctgtgaacagagatagtttttactttttcctttctactctgcaggagttctgtttctttttcttgcttagtttctctgtctggaacctctggtacaatgttgacagtgtgcttgtattttgttgaggatttttgcatccatattcataagagagatgtctgtggttttctttttgtattgtttttatctgattttggtaatgataatactggcttcatagaatgaattggaaagtattccctccaaactggtattaattctttaaatgttttgtggaatttaccagtgaagctgtctgttcttgggcttttcttatgggtagttttaattacgaattcagtctagttgcttgttgtaggtgtattctgattgattatttgttcttgagtcagttttagtattttggtccgtatttttctaggaatttgtccatctcctctgagttacccaagtaattgccgtagaattgttcatggtattcctttgtaatcctttttgtttctataaggttggtagtgatatctcctctttgatttctgattctaataatttgagtcctactttcttggtcagtctagctaaaagtttgttagttttgtttacttttcccaagaatctcaatatttgacattttttctgaccctaagaaggttcttcacagcctctttgctcacttctttctggcaaactagccaacctgtagttaagcctttatttccagtgaatctcttagtcttctcccaattaactgccttttgaaaccatctctactttttttgagagtacccttaggcttgaacttcttcacattgtcttgcaaatgaagtcaattcctttgggaagagatttggagctctttgttttatggtgtgtttctgacttatggcttttgaaccgggggttgagacagtggctttctttctgagttacaaccctgctttaagagctgagtgcctggttgctggggcagcaatagcctcaggtcttctcaactggcctctcctggcttagaactttgactttatgaactatgaatgggccaggtcaagggcaacctggaccccagtattttcatcatgccacatccaaggtagagtctatgtcccagggctaaggacttggttctgctacacttgcctggaacttagcaacaggcaaccaggggtaagataagaaatgcagacatcttgcccctcctggggccatactcctctgaccgggaggtgggaagagtaggaatcatattcttagctgcaccagtctctaatgttcctgtgtggaaacgggaggaagtagggaaggggagagtcttggttcaaataccacagactcttactgttcttaccaatttctgtgagattttcttgaataaatgtttctttatttgctgttatttgcttttagaaccatttccagagactttaaatggtattttttgctttttttagaattttcactgggaaacagatccatggaactcctcacactgccctgctagaaacgaaactctgcatcttacacttttaactggatttagccatccttttgaaattttagagaagtttcaagtgttttgaaaggcttagagagatttttttcccaagggaagagcccactatgaccaggaacgtgagtccataatagagcataaactctttgagattaacacattttcatagcaatttggtacacagacctgttttattttgtctttaactgaaaattttctgatttgaactacagttatggcatcatgatcaaacctattcagagaagcatcatttaattaccttgattctttttaatttttctataattgtaaacctactatttggcagtgtaattaatgttcggtttttgtttttgctagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggttagttgattttaggacttgtactttttacttatttcttcagtttttacatgaaaattttagtgatagtttagctatcaaattggaaatatgcaaatgaaggagaaggcatttactttagcaattatatggaagatgtttaagatgaacatttttaacctcatttctgagatacattttattctactttttgtaaactttatcagcatatttatgagacaagtggaatttattccatttgtttatattgtaatcttagcatgttgaaatcatacattgtttttcataagtgtttaaataggtgaaaagagagttgaattatcatcttaatggggactttcattagtgtgttttagtttttttttttcttaacaaatccagaaaattcaccaaagtatcaagaataattaaataataaacatctaacaaccctcagtcagaatggtcagttgttaatattatattttctgctttttttcaaatacagcaaagcagttataaagtgaacatcatgtttaccctttcacctttcaaagactgcagctgctataaatctaatgtgtctaagttttacgtacacttttaatactctgacatatatgattaatggatctacataaaaaatgttttgtgtgtgttatgaaatgttacaatgttgcagaattataaatttcacttgttttgagatctgtttgtacatatatgtatatttgcatatatgaatttccttgaactgctatataatattttatcacatgagtctaccacactatattaattcattcccatactgtttgaggttattgctagggtttgtgtgtgctatcacaaacttagttgatgagaacatgtgtgagaagtggaattattggatcatagagaatgtgtatgtttggttttgctaggtaatggctaaagagtctctacagtggctatttaactagcagtgattgatagtttccactttgtgctcaccagtacccagtagtgtcaggccttgaaagtttttttcaatctaaaattgtttcttattttaaaaatttgtgtttttcatggttatccatgagattaagcacctttcatatgtatattagtcatttatggctttgttttttaattctggttctcattttttctttcagaagttttccttatttatatgatttatatgttatacttttccctttcaataaaggactagtgctagtcttttatctttgtcataccttttgtcatatggaagtcttacatttttatttagtcaaatataaatcttttcttttgtcttttgctttttgtttataaatttttcttctgtcccaaggtcataaagtctcaaaaaacaatttcttctaatagctttaaagttttatttttgtaagtttgatcttttattcgctcaagattctttttgttgatggaatgaaatgagaatacaattttatttttctttcatatggaaagccctttcttaaacagcccattctgtctctattgattgtcctcttttacataatgtctcctttaagtgtggttcaatttctggtttctctgttttgaagtttttatctatttgccagttcctacaccaatgctcttactatattaatgactgtggttttatattaagccttgacttctttttgggcaattttccttctttctttatttttttttctttttttgcccagaacacctacccttttcagaatatttagaatttgggactcagtatttcattattgaataaattaatttcaataaattattgaattatactttatactttaaacctgtaccaagatacatgtgggacaaagggagaaataaaactgacatttctaaatcagctgctatattatagtcagatattttgaatatattacttcatttgattctaacaacagcaacaccggcatagaaattagctccattttaagattagaaagtagtatcagaaaagaaaaaattatgaaatctattaaaaatggtaaatataaagttatttaatttgatatacacataaagtagtaatacaaatgagtacagattgagtaccccttgtctgaaatgcttgggactagaaatgttctagatttcggattttttcagattttgcatgtgcacaatgcaatacttcggggattcatttttgtttcatatataccttatacataaagactgaaggtaatcttatacaatatttttaataattttatgtgtgaaagtttgtgttaagtacttatgtgtggaattttctacttgtgggatcgtgtcaacactcaaaaagtttcagattttggagcaatttggattttagatttttgtattagggatgctcaccctgtgttagtatagcgtcgcaatccctgaaaaagttagcattatagtaaagctctgaattttaattttaaaaaagataatttgaaatctttctgtatagtatatacaccattgacgttggcaaatatgattgattaaaagttaattccataccagttgttgatatctgttttagaaaaatactctgctatttaggtctgcatgaaaggatgcagtgtttccatcctggattagcagtgggataaattagggaagccaagaaaattttctactttgtttgatttggaacctcacattatgattgcttcattttgtctaagaaatgatgagttggtaaagtccctctctcttacacatccacacacttgcagatacacaaaacaaatttatttaagaatttatatatacatatacttcaaaaccaaatattatgatttggggcatatctttaaaaaaaagattcacaccattattatctactggattgacaattcataatccaatatactttaagcttactttcagtggttcaaacatcttaaatatatcacacataaaattgtttaattaaaacaggttgacactaaaaaatattaatatcagtatacttaaaattgttacttttaaagatttaacagagtaactcctgtttgttaaatttgtctaaaagaatatgaaaaaatatattttgaaataagtattgattaagcatttaatatgttaagttgaaagccttaaccattcgtagcaacaactatgctttatttgatgtctaaccactactacaaatagaaacttattgacttggctatgaatgaatggagttatttgtattcactgctgaaaatagtgatctgtttgctttttaaaaaaatttgtaaaggttttcaaaacaatatatgcatatggtatttaaaaatgaaatcacagaaaagtttactgtaataaggaggctctttgccccaccccatcctgctttccagagaatatcatagctaactattttaactatttttgcatttttgttctttctaggatgactgtcatgtatctaaatcatatacttaaacactgttatttattgatctatcaatattttatactatctattgagttcttgcatttagaattaaggatttacttcactttgcaccatctgaagacattaagattcttttgaaaaactgtatgcaggccaggcattctctcttaactcaccactctatttccaataaagttagacaatgccttttcttttttcttgtattgtttgactttacctgaaataatctttagttatttcaagtttttaagaacaatgtgaattccagtcacattttccttttttctggagccttccatctttctaatgaacatgaacagtttcttctgtagacctgttccaggggtattatcttgagatttcttcccttctctgttcgttttagatctcatattggttctcaagatctcgtgttttcatttttcttggtctactctcttcgttgctggaaaacgtgctgaaatgcttcctaacgaaaagcttggggaaataaatttgtctaaaggattctttattttctctttctgcttaatttggttgtttggctaatacagtattctagattgaaaattacattctcttaaaacattgtcacagctctattttctttcatctgttttatcaacaagaggtttgttattttttcttgttttttttttctgtaggtgacctgatttcttccctgcagctttatttttattttgaaataattttatacttagagaagagttgcaaagctagcatagagttcgcatatcattcaccaagcttcccttattgtaaacttcttgtataaccacagtaccttatgagaattaagaaattaacattgttgcaatactattaattacactttccaccaatataccttttcttttccaggattcagtctggaataacacactgcatttgtttgtcatgtttccttagtctcctgcaatctgtgacttttcctagtcctttccttgtcttttatcacctggacacatttgaaagtggttttggtatttttagaatgtctgtcacattgggtttgtctaatgttttctaatgattagagtaagattgtgaattgtcatgagaagaatagcacattagtgtctttctcttatcatataagaggaagtatgtaatgtgattatctcattattggtgatgttaaccctgatgtattggttaatgtagggtgtgccacatttcttcactgtaaagttacagtttctctctttccatattgtttgttagaagcaagtcactaagttcagtcgacattcagggggaagagaactaagcttcacctcctgaagggagaagtatcgaagaatttgtggacatatgttaaaaccaccacaataattactattttagaggagtttggggggcttttttacaaataaaatactaaagcttcacttttagcattcctcagtggatcttgcctgcagcagttattactgtgatgtttgaaaggtcattttcaattttccttgttctttgtaccacttatactttcttctccaattatttatgcaatcatttatttacattggtatggtctcatgagtagttcttttgttctttgggttataattcaatactatcattttcttgctcaaattgtttcacctttggccattggaaggtctttcacattagttcctgtgtcttcttgaagtgcccctgttttgtttttaacgctaagggcgccttttaatctgtggtgtgctgctaatttcataatgctgtatctgagaatagatttttatttgttgtgctaatgacttgtactctgggtcacctctctccctctctctctctttctctgtctctctctctctgtctctctgggctcttagtagacatattttggaatctctagggttttttttttttttttggtcttacagtttttctcttatatcttttgtctcattaccattttattttccatgaaattttttaagtttactttcagatatttctattgaattgcattttaatttccaatagtgtattccatcattgttggtgggttttgttttgttttactgcattttgttctcattgtatggatgcaggtgcttgctgaaattatctcagttttttaatctagaattttatgtttcctccaggatgatttttttgtctgtatctttttccagtgttgtaggcgttcctgaattgtccagtgattctttgtttttgttcaagttgatgatgatgatgatgatgatggtggtggtggtggtggtggtggtggtggtggtggtcatggtggtgatttgatgaaatcttaagtgaaagattttgaaaactttatgagctagtggcgttttgttttggtttttttgagacagggtctctgtctgtcaccaggctggagttcactggcacgatcacagctcactgcaacctcctccacctcccaggctcaagtgatcctcacacctcagcctcccgagtagctgggaccacaggtgcatgccaccacacctggctaatttttctattttttgcagagacagatttttctcagtgttgcccaggctggtgttgaactcctgagctcaagcaatccatcctcctcagcctcctggagtgttgggattataggtgtgagccactgcctctgccaagctagtggcttttattttaggtaactgggtggaacactgtgttacactggaagatgcctaattaccaaaatacaataatatgctgtgcaaccatgtttttttaagatacaaatctttaatattaacattttgccccaattttttgatagtagttatagtctatgtatggactttaattttgttttatgttccatgtctccctcccagcagaagacattgactgtcttctagaacatattctcttccttgacaatttattttctagtttgcagacatttgatataatcattgttttgctgatggacttcctttcctttttttttttttttgttattgtagatttaacccttttatgcctttactattattttaatgggtgtctcagtggggagaataaacaaacacatgtaatcatgctgctctcttaaactttaaagggttacatttagccaggtgcagtagtgcacacctatagtcccagctactcaggaggctgaggcgggagaactgcttgtgctaggagttcgaggctatagtgcctatgatcccgtgaatagccactgcactccagcctgggcaatataacaagaccccgtctcttaaaaaaaaaatactgataacttggaaatactataatgatacaactaaatggataatgtctataataacgatgtcatatagatatgcacacttttatgttacatgtgttaatatagtgtactttgtgaatattttattgtagatactttgcctacttactggactgttttatttgccattcataatccacttagaagtaaggcaatctagggatgatttttagcaactagtgttatagggatctttaaccagatctcaaattctttttcaccagctaagaaaaaatccttttcaaaagagcccctaaaaagtcttgtgcaactgcagtataggttctttataatatatgacgacttagtgttttagccaagatacaattttatataaagttaaatgtatttataattgtatcaataattataagcttaagtggaaatgaaacagattctgtaaaattcatttgggaatgaaacttcaatttttttaacaaaataaggaatatttgatcaaaacagatgaaacagaaaactccatcaatttcgttgaagttttctcacagaattttgttgttgttgttgttgctgagaccatgtcacccaggccagaacgcagtgatgtgatcatagctcacggcagccttgacctcctgggctcaagcagtcctcccacctcagctgcctgagtagctgggacttgcaggcctacaccactacacctagctaatttttttttttttttaaaggtgggtttttgctatgttgcccaggctggtctttttttcttttttcttttttttttttttttttttttttgagatggagtctcgctctgtcacccaggctggagtgcagtggcatgatcttggctcactgcaagctccgcctcctgggttcatgccattctcctgcctcagcctcccgagtagctgggactacaggcgcccgccaccacacccggctaattttttgtatttttagtagagatggggtttcactgtgttagccaggatgatctcaatctcctgaccttggatccacccgcctcggcctcccaaagtgctgggattacaggcgtgagccactgtgcccagccccaggctggcgttaaactcctatcctcaagtgatcctcccacctcagcctctcaaagtgctgggattataggtgtgagccacagtgcccagccccagaattttcttatataaatgttttaattagtatgtgaaacatcaaaactgttgccctttgtgtccactgttggccagaatggaccaagttatctacaacttgtctgttccattgactacactaaaaactctggacaagtttacttatttgttttcttaagtatctaaatgaggacaatgaaaagcaaactatagcaggcaattgagaaatgaagtgaaaacttgaatttgaataacagtgtatcatatgtgttcatttcatagagatctttttccctcctttgtctcccaggtttaaccctgcgggcactgcatagcaggtgcaggtagcaaacaatctaagagaaacctcttgtatctaaccagaaaagcaagaaaaggggccttttgctccaaaaccagttccatttgcagattacactgaaatagtagcagcttaggcaccaaaaaatctctagaaaatacccatatctctggctaggggaactagaaaatagagtctgttttccaagaaatctgaggtaaatcaacatcatttttctgtcttgccacttctactctgaaggtggtcccagtcgtggtgtaagtgcagaacattatgggagcccccagtaacttggcttttctagccggaggaactagaaggtgagacaactggaggttggaaaggcataggggaaattttgagagcgatataaaagatgcttcctaattctgtgtgtagatcaaaagaagtcctgggttcaaccttgcactgggctcaaccttgagcattgcatgcacagcacagacacaaagaaccacagcaaaggcctcaagaactaaacatcttaaaaaccaccatccaattcccagcatgtgctgagcagagacaaaaagcataacaaagcctttgaaaagtgaattaatgttggaactgctgctcaaagagggcaagatggaacttttagtctgaacctaaacgggttgagtgcctgctaaaacaaaaacattttccagagaatttttaacagggcctaaagtctctgcaatataatgtccaaaatgtccgggatacagtccaaaattactcaacatactatgagccacgtaaagctgactttttattaagagagaagataacagatgtcaagatgatctagatttcggaattatcagataagacctttaaagcagctcttatagccatgatccatggactaaagataagcgtgactgaaatcaatggaaaggcagaagtttttagcagagaaatctgctataaaaactataaaaaagaactaaatagaaattttagatttagaaaaatacaatattaaaagtaagtttatcagatgctcagtagctaagtggagataatagaggaaagagtcagtgagattgaagatagaccactggaaattataaaatctgaagaattgaaaggaagaagattggggagtcagaaaaaactggattgcagggatctgtgggacaataataaaaggtcttaaatttgtgtcattggtctcccagaaggaaaggaaaaatactgctgtaagacaaaatttgaagaaataatggctgggacttcccatgttaggtataataggttcaggaagttcgttgaatcccaagcagaaactaaaagaaaacaatatcatattgtaatcaatctgctgtaaatcaaagataaaaaatcttgaaagaagccagaagagaaggacacattatataccggggaacaaaaattcaaattatggcggatttcttcttagaaactatggaggacagagaaagaaaagaactatcaactatcaactcaccattttatgtccaaggaaaatatcctcaaaacagtatagtaacaagagcaaagtaaagatacttccaaaggaaaactaagagaatttgctgctatcagatctgcctcaatagaaatgccaaggaagttcttcaaggtaaaattaattataccagagagaaatttgaaattgaataatgaaggaagggcaaaaaataaaaataaatcgtcttttctgttttctcagccacttgccaaaagaaatgctaaatacctgggtaaatagagcagactgtttttcctctgctgaaattctttaacatatgtctatttacagttaaaaaaaattaacattgtcttgtagatagtcattgtatgttgatgtaatacatatggccaatataacagaaagggagggtaaggaagccaatagttaaaaagctgctttgttttactctgataatatagaagttgttatatatattttgaaaagttagatatataccaaccactacagagagggtgggtggagatactcccctaaatgtctcctatatataggactgataattattatagactttaataattttgtaaattaaatgagaatactaaacaacattcaaatataggttgataatctctaattcacagcgctccaaaatctgaaactttttcagcaccagcaggacgctcaaaagaaatagtcattggagtgtgttgtttttcagtttaggatgctcagtcagtatgtattctgcaaatattcaaaaatctgggaaaaaaatccaaaatctgaaacacttataggcccaagcatttcagataagggatacttgactgtcatctgaaaaaaatggagaaaagggaaaatagaagcatgaaaaacagacaatttaaaaacagatgataaaatgatagacttaaaatctaatcaaatcaatcattacactaaatgcaagtggtataaattatactaatccaaagggagatactgtccaatgacattttttaaaaaggatccagctgtatactctggataaagagagtatctgaataacactccactttaaagaatatcccagcagaatgtgtattttattcaagagcacatggaacattcacagaggtagaccatattctggaccatgaaacactccttaacaaatttgaaataagaatcagactggcatggtggctcatgcctgtaatcccagcactttgggaggccaagacaggtggatcacctgagatcaggagtttgagaccagcctggccaacatggtgaaaccccacctctactaaaaatacaaaaattagctaggcatggtggcatgtgcctgtagttccagctaattggaaggctgagacaggagaatttctggaaccctggaggtggaggttgcggtgagctgagattgcaccattgcactccagcctggacgacagagtgagattccatgtgaaaaaaaaaaaaatcatacgaagtatgttctcacatcattaagctagaaatcaaataacaaaaatatctaggaaatccctaaatatctagaaatcaaacaacacatgggccaagaaaaagtttcaagggaaattagaaaatatttccaattaaatgaaaatacaccataaaatttgtgggatgcaggtaaagcagtgcttagaggaaattcgtagcattaaatgcttttactggtaaaaaaagaaaggtcctcagtcaatagtctaaacttccaccttaggaaactacaaaatgaagagccaattaaattcaaaataagaagttgggaaataataaagagtagaaataaaaagaatgctatgcataactctacaacctaaatttgaggacttagataaaatggaacaactccttgaaagatacaagctaccaacactggctcaagaagagatagatagcatgaatgctcctatatctgttaaagaaattggatttgtaattttaaacttttgacaaaagaaaactctgggcccgtatggtttcattgacaaattctaccatttaaggaataaataataccaaattctacaatttctttcagaaaataaggaacacttctcaacttattctatgaggctcacattatcatgataccaaagaaaaaaacttagaccaatatcgtaagtatagttgtcaaaattttcaacaaaatactagcaaatccagcaatatataaaaaggataatgcattgttacgtagtacagtttattccaagaatgaaaagctgtttgaatatttgaaaaagtcaatgtaattcactaataatgacaaaagaaaaaaaatcacatgacagcaaacacacaataaatatttggcaaaattctgcatatatttctgtaaaaattctcagcaaactgagttgaaggaaacatcattaactgggtaaagggcatttgctagaaatctgcagttaacatcattcttaatgatgaaggaccttttgcttccctgtggaatcaggaacaaggtaaagacatctgattttaccattcttattcaccatagtactggaatttctacccagtgcagtaaagcaggaaaatgtcataaaagacatacagattctaatagaagaaataaaactatctttatttgcagacaccaggttgtctgtatagcaaatccgtggtgcctaccaaaaagctttttgaactagtgagtttggcaaggttgccagatacaggataaatgtacaacagtgaattgtatttctacatcctagcagtgaataacgggatataagtagtttataaaaagagtgccatttgtaatatgatgaaaacagtgaaacattttgccataaatctaacaaaatatatgcaagacatgtaagctaaaaactaaaacattgatgaaagaatgcaatgaagaactacattaatgcagagatacacattgtattcaaggattggatggcccaatattgtttccatgtaatttctccccaaacatatctgcagattcagtataatccttctcataattccagcagcatttttatagataacaagctgattctaaaattatatgaaaggcaaagcaattagaatagccaaaacagtttcaaaaataacataattggctgatttacactgcataattttaggtgttcctgtaaagctacactaatcaacactgtgtagttttgaaggacacatggataagtaagacagaatatagagtccagaaattcccctccacacacagggtgcaaaaacagttcagtaaagaaaaagtagcgttttcaataaattgtatagaagaattagccatatgcaaaacctttaacctacatatctcaagtcttttacaaaaactaactccaagtgattcagagacttaaatccaaaacctaaaacaacaaagctttttgaataaaatataggacaaaatctttgcagccttgagataggctacgagtgctttaacacaactccgaaagtgtaatccataaaagaaaaaatcagtaaataggacttgatgaaaactaaaaacttttgctctgtgatggatcctgttaagagaatgaaaactcttaacagatacagatacagactgggagaaagtgtttgaaaatcacatacctgacaaagtgcttttatgctgaacaccttaagaagttttaaactcagtgtaaacaaatttaacagttttttttttttaaatgagcaaaggatttgacacttcaccagagaacatatgtatgtgacggaaaagtgcatgaaaagatgtctgatatcatctattagggaaatggaaaataaaaccataatgcaatactactgtacacctattagaatggctaaaatcaaaagcaagaaccatgagaacatggtaactgcaagtactggtgaggatgcagagcaattggaattctcatatattgctggtgggaatgcaaaatgacacactgcctttggaaactagtttggcattttcttataaacatgcaattaccatatgatctagcaaatctacttctgagtatttacccaagagaagtaagaactgtgttcacacaaaaaaagctgtgagtgtgcatgtgtgtgtgtgtggcagatttatttatttattactcaaaattggaagtaacccaaatgtccttcagctggtgaatggataaaaatatccatacattggagtactactccccaacataaaggaatgaattattaataaacagccacatggatgaaactcagatgcattatgctaagtgaaagatttcagaatcaaaagactgcataatatatgatatcatttatgtgatattctggaaaaatcaaaactataaggacagagaacagatttgtgttttctagggcataagcaaggaggagggagagttcaactacaaagagacactacaaaggaatttttggaagtgatagcaactcttctgtgtgtttattttggtggcgattatgtgactgaatgcatttgtcaaaactcatagaactctataccaaaaaaatgaattttactgtatataaattaaaacataaatgttaaaaaagtggagacaaactcattttgagagactacagtgtaaaaagggagagagatttactattttatattttaagaattcagaacagttttctgttaagcctcatgtgcatgcctcagtatcaggcaaacacttctgttaactctgccaaggataataggatttagagccaaagggactcctgaaaattattttgtgcaaccccatcatttcataaataagtaaactgaaggctcaagaggctaattgtcttccaaggctctaaatgtagttactcttgctgctttctagattttctctttgtctttgtctttcagcagtttgattataatgtgactcgatgtgactctctgcatttaacctactcggagttcattgagcttcttggatatgcagattattatttatttatttttttttcaaattggggaagtttttacctatttttcaaatattctttctttaaacaccttggaactaatgagtctctcagcctgtgctgaaaggttctgtgtgcatgttgcagcttgccttcagcactcagccagtcatttgacatctctgccttagccttcactttctgcttacctagagcctcaggattaggcacagattagttagggccttctcatgctattctgagcaggctcacagcactaaacgtgtgtgaccttctaaacatgtatgaccttctagattcctgtgtatatgtcacaggtttttaaagctcttctgaatctcttagctctcagctagcttttcctttaaagccttttggttagtctattgtttgtcccaattattatcccctgtcttgggcatccatgaagttaaaatacttgcttctaattgttttagacaaacacatgccctgccttacatctgggagaaggcatttctcatggggctacttcacagagtcagattaaatatgacagttttataagtggagtcttcagggaatgattatttgggaattaggctttgaaagagcctcagctgtgttccaccccctctagtggctgccagatggtgccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatggaagagcaaagttttggaggttcttcaccatggtcagtgacatcatttcttggttttgctcttgccccctctttctttctgaagcatcataaggattagaatgatccttgtgttgatgagttctctttgtgacatgttgaatgatgctgtctgtggcacatccaggaaatgtctaattcacagctgagtttcggaatctggatcttgatgtagtcatctatttatagatgatagttaaaacaaagtggattaaatagcctaaataaagcatttataatgaaataaccaaagagcttctatatttgagttgataattgctacaggaaaaaatgaaaaatcactcattatgcagattggtgtccctataaattcatggtctcaaatctcaaccagtttctcagaactgcctatcaatcttagtcgtctttgtcagttttctcattaacttaattattatctaaacctccttaagtcttcttatatcccttgtcactccccttcaacctcgccttactctcagttttctacttaaagaaaattaaagcatgacttctctcaaattatcatctttccccccttattacaaccagccctccttatatgtggattcctcatcctcagattcagccaactagagattgaaaatttttgaaaaaataaaaactgtaaaaaataatacaaattaaaaataatataacaactatttatattagtcataaaagtaatctagagatgatttaaagtatatgggaggatgtgtgtaggttatatgcaaatactgtatgcaccattttatataagagacttgagcatcaaatgatttggggatctacggggtcctgggaccaatcctagtgtataccaagggcaactatctacttttacccccaggtaaatgatactggaaaatgtagggtactcatgaaaagactttagatattctaggccgcgtaggtaagaaagagtgtaggagggactgatagactgggagtaaggtaggggtgtttcaggaactacatggctctcagtttgaataacttgagtccttacattcaaaaatgattacagttaacccttgaacaacacagaggtgaggcaagtcaaccctcaagcatttgaaaatttgcgtgtaacttttgactcccctaaaacttaactactaatagcctgctgttgactagaagccttaatgatcatagtcaattaacacgtattttgcatgttatatgtataataaaccagattcttaaagtaaactagagaaaagaaatcgttaggccgggtgcggtggctcacgcctgtaatcccagcactatgggaggccgaggcaggcggatcatgaggtcaggagatcgagaccatcctggctaacacggtgaaaccctgtctaaaaaaaaatacaaaaattagctgggcacagtggcggcctgtagtcccagctattcgggaggctgaggcaggagaatggcaggaacctgaggggcagagcttacagtgagccgagatcacgccactgcactccagcctgggcgatggagcaagactctgtctcaaaaaaaaaaaaaaaaaaactgttaagaaaatcataaggaagaaagaatatatttactattcattatgtggaagtgggttttcataaaggtcttcatctttgtattcaaattacgtaggaatttgaggaggaagagaaaggatcggtcttacggtctctaaatgccacacatttaaaaatgtccctttagtgggttgaattgtttcttccaaaaagatatgtttaaatcctaatcctagtatctgtgaatgtgaccttatttggaaatagggtctttgcagatgaaatgaagttaaaatgaagccatactggattagggtgggccctaaactcaatagctgatgtccttataagaggagaagacacaggggaaaagtccaggcaaagacaaaggcagggattgaagcagtgcagctacaaaccaaggaatgccaaggattgccagcagtcagcagaagctagggtgaggcaagaaaggactcttctctagagtccttggagggagcaaggctgggctgagatcttaattttggacttctggcctccagaactgtgagaaaataaatttatgttgttttaagccacccagtttgtggtattttcttatagaagcccgaggaaactaatatattaccttaatttgctcttgaaattaattttaatttataaatatggaggtatattatcaaatgacaaacttagaaatagcattagtaatttaaaaagtatgtttcatacattgtcatagcttagttttgagagtagcaatttgaaaaacagattataggcagaactctgacagttagataactgactcttgataggtgcttcagatacagaaagcttaaaagatctggtttattccactcatccattccaatctatcattccatttgaaatctcagcaaattttttccaagggaaattactgttaagaatattaaaatagtaagtagtcgaatgtagtttctggaacattgtatttaaatccttttaaaagactacattttcttaatgtgataaagcatggtattctcttagataatctaggcaaaaggagcattttttttcctatactcagtttattaaaaatttcttgggatacattgagattttcatgaagaaatgaaatttgaaatttgttcttgacgtactttggatatttgtaatgaagatgttttacatatcttgagccatatattaggtcagctataatttattgggctttaaattttttataaggttatatcatatgtaactagattagttttctattgctgccacaacaaattaccacaaatttagccgcttaaaataacacacacttattacctcatagtttctctaggtcaggagttcaaggggcctcagctgggtgctctgctcagtttctcacagagccaaaatcaaggctttggcaggactgcattccttactgaagaccctggggagaaacctgcttccaaagtcgtttgaattgtcagctaaattcagttcctttctgttgtagaatgtaggtccttgtttccttgccagctggcagttgggagcctccagtgtttacacttggaggctgcccacactccttctcatactgtccatgtggccccctccagcaacagcagggcacgtttcccctcactattctaatctccctgattctagctaaagaaagctcttcgcttttaagaattcatgtgattacattacgcactactggataattcagaataatatccctatattaagctccataactttagttagatctgcacagtcccttttaccatgttacttaatgtgggaaacacacattcgcctgtctgaacccaaagactgcacttggagacacaaagaacagcaaaagcgagacttttaatggtggtcttgcaagatggggcgtatggtaggcaggcacacccagggcagttacagcagttaatttacctcctagcatgcaaatccctcccctagttcctcataggtcgagtattacagggttacaatcttcccggacatcatccaagtttcattatccccctaataagggtgtaatcttcccttccctgcttaagtttcgatttcccaataatgaaactttcttcgcttttatgggctgaccccttctctacattctgtttgctcattgtgaccttctaggtgcgtgagccgtgcagtttgttacatccgcaggctggttgccagtatatttagatttatcatgccttgaaaatagatcatttaaaacattttctcacaaagtccctcctcttttctgtttacttccttcggtctcattttcatctaaatcctttttgtccttgaattgctctagaagtcttttactttctccataggagattgagtttaattttgtttctaatagtaccaggttattttgctggttaagtcatgggcatttgtttattaatagctgttttaatctctgtgctagtccccccacacaagggttaatacaaaaatcccactgctgttaagacttctgccacaattatgagagatgtaaggattgagggctaccatgtctttccattttccaaaccaatcttctagccaacccataaatgggtcatcaattccagcattttctgccagttcattggctagagttgttggtcttcgtaaagcttttctgatggtcccatctggggcagtattgttgggaatgaaagtacaacatttcccacccagcataacacatacgccccctttttctgctagtatcatgtctagcgcaagcctgttttcccaggccatttggctgatggcatttagctggctagccacccctttgaggatgtcccgagtataatcgatgaatctctgttgattataatagatgtagttaatctagtccacattcttaatagttgaccaccagaagagtgctgacttaaaccgagctgctatttggtttcgggccttaaattcattaggcacccccccccccccggaactcctatagagttaacatatatattgggatcaaaagatacgtcaaatctctccggttttggtagccgtgtgtattttcgggtatcttatggaataccaggatgaagggaatggccaactggactaaagcacaagtcccagtccaattggacggtaacaacttatcatccttttttcccacagtaccaccagacatcagccgtggtgtatggagagctgagtaattgccattgcctgactcaacctgtgatgcttaggatgtgggtacaagttgagagttctcccatgggcttattgaactctgccccctgcctggagaggcaagaggagtagttcatattccctgtagagaatgaggggttctgacctctctccacaatgcgggaaagagcaatgacagactcttacaagtctcattttcccatgcatccttgtctcggtatagagccaacatgcaacacattacttcaggatcagtattccatcctaggggaaatggaaccacccatgcctgaggtcctcccgcagcacatgcatagtagttactcttgttgagggcttgtaccaaaaatgtgacccactcaacccaggcattcacatccccataccctcagtttttaaggtttgctttacatcctttacctcaattatttttagccttttaggatcattatttggtggactaaagtgtttactagggcctgggcttggagtagtaccagacacttggggggttgagtttttgatgagtttgagaataaatcgccctacagggtctttccctgtgatgtctgcccctaacccatataaccaagagtcttccagaactggggccagcccatgttttctttttagatttttctcagagttaactttaagggttccttaggtgacccatgcactttccactggtcttttcccctcctttccagggtctcctttaccagtcccttgactcgagtatagtgagtccacctcatgcagctgttcgcatggctgtctcagtggtcaggagcacttgatagggaccttcccagcttgggtggagcttgtcttctttccaagtcttaatcagcaccaagttaccaggctgaaagtggtgagccatgaactcaagaggtgaagtttgagttagaagtcgttttaacctaagggatgacagggtggagtatatggccactatataatttctttaaaaattgatccttggtttccatagccggaagatctgtagctctgcgcaaatataggagcccatataatgactcgtagaggggcaatcccaagtcttttattggtgcttgttctaatctaaggaatgctattgggggacatttggttcaaggcattttagtttttaagattagtttggtgatatgctttgtgagagtttgagtcattctttctactttccagaggaagggagatgccaaggggtgagataatcccatttaatttgtaaaccttccataattcaccttaacacccttgaggtaaagtggcttccattgtctgaattaatattttccatcagtccaaagctaggtgaatctgttttaatattattttgaccacattcccagcagtggctgttggaaggggaaaggcttctacccagcctgaaaggtaatctaccatcaccagtaaatactttagtcttcctactttgggcatttctgtgaaatctacttgaatgctttgaagtggtcttactccggaggtcttcctgttttctaatcacctttttgtttatcttttgacaagttaacacaatttccacatgcttgtttagcaagggtataaatccctatacacccataattcctaagtattgtatcacacaaagcctggggtccccattgactccatttgtgtaatgtagatactagttttctcattaggggtttacttatttcaggaagtacccatttgccatcttcagtctgagtgacccctgtcctgtctaattcttcctcctcctctctggtaaactggggccttaatactagcttagggatgtttgggagcaggctacatagtctaatttcttcgtccagggaggcttgcttagcagcttcatctgcaagcctgtttcctgtagcttctatagtgttccctttctgatgaccatttacatgaactatggctacctctgctggaaggaggaggctttctaaaacctgtttgaccagttccccaggtaccaattattttcccctgctatttattagaccctgctctgtccagattttttcaaaagtgtgttccaacccattaagcatatttagaatcagtatatatagtgccttctttggctttaaggagctttatggccgggttaagaccatataatttacagatttgggctgaccagccattaggtaatctacctttctcacatagggagtgtttatctccatcagtgacagcattgccatctctcgttcgtcacaactcatccacaaagagccttatcccatcatgtagtggagcttccctaaggtttggtcctactttggtttgttattctatgatatctaagcagttctggtctgatgtctttgatctcctctcctttccataggaaactggctgcatttaggcaaatatttgttgttacaagcaaataattttttttcttaataatatggcttcatattttatgaagaacgtgttcaaactatctcccggcttttggtttaatatattcctgacctggtgtggagcgcttactattagggccccaacaaaggttagctttctactctcctaccagcagggctgtggcagcactgcttgcacgtatttgggccacccctgagagacaggatcgagaagcttggaggcaaaagcaacagattccctcttccctccccaggtttgagtgagcaccccaagggtgatccactgttaccaacagatggaatggtttctctaaagatgagaggaccaggaccggggctgtaatgagggcccgctttagctcttttaccacctgaatttcctttgaggacaattgcaagggattgggttcttcttttagtaacttgatatatagagtctttgtcttttgatcatatgagtcaatccataacctatagtagccagttaaatctaaaaatttttggagttctctttttgtcttaggcaaaggcagacccactattcccagtattctctctgggtttattcttcacatcccttcactaatcaggtgtcctaaatatttaacttctttttctgcaaactgcagtttgttcttagatactcgcaatcccctttctcctaggaaattaagcttgtggtggtttctgatacctcggtcctcctctccccagaaattaaaagattatctatgtattgtaacaactgggttcccctggaaggttgaaattcctccaggactttttctaagatttgaccaaatacgtttggggcttctgtgaaaccttgtggcagcacagtccaggggtactgttgttttctcctagttatagcatcttcccattcaaaggcaaagaggttccctaatcctaaagtctaggggacatgcccagaatgcatcatttggatccaccacattgaaccacttacgttcatagggtatcttactaaagagggtgtagtgtttagtcaccacagggtggtaggtctggacagtttgatttatagcccttagatcttgtagcaatctatacaacccatcaggctctttgggagaattggagtattgtaacatgcagggttttaattgtccatcgttaatcaatccctctattaccagttggagaccttttctcccttcagtggaaatgggatattgttctctgcaaactacttctggttgttttaggttaatctgtaagggtgtgatttttaaccctctgttgccttccctaaccctcacaaggggatttaatttttctttcctcctcctctgtcaggaggcccatcattacttttatttgtccttcctctattcctaatcctaaacccaatctcacaatcaggtctcgacacaggaggttagttcctacttcaggaacaagtgacgcctcaatttgttttgctcctgatgtaattaaaattttcttaaatattggaacctgaaatccctccccttttacccctgatactttcaatttttccttagagagttctgtagcccttggttggtgaattagggaggagtgagctgccccagtatcaaccaaaaatgtcacttctccctcaggtcccaccttcaaatttattaagggttcctggtgggatctactcagaaggtgctcctgcccccgactagtcttcatcaatagtcatgaggggtatcaccttttcttttttccatttaggacatcctctcttcaaatgccctgtctttccacacttgtaacatccactcatagtcttaggaccttttccctgcatttcccttctttctttgtgttgaaatctataattcccttgtctcctaagtgggggatcttgatgtaagtcttttctgactacctcttccacagtggaaaccatgatttttgctttttgtttctgcttctcttcctttctccttacaaagaccctctgagtttgcctcagtaaatcctcagttggtttctctttccatccatcaatcttttgtaattttttggtaatgtcaggccagctcttaattacaaagttaaccttcaaaaggcattgccctactgggtcctctagatctaatccggagcattttctcatctgatctctgagcctatataggaatgcagaaggagtttcctctttttcttgttgaatcgtgaatgtgtcctatgtcctacgagtggactccttgatccctttaattattagttcctggagatcctacatttgggcgcagtccctgggatcattattatcccattcaggattaacatttggaaatttttgtttggctggtgagacttcttgcctgggagggtgttgcctctcccagatggtcatgtccactctcctgatcattcccctttctcttcctatgaataggatattcttgatggacatcatttcagcccaggtgtaagagctgtatcctaggaattggtccagatggtctgctaaaccgagtggatcttctaggagtggtttcatttttttcctgaaattcctaatttcaatacttgcaagaggagcatttacaaagccagtctctccctgtcccatgggaactcccctaagagggaacatgctaggtgcctgctgtgtggaaggaatagggaagttctcaatatccctcttacagtgttcttttcttaaatttggataaggatttagaggagcagttggtttggctccgccatggtgtccaggtctttcctcctctaaccctcctgctgccccttgattttcctgtcccctattttgtgagatgtatggaggggcatggatgatagggtcccagggcttttccctgggtgagggatttttactaggctctttttcttcttctttaagtgggaatatggggctaattccttgatccagcagagagcataacctgtctcttgtgaggttggggttttattattcacatagagaattaaagcttggcacacctaatttttatctgagccaaacttaggccataggactatgctggtaaatgtcagagggagtctctttggctccctctttcccttgtcccctaggcctagaatttctgtttcccatttttggtcagtctgtgtctgagcttttccctgtgttctcagcaccccctactggaggtttcttgcacacccatggaatcacttcatccattctctggccattctttgtccattctcctcacgggagaacggaaccatggattgggactctgcacttgcttcatatctagggtacatctcagtcacacacactcaacctctgaaaatgcccaaccaccaagacagtacttacagtccaattttcctcccttggcttctgcacgaggttgcctggttgctgcagtgcctgcttttctccctgtgtcgcctctgctgcctcctgaataacagtctcaggtttgtctgtggcttctgtggggagccaggatgcccggacagagtgggccacccaaatcgggtgggacacctctgccctctcggctggagtcccactccatgcaggcacagagatcccagacaggcccccaggtttgtgagaaacacagattcacctgtccaaacccaaagaatggacttggagacacaaacaatggaagcgagacttttaatggtggtcttgcaagatggagtgtctggtaggcaggcacacccggggcagttacagcaggtaatttatttcctagcatccaaatctcactgcaacctccaccccgcctggttcaagcgattctcctgcctcagcctcccaagtagctgggattacaggcgtgcatcaccacgcccagctactttttttgtatttttagtagagacagggtttcaccatgttggccaggctggtctcaaactcctgacctcagggtccacccacctcagcctcctaaagtgctgggattacaggtgtgagccaccgcgcccagcctaaatacagtttgtttgtttttttaagtaggccactgcctccacctttgtacagagaaatcccaggttcctcctgtcagaacctagctagaccctggaataagataccaagaccaggcttgccaactgtggcttggcatagagtttgtgtttgacctggggtcagggccttgtctacacactttttttttttttttttttttttgagacaaggccgtgctctgtcatccaggctagagtgcagtggctcactgtagcctcaacatttgcattacatgttgatttatataattaatggatggtgttgcttattatcgattgattgtgaatctggccacgacaaatttattctaattgtttattttctcagattatttatgtaaatagtaataactgtaaataataatctatttcaatttttttcttccagtgattgtacctcagttcattttactgtcttatatgttggcttcgtcagaatgtttcatattatgttgaaaatagtaatgatatatataatagcattcttatcttgttcctgatgtataaagtaatagttcagaagtttctccattaattatatgtaggggtatagcaggtaaaagaaataaatttttattcctggtttgccaagagctcttatcaaaatgtgttaaattttatcacactgtttttatgcttctgttgaccttttttttctctcctttaactttatggaatcttaagtcatacaaagtattttatttttgtgtagtcagatttgtctattctctcttttatagtttctaaataacctgttgtactttttaaagtaccttcaaactctaggttatagaaatattttcctttttttttaatacttggttttaaatctttgtagcatgtatcttggtgtgtggtatgacatggaggtgcatcttctttgtgttacttcagatggatgtttaatacaatattgtattgagtgcagtgctcctgtaagttttaatatttgtttgtaacaataataaggaagactaatggttttttcaaagtttactcaaaagtaaaagcacacacgtaaagaaaaagagaatgtaaagaaaaagagagaatatctgacgtggaccaacttgagcctatagattttttttattggtaagtcaaaagcagggccaagaaaagaaattatccaaattgaattttctcattatattagtctgttttcatgctgctgataaagacatacctagactgggcaatttacaaaagaaagaggtttaattggacttacagttccacatggctggggaggcctcacaatcatggtggagggcaaagaggagcaaatcacatctcgtgtggatggtggcaggcaaagagagaataaggaagacacaaaagcagaaatccctgataaaactatcgtatcttgtgaggcttattctcaagaacagtatggggaacccacccccattattcagttatctcccactgggtccctcccacaacatgtgggaattatgggagcacaattcaagatgagatttggatgaggacacagagccaaaccctatcacttattacccaagttttatcagactgggaaaacaacatttcagtcccttaagtaacaattttagagggaagatctacggctaacagttattcattgtgcacatcaggataaaccagttaaccaaattttgatatgcctcatttattatacacaaaaacaaaaaggcctttttgtttttagttaacattaaactagcttttattccaaaacaaagaagtcggtccagtaaaactatcttatattttgaagaaaacatatttaagaattgctttggacaacagaaactgttatcttatgaaacctaaaaactttattaaattctgaatgtagcatgtgcctgcctcccatttttgccttgtaaagaactcagtatgctattaaattattaacttagtttatttgaaatagttccaagatatttcatgcctccaagattaaaactaaaacccaggttagcagttttgaagaagagtggacatgagccttgaacattatatatatttgttacatctgatagagatattttaaattgtctgctaaaaaccctcttgctttgtagatgggaaaactgagagttccagtggctatttacttgctccagcttttatttccagttcatagcagaagcaggacttaaacttcaggtcttttcgtctcaatcacatggtctttctctttgcattgtgtatttgataacgtttttaaataaaacaaagcattttgcaactagtgaaactgtacaaaaagtcatataatgtgaccagaagggagattattaaaaattataatttcacttaagcaaaatgtgtataacgccatttactgtttttctatgtaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgt

SEQ ID NO: 16042 - DNA, 7772 bp, Human; identical to SEQ ID NO: 12027

SEQ ID NO: 16043 - DNA, 23148 bp, Human
ctagtgcctctgtggcttcctgctggcgggcaccgcgatttggaatggcgcattaaccccgcgcctccatgctcctccggtcggaccgccagccatttcgcacgcacccgggagctggcaccggcggggggcttgaggggggaagctcgcgttccccaggtcctagctgccaaagtacctttctgggctcattttgcatggcctggtgcagttttcctgtgtctgcacatcgcgacccagaacctagctttttcccgagtttgcaaaccagcccgcgaggcaagaggcgctcggtgctgcaggtcactaggagtttctagtccctacaccctctcgagcccaacagctgcatagcgaacaaacagacgctcaggagatgtaaaatgcattagtctctgcagaggtgggaggtggcggccgaattaaaggcttccccgggttgcctgcaccgggacagggagtggggttccgggtagagatgaggactggaaccctggaatggaggcgggggtgcctgtgaactaatggctaggaaaggcactgaggtttttgcattaacctgggttttgcatttccctcccgcatgggaaaaaaaaaatcgagtttttcctaagaaccgttttatggagccggtcgaggggataggataatcgactgcacgaatctcgcagattccgcttgaggagattctctctaggtcactagtgccctggagacgaaccctgggattaggaaggcactggataacactgcaccccaagatgcctcggttcttccccgtctcctcattggttggaactcgcccccaaatttacagcccctttttctaacccacccccagctgcgtggccctcctttgtaggggtgtgaggattgagaagccaaacagagcccacctcgggctgaaaagagctgaaccccctactctgcgccgtaccacggtctaggccttccagtgccagagcacctccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtaaagcatttactgagctcttactacatgttccgctagagcttgtcatgcgtgatttaatgttcataactttaagaggtgggaggagtattttaaatcgaatcagtgctttgggaagttaagtaacttaaaccagatatcccatacaggccaaaagtctccaagtccctgctaacttcttgctctcgcaacagaatacctatttaggtgggaagaatgaggtgtgggcggcaggctgggtgagtggtgcccccgagcctgccctcgactagccagaagcccggttgggacccgaggcaggggaatgcgcttgattttatttccaaagagaaacaccgtccttgcttgggccgagggctcgttcaggggcctataggagctaccgggacaagaaggggaggtctctggttggggtggaggacgaagggtgggaactacccgattgccccccaggaatgggggatgttgcgcaccagtagaggggactggacaggaatcgtggtggtgggggtggggggttaactggaggggacagcagccctgcttgaaactctgacccctaagaccgtgtggtggagaagggcagctgcaacctgaaccaggagtgcgagctgctcctggggcgcgctgaggagggagaagcgaactggggacttgcaaggagggcaggagtgcccgaggagccgctggcctgcagcggtgccggaggagggcggtgacgaggttggagaggggcgcagggacccgcagggagcccaggcttaacgtgcattctgcggttctctcccccacctcccgcctgcccgcgcaggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactgtaagaaccgttccctccccgcgggggggccgccggcgagaccccctcgcacccccacccgcagccagccccgcacgtaccccaagccagcctgatggctgtgtggcctaccgacccgtgggcaaggggtgcgggtgctgaagcccccaggggtgcctggctgcccactgctgcccgcacgcctggcctgaaagtgacacgcgctggtttgcccagcacagaggggatggaatttttatgctgctcctttagcattctgatgaacaaatatcctccccaccagcaccaccacctcagaaacacacacacagctgtccccttttctgtttcctcacctatacacactcccagtttttctttgcttccaaagccctttatctgtgtgtctgtgcctggctgtgcttaattctgagaactattgcactttcatcctaaactgcgcctgcaaggcgagaggccggcttttcacaaaagcaagccagaggcagagaaaacacagaagggcctccatttccagaacaagcgtctgggtaatgtcaaatctgttcagaaaagttcctctgttcagaaaagttccggttctagaaagacttaaccataaatagtgctggctgggactagggacaaagactgtagctcactccacgtgagacaatgctaactcttgagaaaaaaacccaggttattcttattagaaaataagtctgtgatttacctctcaaaaattaacatgttttagaagcaagtcaattagggcatatcagctgtgatgtgatctcgttttccctccactcctcagaagcttgttgcatgaagtgagagaggctacattacatgtgatagaggctgttgcagaggcataatgtcaacaaagatagcaatagaaaatttcacacaaccccaaaataaagcaggaatgagctgtgtgtaactaggataccaccctggctactcttccctccctaacgccacccccagaattatccctctagtaactttgcgcttgaaacttactatggtcataaccacagtagtagtcctgcagtagtcagctgtgcgctgagtcccccaaacccaatggccttggctaggaaacaacccagtaaatgcaatgtgcttattttatgcttaattatagcaacaaaagcaccttcttccacaagtcccaagaaagatagaaagtggatttttttataaggcaaattaagacttcaaaaggaagttagggaacatggttaatcctttgaaactaaagtacctgttccaagagtgtctgtcaattaactgtataaacctactttaaaggcttttatttccatcacaaatttagtgtatataaacgtttctccaacagaaactttaaaatgccccttagtgccgggtcttccaaaactggctattcattcactcaaacggtctagacaagagggacaggaacacagtggcagataatagttctctaacccagacgttgccaagagaaaaatgactgtgcctgattacaaagctgattaattcatggaggtttaattgctgtattagtgccctgttcaactagattcatttaattctggctcaggctcctggctctgctttcaactaactctgtgactttcaggcaagttactttagagctcaatgaactgtaccataaagagaagcctttctactccacaatcccagtggctatgagatttgccccttggcctttatgtttgtcctaaagtcctttgggaagaatctcctaagaagagattggagtcacctggggaactttaaagactactgatgctaggtctcaccccaggagattctgatttagttggtttggggtgtggcccaggcatctgagtttttaggtgttccccagatgagtctaatgtgcaaccagacttgaatcaccatggcttgataatacccaagaaaatctttggctcatataaggtacaagtagtcacaaagcaagcgagttaacacagattgcagggataagggcatgttgtagggaagagggattgcttcccttttccaaaattgatgctgtgtcatcagtgaacaagattctcactactctatttacatttgaacagcaaaacacaccccattgtgttttgtctgtgggaagacccaatagatcccagaggaaacctgaaaaagaaacgttcccaaagagaaactgagctgcattctaagccaaattgacttctttccagatatgtttgattcggtagcaagctgtcaagtgcagggaaggcaaaataatgacagtatgcagactttgaacactcaaccagtgtcaacacgcctctgtcacagtgctgacatttatatcctgcactgtacatggtgcaactggttaaggcttatgtagaaaaacattaagtcaccacatttcatttaaaaatagaaagtatcataaattctgattcctctagttccatccaaatacttgtaacttaatgattgagcaaaagagctttcatgccacattaacgtcattctgcgcttttcacaggaggaccagaatatacacagtttgcacactcacctttaagattgcatgtgttccgctggttccaatgtaaataaaacatccagaattctattactagtatgccctcagtgtgagataaccaaatggaattcataattggccaacgggcttgcctagaggctggctgtaaagtaaatggctcaggactgcctcctgtagcaacttctagcctgtctaaactcaaggacttgtgatttgacttttggggtacccaagacttttctcttttgctatctttatttgtttattttgctttttgccagtattttgccagtattttgctttttgccagtttccaaagggcaattagagcaggcatgaggaatctgcaagttgaaacttgcaaatgtcatagcattttcgagctgaaaggaaacccctctagtcctgaaacctaaagaggcaaagcaacttgtctataatgcaccacagttccatgatcacaggaggcaggtctgaagctgggaccagagtttcccccaaactactgaaatgtactttatatgggaaggggaggatactttatatgggaggaaggtcttgaactaatgatttagaccatggtgcacaaggttgtctgaatttattgaaggttagttcatcatagtcatattccttatctcaactctaaatgtatttaataagtaaaagcataaaatgcatgtggttttaaaaatttgcatctaaatgcacatatacattcaccaaatagttacatgtatgcctgtctgtgccaggcactgtcctaagtgctagggataccttgatacacctaataaacaaaagtcgctgccctcatggaacatagcttctagtaaatgcacatgtgtggtggtatgaaaaaatcaacgtgaaagaacctcagtccagtaaggtgggctgaattttttgtgcaactggaaaccaactaaaatgacattgagcatcgttaagttgtaattacaagtaattcctaatttagtataatataatgggattatattctaccagtttggtagcagttcacaaaatttcctatggaaacaattttttaaattaagctatcaagttttcaggctagcccacaaaaacctatgtaaaccacgatataactgaactgtcattcacaatattactaagtgagagtctctgccctggggggcacatcccataatctgcaaaaggagggcacagaacaagaaatcagggaggtttcagcaagcaagagctcaaggtaacacattcagaccagactaggatttggaccccagccttgccacttaactgagatgttgagctgttacttaacatcccttaagctttgttttttcttccctgtaaaataggcataagagtaaatctgtctcatgggttgatgtgagggttaacttagatattgctttgtaaagcctctgctccataaatagggatcatagttgtcatttgccaccctcctgcttgcaatggcccctccctgggcacccagtgaattcacttcttccgctacgacatctgccaggatgctgctctaaatagtgggatttcagcagcacaacagagtacagcgagtgagagaaatgcaggccttgtgggcaggctattttgggccccactgttggttggtcagcacgtaggcagtccaggcttgcctgggattctgcccctgggtcagctgcccctggctcttcccaggtttcacagctccgacccttccccagtttccaagcccatatatttccagtggaatttttttctcaccaaactcctatggttatgttagggagacctcttccgtcatgggaaggagggaaccaaggcagggtaggatctttctatggaagtgacaagagggttgtgagttggaggctacctgtatggagatggagcgtatctttgtaaatgatccatcccagctggacatttaatttaagaagtttcataaccctagcaaaaaatacttagtaaactgtgagaccacctctatagagctaaggaagcttctagtgcaacaagctgggtaaatgttaagctttcaaatctaatgttatgaaatacagaatttagaatgaacaaacaccatctatctgttgtgtcttatcgcttagggactgtatgaatgaacaatactttaacaaagtaactacctaagctggaaaggagctctgccacttgggatgggtctcttggaatcaagaaactgcacatcagactcttgtaggaggcactgattctttacttgagatctgagaccaatattctcattctggccccagtctggaaaaccatttcaaactgttactgcttagagaaatctatttaaggcttaaattgatttggccagtcaggaccttaggctgacccagggcgtgagcaatgtactcaacaggttcttcttcaacagatataaaaattaaagctccctgatattttcccctcctaatatctctttgatctttgtttatttaacactcatggaccatagcaccttcatttgattaaaatacttgttttttagttaattacttaagcttaatcaggaaacaaatattaaatatctttcatgtactgggtgccatgcggcctcaaaaaggctaaatttgtaaataaagttgcttgtgatctagctgtaaactattgctaggtggatgggcggatggctggatggatgaatagaatgtcagtcagatagatatgtctattgtgtagggtttaggtgagctgtacgcatgtgtggtaaaaattcctagcagtgagctcactgggatttgggtatcatagcagggacgacttcagggaagagggaggatttgacctggtacttgaaagatgggtgtttggaagggaagggaaaaggaaagggggacatactagggagtagcatgggaaaatttgtgaccatgatgtggggaagggacagtggaacaaagaggaggacagaccagtctccaagttctagaaagaggtgctaagaagtggtgggaaattgaagatgtcttgacaggtgataccagattgtgtgatactataaaattcaggaaaggtgtttgctctgtttttgatagcagtggggcacccatggagcaggcaggtgactacaaggcgggatcttgcttcaaagctgtcttgcaggagaagttacctaaatacccagactgcttttgagtggggcctatgccgtaagcatgtcttttattttgaggtgttgtgcttttatttttaaaaatcttctagacataggcacaattgaaccaaactattagccccaagtaagtgaatatctgcaaataaacacttaatattaaagttaatgacctagcaccttttaactatccacatgatgaacacagttcttgtcctgaaatcaagtaagtttgagctctacaatagaagaggagatattattatccccattttacaggtgaagaaaggagacctagagagttgttccgggtcacaaacctagtaagtggtgaagccagaatttaaacctcagcatgttggtccgaaagccaatatttcttgactttacacagactgtgtgtgcatattagtgaattaagaaaatatagactttggcttgcttaaaaatgcactcactaaccctgaaacacagatttccaggaaaattaagcaagcaaagagaaaagagaagcagagactatcaaatttccttttggcccttttaaaatctccatttgggctgcggtaggcttaagccagtattactaatgactacttcaaagtccagatcaggatgtttttaagaagagaaacatgaatttctctaagtattcctataatattgatgctttttgcaatgagagaaggctccctaactctttgcaacaaagcaaggtctcctcaagtgcttggtaggcagacagcattcgggaggccttgtgggagactctggttctcagatctctcccattctgcccagcgaggggatggcatccacataggaacctagtgtgactgcacgagtgccagagcgatggcctcagtgggaataggagtatgcgtaagcagacttgggtcaccactgggaaacaactggttagctcagtagaggcaaaacccacttttgcataactttaataacaaaattgaagtagagaagcatggttttaaaacaatatggccttccaatttttttgcctgcaaacctgcaaataagaatgttgaaaaacgattacctactttgaagctttctaaaatttttcatcataggtttaaatagttacaccagatgtcatttctagccctttcaggaactgtatatatgctttaaatattcttttggcaaaactttgcacctgcctatgtagtttatttagttcatggaaaatgatcaaactaatcagcccaaatcaattggctttttggtcagaaaaggtctgacttcattttcaattcaaatgtacatgttaatatacaccccatgacaactgtcacaattctggatcctaattgtaaggtagagagatggataggtgaacagtcagataagcaaagaaagcactgaggcttcccaaggggcctggccaggaggaaatatggagcaactggcttcaggatttcttggtttattcacaaagttatctccctttgcaagtgtttgtagcacagtgaacacccatacatccttcactaagattaacctcttttttagcattttgcctcgtttttttctgaaccatttgagaatttgttgcaaacatcagaatgttaaatatttcagtatgtaccttctaagaacaaggacaatgtcttatatagccacaattcagttatcagtctcaggaaatttaacatggatataatactgttatccaatagatagtctgtgttcatatgtccccagttgtagcaattatgtcctttatgttttgtttttttttttttaaaacccaggaccataaattgcatttgactgtctggtatctttatacttccttaatctaaaatgattcccaagtctttttttcccgcatgacattgacatttgtgaaaactctgggctcttttgctagctgtttcccagactacccttcagtttagatctgtctgattatttccacatgattagatgtagggaaacatccttggaatatcatattcatggcactatgtcctcacatcaggaagcgcccaatatcagtttgttccaaggagccattcatgcatgaatgcctttgtatggcgcctgaaggtgtttatccctgggacaggccccacaatagaatggctagataggtgagaagcacaccgtctctcagtaaggataaagagggattggaaaaggggacatgggcaaggagaaccacagcaggagcatccgcaggcagaccagacattttaggacatggcacatgtggaaattgaggaaatggacatggattccctttcaaccacccataggcactgcagaaagtcttcctgtgcccccagagggccaggtgcctcagtctgaagacactgctctaagccatagtggacacaaagataaccctcatgggctctggggtctgctgacatttgcatgtttagttgtcaggcattttgaggaacacggaagagctcacacagcctcccaagacgggcctgtggcttctgcccacaacccaccatgccaggggctccaggccctgcacagaggtctctcctctgtagaacatgctagactaagtagggaccagtgtctggatccccttttgggcaatcttgctttgtctagagactgtagagttggctttacactgctgccttctgtgcaaatattgctgaaggaggatcccagatgtgataaccatattggcctacattaggcaccatttgtgaaatactttctgtggaccaggaactgagctgaaatcttttcttatgttatcatattaattttgacctgaaggtaaaggtgtgactagccccatttgaaagatggggaaattgaggcttacagggttagcagcttagccagggtctggacacagggcagcctgagtccagcactcacacttgtcactactgcacaagatcacttcctgccagcccatgacactcagatgtcactcttctgactgcatcaaaaagtcatcaaggaaaaaaaatcagggaatgggtttggcaggtaaagttgttttagaatgataaccgtatctcattacctgaagagtctttgagattcccgtaaattcactcactgggggtagaaattccctcctcatatctgaccacaagaatctaccaaacaaattcaaatgataaagaagatttctttcatcttctcttagtccctccttcttgttcaaatcactgagacccttacatgccttttacctactgctcagtgggtcccctgggaagagctgagggatgctgagtgcagaatcctgcagggtcctgcagcctctcaggctgggggcagggcttcgctgaaagaagaaaggagagactccaccacccccacaaccacctgcctctgataacaccacagggatgatttgccctagtggctttttgtgcacttaattttactgggtaactttctcacccttccctgttaagttttttataagggcagtagcagacctcctggtgtgtgctcattagcttgtggtgtttattaccgactctggagtgcttttagctcacaccaggtgttcatggattagctaacaaatgaacaccctgttgggtgttttcctgacttaaaagctgaagaatggacactttccacccagggggactgtgctgtattactgtaaaattattagcataactgtaataaaagcatggaccacatacatagaaatcagagcaaggtgatcagaacctgagtaacaaaggaatttactgtctgtctctccctgagtggggttttctggctgtttgtattgatggagtaattttcagtccatttattacaaatttgcttagttgagttgtaggataacagtttaggatatagtacaactagtatgtgcaatgtcattcagagtgggtggagatggtaaataagatggcattttgatgggcaaagtggcttttctaagtacacccatagcttctttttctatattctaaagtgatttgcattctggttggtctttttcttctgccttgagagaatccagaaatgcttttttaaaacaacaaaacagtggtgtttttacaacgcaaatacttttcaaataaatcgatgtcatgccttactgtcaacaaaccactggtcctgaagagaatgcactggtagctctggaaatggtcacaatgacttagtaaattgcctcagctggtaattgtttttaggaaaatagatgctgtggacacttctgaaagttaacccaacagcagcctatgatcaggacggtctaccaaacactagatgaattctgtgtccaaaataggaaagcacggaaggtcattacataatgtaagatgcatcagcattcagtgcttactgatctatgggccttttttaaaaagtagttcaaataagtgtcaaagtcatcactttgaaataggagcagataacaaaactttacagaagtttttcagagaactagaacattctcataaactcacatttagagtccattctcatggactgcacattttagaggttcctgaaggtcaaataagaacaagagttgacagcccagagattggcttcaaggacaagctgcttggctctcctgatccattttgtaccacttgcagtgggcaattctagccttggagtcataagctgggtatgacctaagcatacttgaagcagcaaaaacagaaatgaataaaattgagattcgaagaaaatggtaaattgagtgtttgacttttgggtgatggagactgaaggaattgtagcgtgaggctgtagtgtgtcctctcaggggtcatggggcccatctctatttttacagatggaaactgaagtttaagaatgccttacagtagaatctggatgctttcatatgcagatacagggccctttctacacatcttttacctctcttaaatagggcacaggaagatgacttgatgatttaagagaagattgatgacggtcatttcaaatgtagccgagacattcagccaagaggtaaactgaagaggtcaagcactgcagagttctaaaatacctcctgtggggttttatggggcccctgatggtactggctgagctgaatgctgctggggcgtcagccagaggtggtctactcccttgcagaggtgactgaaaaacccgtgtctggccacactttccagccaagacttagactctccacactttagcattttggagctggaaaaggccccagagagcactgagttgacctcagaagggttaagtgactacttccaaggtcacgcagctgatcagggactgacccaagactggaatccgggcctctcttgtctccaactctgcagcaagagcctggtcatttggtgccagcatgagttggaggagcttccggagatggggcctctctgtctggatctgctgctgtgctggctgcggcttttccggttttaactgggaaatcgccagagctgtcttagcgtgatatgcaagaaccaggacacaggagaaatgcccctgagtagcatggcttttcctttttgggagacaatttactgtattctgtggcccatggcagcctaactttaggatctacttagcgtacctgagttcgtactgaatttttcaacagaaagtatgtttctcacctcctgtgctgactttggtaaatgtgtacaggtgaaaccagcatgtcttgctctcgtctcagagtaaattcccatctgctgcaagacttgaagagctcagtggtagtagagtttttactttaaaacaaaaagacaacaagtttgagctttgaaactgaaccaccaggtccacatttattagtcctatggacttcaccaaatatttgtcttctctgagcctcagcttcctgagctgtaaaatggagatagtattcaatttagccttgaagggaggttgtcaggtttaaagttaatgttgtgtgaaagtaggcagtattccacctttacactggtaatgttttttaagtgcttcaaggaagctcttatctaagttatagcctgatgaaattttgtaatgcaagaagttttacaggttaaactcagccatgtagttcttgtaatgatattccaatattagtgaaagaaaatcatgtttgtaacatatagaaagataaaaataacttattccaaaacaatgacattcattgggactcttcttgagaagttgtatcaattttaagttgatcttttcttttcatataagtatgtatatgtgtgtctctgtgtgtagacgcatatgtatgcacgcatgtgtatgtgtatgtgtttatagatcgagagagatctctatatttttcagatacttggcctgtagagcaatttgcattttacctgcaatataggtaggcaaagaataccagattaaatgtctcccaccattagggggttttccattttcctcctgtctgaagacagcctttcataggaaccgctacatgtcaggatggatggcaccgcacctcggcagccgcaggtgcagcatcctgtggcctcatcctcagcatcctgccccatcccaaaactgagccccaccatctggccactggttcctgatgtatctctcacttgtgtggccttggctcaggcagcagctcacccctatgggtcccattagccctcacccttccaggcacagaagctggacactatagtgaagtagcaaggctgttctccccacagcaagaaacccctgagccttctctctggggcccctgcatcagccaagcccggctcatgcagatctcaagcctggcctggaagacatctcctgaacaggaccactgtgtgtactgaggtcaggccccctctctcctgggtccctctgagcctcaaagaccttccttccaccttctggataaggagttgtgtcctcaccactttgtccctcatagacaactttgtgccatctccctctcaggcccacaggttggggacttaggatgacttagaatgaaagtcagcttagactccctgcctggccaggctgaggaggggacaaccagctacaagtagaaaaatgaccctttgattaaaatatagttaacctgtactgttttaagacaaatctggcattttacgaaaagactttgtccactcttgccagcttaaccaatgtaatgttttggattatgtaattttgagttcagctattacagggaggacttggagccctcaccattgttcctattaaaactcagttgactttacaaaatagtcactatctcagtcctttgttcctgggatgacattactattttttttccccataatcgagggcagcaaagtctttgcggtgaactgtttgttcccagagttgtgccccggtacaaggtttcatttctttaagtaacactatttatacaaagaacacatcaaagttaaaatattttaaatagaataacaccaaaacatttggttgcactctgaaggatagcttaaatgcatttgagcactttggatttccaaaaactttatattttagatggacatgttttccaagatatatcctccaagcaggtctgggaaatgagcaaagatatgacctattatttttttaatgatgctcctcttttgtggtttgcaagtatttcactattaaagttaataaatgagggtcatttgcatatctgacattctgccaagccttttaaaggatgaagacagagatgcgccagtaagtcttaatttagggaacgaatccaaacccagacccctcttcttttccctcagctcagtgaattcctggaaaatggaggcagctgtgggcatttcagctcatcaccaggagtttcttgtctgggctgggtgagaggcctctgcagaagaattaaggacaggctcagtgaggctgcccagcatcctctgcagaggagtatggcgcctaatgcccccaggtgcctcgcatcgataaattgaggctggctctaagaatgaactcatttagtcggaacatgcaggcctatttgccctgtggtttgaaaaatacaatgttgccctttcctggcttccagaattcatatccatgtaaatttttcagcaaaaattttgttgtttcttctatttttcatgactatgaaggaaaaaaaagccttcagcttaataagagttgcctatggcctgaacttggggtttaaataatatttccacattagcaacaaaatgtgaaggagatttcccatcaaaggaaggaattttcaaaagccacatgccaggaagactttaaaaaataataataataatagactttattttttagagcagttttaggttcacagcaaaattgaaaggaaggcagagagttcccatatactccctacccctacacatgcatagcctcctccattgtcaacatcccccaccagaatgctacatttattatagttgatgaacctacattgacacatcattatcactcaaagtccacagttgacattggggttcactcttggtgctatacatcccatgggtttggacaaatttgctatgacgtgtattcactatttacctgaaattcaaatacaaccaggctttctgtattttacctggcaaacaaagcctgtgacaaagccatgtggtcaaaatgtcttaaaaaggggagaaaaatgtttttcaagttcttccaagtatcaagggctaaaaaagaacactataagtgctgattcaaatccttatgattgtaactctagtaataaaaagttatatatcatatagattaatgagtctctaaaccagcatgatttaaacttctgtgactctaatgttttcctattagcttatattaaaattttagtaatgttttaccctcatttctgattaatcttcagttgattgttaattgaacttaactttctatatgcccaggttcctaaattaatgacttatttagaattcttgaatagagcctatgatgtgagtccttttgtaaaacagagtctctgttttttaatttgaagactcttctgtattttgattaatcactcctaatagatctgtttcataagttccgatttatatacaagcatgtttttttttgaaactgggcacatctgtatttatttcctctttaatagcttattattgaaagaaatcaccaatagctaaagcagctcatttttttttaagtcaattgtttctgtcaaccaaagtgatttaatgttgttgttttgttttgttttgaaagaaaacttcctaaagaaagttcagtgagaaagcagtacaaaggaaaggacaaattaagagcactcttggccaggcacagtggctcactcctgtaatcccagcattttgggaggctgaggcggacggatcacctgagatcaggagttcaagaccagcctggccaacatggtgaaatcccatctctactaaaaatacaaaaattagccgggcgtgatggcgggcacctgtaattgcagctacttgggaggctgaggcaggagaatcacttgaacccgggaattggaggttgcagtgagccgagaccatgccattgcactccagcctgggcgacaagagtgaaactccgtctcaaaaacaaaaaaaaaaaaaaaaaaagaaaagagcacttccctgggcccccttaagaaagcattactcagggaccagagagctttaggagacccaggggaggtgggcactgagagttaatgctgctgcaaagctgcagaaagctgaggaggaaaggtggtttggagacagtccttcagctctctggtgggcaatgactgtgccactcagggcagagtggcttttctgagtaatgtgggctgtttactttggagcatttcatttcataacgatgcagttttcagctaaagtcccagagtccccttgaaaaattaagaactctctttccgcctagtaaaatgacccgactcattcagccagcagttaccgtaggcctccacagcctactcaagcacttggagatccatcagtgaacaagcaggacagagttcctgcctcttggagttgacattcttttagagaagacagactataaataacaaccctaagaaatcagttagatggtgtgttagaatgtagcaagaattatggtggagggggaggcgcagggcaggggtatctggattaggggctggggaggaatcttgttttaaatagggaggtcaggtgggacttgtggatagtgacatttgagcaaagacttgaaggagatgtgggactagccacagggtgggagacatttaatctggtattctttgcctacctatattgcaggtaaaatgcaaattgctctataggccaagggtccaggcagagaggggacagccagcacaaaggccctgagttcttgactgtttaagctatagttctcaagggatggtgttgcccctaggggacatttgcaatatccagagataccttgatctgtcatgactaggatgggggatgctatgggccttgtattagtctgttttcttactgctatgaagaaatacctgagactgggtaatttataaaggaaagaggtttcatggactcacagttccacatggctggagaggcctcacaatcatggcagaaggcaaaggaggagcaaagtcacatcttacatggcggcaggcaagagggcataggcaggcaggggaactgcactttataaaacaatcaggtctcatgagacttattcattattaccagaatagcacaggaaaaacctgcccctgcgattcaattacctctcactgggccccctcccacaacatgtggggattatggcagctaaaattcaagatgatatttgggtggggacacagccataccatatcaggcctctcctggatggaagccagggatgctgccaaacatcctacagtgcacaggacagcctcccacaatgaagaatgacccagccgaaaaggtcagtggtgctgacactgagccccgtgtttgaggaatggtaaggaagccagggtagctagacgggagggaacaagaagagaaacaagagaggaggtcagaggtaataaaggctggaggagaggggcagccaggtcaggtagggcctttagggccagtgtggatttgggctttttctctaagagtaacagagagctattggaaggttttgagcagaggaggttatgttctgcgtttaaagtatccctctgggtgctgggtagaaaatagatcgaaggtgggtaagggtagaatgaggaagcccagttcaggggccactgtggttatccaggcaagaggtgacagggcttcagccagtgtggaaacagctttgtgatttccgtgcagctgatcctgccaatgctaaatttcagatagcaactaggcattctacggattccaatcaccagtcttttcattattatatatcatatgttttatatattacacacacacacacacacacacacactctacacacacgtggttaagttgcttttgctagattttgttctataggagggatacctgatatattttaacaattaaataggttaggtttatgacaaaacaatttgacatgggttagacataatgtaatctttctatgctttaatacaatcttggcaaaaaacatttactcttgctgacaactcttctttggtttatttctctaagccacttagaatcctaaacatactaaatgacctgaaaaatgaggtgaggggggcataagaggcctactacccaagaaacaggtgtttggattgtttttccccccgtttagaaatttattacattgttccattagttatttttctctgctgacttgatcggccaaagcaaacactgaaatccggcagaaagcactaagagactgctgatttatactttcaccaaaggtctcagacatcttagtgtccctgcatccttcctccatgtgatctccctaatgagcctcttgtcctgcttgcagccagacagtgggagccatgtgacagcttgcagctgaggctggacctcacccttgggggcagggctgcttctatgcacgaacagcatctcatttcatttattgctgtgatacataaatgccattttactctatcactggacttttttgttaaagtcatgctgttcaaaggaagcggtaaattagtctttttgttagtaaaatataaactgttttcctgttcctttatgatttttaaggaaattttaaactatagttgcattcctgagctcttcatttgttctgtcagaatggttcttgtcccactcagccacacagaatcaaagcaagtttcagggaagagcactcagtattccagatgaaggtagccatagtggaaggcctcagttttttcaccctctaagacggtgtctctcaaagtttagtgcgtggatctttggtgtgtggatcttttacattagaattccttgaggcttgttagaaatgcagattccttggtccctccccagaccaaatgactcattgtctccaagggtagggccaagaatctgcatggtagtcaatatccagggtattttcctgcatattcacatttgagaaccactactctaggttgtgtgactaggcaagaaaaatgcccctagaagattggccagctcacagcaagctctgcatggacttgttaaaaatggtgaatgttattcaaatgaaaactatgcttctaaggatttgttttcttcgagaaagtatgtcaccaccacattagtctcctcttccaactaaatcatctttcttctgtgcatttttgcctctgtttttggggattacagtggtcctatagcttaatcggctgatagttttgctgtgggtccaatttttgctgactttaggggggcactttgatcttgaagacggcttgaaatgatcattttgtctcatgtgccattttctcttttctttttgaacagcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcg

SEQ ID NO: 16044 - DNA, 19927 bp, Human
tcctcagctgaaggatgaaagagattggcaaggaagcaggaatgagtcagctttgggggaatattacctggtggctcccatcatttattgcttaggacatacccttttacctacttgctatcatgctggacctcagcatttcagggaccagaaaagatggggacaccaatgcaagcccaagactaccatccagaggaccgttcctgcccatgctgctttctctagttttgctttcagagtggtgtcaccccacttgctaactcaagagtgcatcactaggcttcctgagcaggtttgatcaggatttggcctgggtctgttggtcagggaggcagaggtgtggggagaagggtgaaaggtgactgagccagggttccaggctcctcactcacggggctgaagctgggcatcgtcaggctcagagcccctcgacgtgcggcagcggtagcccttcttcttgagcacgtggcagatcatgaagcctaccaggcccatgaggaagaagaccagcacaagcaggaagagcatatatagcccatgttggggcggttccaggtcaggctgtggttccgacatgaggccctggggggcgagcgcgggccagggcgcctcctgggtttagggggctgcagctgggaatgggggaggggtaggaatgccgtcctcaggatctgaaacaagcacgtctaagacgtccggctgaggtccggccccaccccctacccaaccagggagctgtccgggccaggagtgctgtttcgcctttcggcaagaggtcagcggcaacgcaagctctctaccacgaccctggtcccgcttccccgacgccccgagcgttcccctttccagcttgttcgcgcttctgtccctcccaaggacactgcagcacgagatgggacggcattcttaggcggcgggagcagaaatcctgcctgagtcagcgcccgcacctcctccacgccggcctgagccaggcctctgcagccccttcctctcagtactcccgcacccctctccctttttggtttctcccaccctgaccacctggccgacccggtaccggtgatttggttctggttccggcttctgctggggttccggctccaggggcgtcctagtgcggctcagggcccccgacgcccttccggcgctcatcccttgattcctcccctcccccttcgccgcctcaccggccccgggctgtggctgcggatacccgcgccgtggcaggcggggggagggaagaacagagaaggatgcgggctggctgagagcggtggcaggctccgggcaactccggccctgggtcagggagatcgcctccgcagccgccctggcttcccaaatgccttcacccgtcgcgggcccaggaccagggggcggagcgcaggtgtgcggggcggagagcgtgagctctgcgcgcgcgtgactgcgccgggcccccccggggcaatgtgcggcgccgagtctgggtccgggtaggggacaggcggtccggcgtgggtgttgtccactggtctatccggtacgcctggcgcagctcctgccctcagatgccccgaccgagcggagagtcaggaatcttctccgagggctgggggaagccggctttccgcacctttgagggacggagtggcgggatcttcggagcttcctagagaagtgaccacggcctgcgcccggtttggggcaagcggctggatgggatggctcggcttcccgaggatctgacccccggccggagacaaatggccctcgcatcctaggagctatgctgccagttccctgcccaacccgggacgctcaaagccccagataccgggagagctgagccgggcgaggggcggagctcccctgggggcgtggcctgggtgtggatggaggcggggccgcaacgcccagttccgcagaggccggctacgtgcttgcgcagcacgcacggccggggaggggctggcggcggccgcgggcggcgggcggcggaggtgcggggcctgctcccgccggcaccatggccaagaccgtggcctatttctacgaccccgacgtgggcaacttccactacggtgaggaaacagggatatgcatgaggggttgggacacggaggttttgaggcggggttgcaactccaggggtgagagctgacgaactctcttctccccacccccaggagctggacaccctatgaagccccatcgcctggcattgacccatagcctggtcctgcattacggtctctataagaagatgatcgtgagttccgccgcctcggccgggggttggggggtggggcgagctgtggccgtagggataggtgggctggactgagtgcatgaagtgcgacccgcccctagagtatcggggagctggatagaagtcaccaggagtaccttgaaagtgcagggtgttgggggtggcgtcctctgcttaatggaaagtactttctcacctcaggtcggccaccctctgactgtaggcacactagcccttggcctagggttagcgtgatgtggggctggtttgaagacagaaggtgtgttcctcctctgcattttagagtgtggatagggccttggcctcaggaattagggttaggggagcggatatcactgtatcagggtgtgaggtttaccctcagttcccactcctcttttaccacctttctttacctccaaggagctagggctccagggtggaacgatgctgccgtctttgtaaatgtgtatgtgcgtgtggaacagaggcgatattttagatattcctttttcagcctggaatacctctacatggttctgcttaatcgctatccagtttttcatctaccagacatacacatgctgtcttcccagcttggaatttatggctgtgatatgggatagtaacagttaagccacgccaggcgtggtggcccatgcctgtaatcccagcactttgggaggttgaaatgggggggatcgcttgaggccaggagttggagaccagcttgggccacagtgggacccacatctacaaaaaataaaaataaaaaaagtagccatgtgcggtgggtgtgcctgtagtcccaactacttgggaggccgaggcgagaggatggcttgggcccaggagtttaaagttacagtgatctatgatcagcagcctgagttgacagggaggaccttgtctcaaaagaaaaaataagacaaaacagctaaacccaggctttatgtgttgctagggaaactagtgaacaatatgaatgaatgttcattgcttgtgccaaggcacagacaaatggactggtcatagaaaagactgaggtgatgttagtgcaggaatctatatcccttgagattgtttgcctgtatgtacctgtgtgcattttctgggagaagaaaagctctttcttgtgcagttttcaaagaggtgtgacacatccccctgaccttccaaagataataaatctttgattttaattagaaagttgacatatatcccatatatttgactccagaaagaagaatccagaggaaagaggacagaatcagagcttgggggaggagatgagcatggagagaactgggaataggagattccaaggaacagggcaggtggatcagggctcaaagttgagaaggtacgataggctgagctggaggtggaaaggaaaagaagtggtcttcagggggctcatttgtaataacttacctggttaatcggagtctctctactgacttaaggattgtgggatgaggggaatgctatgtttggcttcatatagtctccaggactgggttcagtatgggtggtctgagcctgtggagtggggctgaccctgcctgggttcatcttgtgtctccatcccgaggtcttcaagccataccaggcctcccaacatgacatgtgccgcttccactccgaggactacattgacttcctgcagagagtcagccccaccaatatgcaaggcttcaccaagagtcttaatgccttcaacgtaggcgatgactggtgagggaggactgggagttttgatgtctaacagtttaatgccaagcccttcagtgaggtcttttggcagcagtgggaagatctcaaggggggcctacttgtcaatgcatcataattcattttatttgtttattcaataaatatttattggtcacttgttctaggcaggccctgtgctaagtgctgggaatgcagtgatgaacaaaaacaaaattttaatatcgtatttttgctaagtcttataaagaggaggtgtatgacagattatgagagtgtatacgtggaggattgtttagcttggtggagtggctggtcggtggggccttcctagaggaagtaaagattgagctgagatctgaaaaaagagtagaagtaatcagatgaaagatggttggagggtgaggggagaagtatagcaggcagtagggacaagtgctaagggtctgtggtaggactgagtatgactcatttgaggaacagaaaaaaggccaagtgcagagtatgaagaggaggtgaactgaattgaggctaaagaaataggaccttttaaaagcaaacagctctattatgaattggggtttttacccgtagagtagagggaagctatcaaagtgttttaaaaagcaagggatcttaagagggctatgggcagttaaaaaaacaaaaaaaacaacgaaggagtggtttgatatcattaggtttacattgagcttgtatcatccatagaagagtcagggttagaccctctggggaagagagtggacaacaaagataagccacactctactctatatccatgaaaaaatagtaaccatcacagctaccagttgctcaattctacttacttttgtttttaaactttttattagggaaaatttcaaaaatttctgaaagtgaagtagtgcagtgacctcccatacgtccatcacctagcttcaacgcttatgagcaaatggccactctttttttttttttttttttttttgagacagagtctcactctgtagcccaggctggagtgcagtggtgcagtcttggctcactgcaacctctgcctcctgggttcaagcgattctcatgcctcagactcccgagtagctgggattacaggcgcctgccaccatgcctggctaatttttgtatgtttagtagagatggggtttcactatgttggtcaggctggttttgaactcctgacctcaggtgatccaccagcctcagcctccaaaagtgctgggattacagacgtgagccatcgcacccagctgagcaagtggccactcttacttcatctatactccctcatgttagattgttttaaagcagatcctagatgttatatccttttatccataaatattttattatgtatctctaaatgatactcttttaaaaaaacatagtatcattatcaaacctaaaaagttaacagtgattccttaatgtcatcaaatatgggatcaatattcaaatttctgcagttgtctcataattattttgtagctaatttaaatccagatctaaacaaggtctatacagtgcatttggttgatatgtctcttaagacttttaatttgtagcttttctgtcacccccttgaatttatttcttgaagaaaccaggttgttgatcctgtagaatttcttatgatagctaccatttactgagtgcttactctgctaggtattatgccaagggttgctggtaaatccacttaattctcataccaatccttagatgtattataatagacctttttctgatgttatatataagtaaattgaggtttgggaatatctaggtaacttagccgtagtcacataactggtcattggagggggcatgatccagatcccgggtttttaaaccactaatctgttttcctgaaagatcttaatgacagaagcagccagggctgtaggatagaggccaactcattaggctggcattggcacctttccaactttatccctacacctcagctgcacaggatgccttcctggaatgcccttagttctctattcaacctcttcaaggccttctcagccttcacaccatctccatgaaacctttcttgaccacaccagcccatagagctctgtcttgcacacactgcactgctcatttggtgttcagtcacatgctgtttggggaggtttcttgtttttttgttagtattcctgctgttatttctgagctcactttctagctctgtgaatacagggtcagcccttacgccacactggggtcccgtagatgctctttgtgcgattagggaatgctaattagaatactatctctgggctatttatgctgcatcagtcttcctgtcaaacaagttacagttgtgcttatctgtatttccgatgagaatcaggaatttttcttctgtttaatgaatttctgattggtttcaaagtattctaacataagtagccaaattgtactataggcctttaaatgaaaaaaataaaaaagtagtcccaagccgggcgcagtggctcacgcctgtaatcccagcactttcggaggccgaggcgggtggaccacctaaggtcaggagttcaagaccagcctggccaacatggtgaaaccccatctctactaaaaatacaaaaattagtcatgtgtggtggcacgtgcctgtagtcccagctactccaggaggctgaggcaggagaattgcttgaacccgggagttggaggttgcagtgacctgagattgcaccactgcactccagcctgggcaacagagtgagactctgtcttaaaaaaaaaaaaaaaaaaaaattccagacctctccttttcacccataaatccctctgcccagtgacagccactttcagctcctttcccctatgtcttctggtatttacctttggatttctaaataataatattaattgactgttattactaatctgtaatccttaggtaatacctgttatatactaggtactgttctaagtgctttacagccattagcttatttaatctcaacaacccctatgaagcagggtctattattgtttccttttaccgatgaggacacttaagcacagaaaggttaaacagtttgtacaacctcactatcattagtaggtgttaaagaacctaggtagtctagctccagaatcggtgcttgtaatcatactcccctcctgtattgtctctcattgctatttcttcgtctgtcaattttaggcattatctgttaagcttttagtatgggatatgagcatttagtcttcttacaccatcacattggcttcctttcccctttcagcttcatagtaatttaaaaataaatcagtattctgtgtttacattattataactctgaaagattcatttactatcaagccaaatagtgtagtgtgatttaatctattttcttctaaagctttttgtttttcctggagctgacaattgcattattttttcatttgcttagttttctggtattaatcactaattctttccaagccttttgagaaactataaaaccctacaattcttgcttgaacccgggaggcggaggctgcagtgagccgagatcgcaccattgcaccccagcctgggcgacagagcaagaccccatctcaaaaaacaaacaaacaaaaaacccctacagttctgtttttcacatggtcaaatgtatcagctgcactattttttttttttgagacctaaaactagggattgcctaagcctttcctttttaaaaagtcaggtttatataggtataacttgcatacagtaaaattaaccttttttaggtgtaagagttctgagaggtttgatagaatatatcaaggtatagggccagcgccgatggctcacacctgtagtcccaacaatttgggaggccaaggcgggaggatcacttaggcccaggagtttgagaccagcttgggcaacatagtgagaccctgtctctacaaaaaaaaaaaaaaaaaaggtatcaaggtacaggaaatttccactacccaacaaaggtcactcacccttttgtagttaataacttctctgcaacctagatccagccaactactgataagatgtctgtccttgtattttaccttttccagaatgttacataaatggagtcatacagtaagtaggcttttgtgtctggcttcaagcctttactttttataaagaataacaatggtaataattatagctgacatttattaaaggctgagcggatactgtatactgtgctacaggcttttcgtgggttatctcatcactgtttcacatatgtaggtatacagttctttctttaaaatatgtgactgaaaaatattattgaacattatgctaaaatttgttacactgagaagactaagaaaaacagagctcatgttttctttcaactgatttcctttttacattgtacttgagtacctggaagctgcttgcttctttccgcagctaggatacaaactccctgacagttaagtgcttctttacttcccatccagtgccttgcacagggcttggtacatggtttggtccaaaatatttgttgaataaatttgcagatagcccacgtgtgtaggagagggagagaaggttcttgaaaaatggagattggaggaatctaggatggggagggagatatgggaagggcccagacagaggcaggagggttccaacttgttcctcttccctgcagcccagtgtttcccgggctctttgagttctgctcgcgttacacaggcgcatctctgcaaggagcaacccagctgaacaacaaggtgacatagtcccgagtcctgttcttcctttcctctggatccctggactcgggatttaaccctgatcctgggctcccagcttgaggggtgggcaggaaggactgtgacttaggtgtttgtctttcagatctgtgatattgccattaactgggctggtggtctgcaccatgccaagaagtttgaggtgagtgaggaggtgatgggaaagacagtggccatcctagggtaggtgtttaggatgatggtggggggcagctgggaggggaattgctcttctctttatgagaccactgtcttgccataggcctctggcttctgctatgtcaacgacattgtgattggcatcctggagctgctcaagtaagtagcccaggaggagatgggggcagttacgggattcttggctgaggaggtctctcagtctcaaccctgaccttgacctccctcctccctgattagcttctcccaagttcttgatgctttattcaggctgcctcttccactgctgcagattccctactgcctgctcacatttcagccttctctgcatatccctctcctgtccctgcctctagcctctaggctggagcccccagttgcctttagggaactggtgacattaagtttcaggtgaccagggcagaagcagactcttcacaattcgagacccggtgtttgagaggagtgggttggggggttcacttctagctcagaccctggctttggcttccctctaggtaccaccctcgggtgctctacattgacattgacatccaccatggtgacggggttcaagaagctttctacctcactgaccgggtcatgacggtgtccttccacaaatacggaaattacttcttccctggcacaggtatgggaatagggattactttcccctttgcacccttcagctctttactatgagtgcctccttctcagccttctagtctcatctcaggtgtcccctcctcagagaagcctttccttaccactccagttatcataatcacctccttccccattcctctgttacatcagcctcattgtttccctcagaacactcactgctatttgtgtttattgtggttttttgttttgttttgtttactgcctccctcctcctcatggctattccctaagaatataagcgtggtgggatatcgtaaatttcattagttccattcgttgctgcatccctactgcctagtacacagttggctcagagtggatcccccaaaactatttgcccaatgaatgcaagctgcaagagatttagtggctctagggagtttatggtgaagctacatagatggaatgagaggctcccagagtgcagattggggctgaaacagctgggttgtgggtgcttcccatgtgtggctaccaccacccacttccctacaggtgacatgtatgaagtcggggcagagagtggccgctactactgtctgaacgtgcccctgcgggatggcattgatgaccagagtaagtaccgaagtcttccctctgttccctaggccccttctttttctccttgaaataacctcttctgcctggtattgtctgctgttgggccagttgtccttaaggatgaatggccttcagagggaccatgaatctctggaaattgtatgcaacatatcatgtgtatgtgcatttttctgggaaaagtcattggctttcatcagtcactcatagcagtctgggatcccttccagaagtttcagaccagtgatttgattcttttgggtggcccctttcctgggctacatgctcgctcaaccccctttttccttttgttccctgtctccccatccccttggggtgccaggtgcccatctttggccctctcccaggttacaagcaccttttccagccggttatcaaccaggtagtggacttctaccaacccacgtgcattgtgctccaggtaatactgtcagttcctcctcaggagtgttctgcctgggcttggggaaagagagcaagggaagaggaggttctttaggttggtggtggaaggggtatctgtgatgttctgatcagttctgatcactgcactttcctggggttttgctttttgcagtgtggagctgactctctgggctgtgatcgattgggctgctttaacctcagcatccgagggcatgggtgagacttgctctccttcttctccccaaggtttttaagtggccttggacttcagtacgtgggtgggggtagttggggaatgggcctcacctcttcttggaaatcaaaaatagctacaaattgtacttgaactagaaatgtcatcttgaacagggttccctagatggtcattcattcacgatatatttttattaagcacctgttatgttccaggcatcataccacatcatggggatggaataaggagtctcccatggagtttacagtttaggaaacagacaaaaaataaataatcaaatgaaataaatagattcttataaattctgtgaaagaaaaaaagaaagctgagacacaggatacaatgggggacctacttgagatagcatggtttcggaaagtttttctgaggaagtaaaatttgagttgagacctggagactaagaaggagtgagtcataagaggagcagagagaagcctgacccaagcatggacaaaggcccacaaaaggctctgagggctgggcccagtggcacacacctataatcccaacacttccagaggccaaggtgggagaatcgcctgaggctaggagtttgaggccagcctgggcaacatagtgagagccatctctacagaaaataaaaaacaaaatcagctgggcatgatggtgcatgcctatagtcctagctactcaggaagctgaggcaggaggatcacttgagcctaggagtttgaggttacagtgaactatgattgtgccactggacttcagtctgttgaggtgaggtccgagaagctggccatggtgagattgtgcagagcctttaaaccctggtaaggagtttgaattatattccaaagatgatgggaaaccattgaaggattttaagcaggaaagtgacatgatccaatttgtgtttgaaagtgacaattctgactgctgaatagagaaaggtttgggtaggggggatggagatggaagtagaaagaccagttaggaagccatggtgttggttaggtgcccagactaaggtggagggggtggcaatggagagaagtagatgatctgagaggtgtgtgtgtgtgtgtgtgtatatatatatatatacacacacacacacacatatatatgtttttttttttcttttttgagatggagtcttgctctgtcacccaggctggagtgcagtggcacgatcttggctcagtgcaagctctgcctcctgggttcaagcatttctcctgcctcagcctcctgagtagctgggactactacaaaggcgtgagcaccgcgccgggcgtgagttatattttcaaggctagaattgacagaacttgggttgatgagaatagttgattagcaggcagggtgccagggagggtgttgagcagaacagaggggggactgtgctttattttaaaatttttattgagacacagcatataaagtatacccaaatcttaagggtataacataatgaatttcactatcaagataaagatttagaacatttatagttttcttgtgctcctttcaggcaatacctaaaggtatttaccttgtcttttgataacctcctccacatcttcctctggttccttttaacagggaatgcgttgaatatgtcaagagcttcaatatccctctactcgtgctgggtggtggtggttatactgtccgaaatgttgcccgctgctggtgagcactctcctgatttcctcccctgttgtccagtgtgagctagggtgtccctcagatatggccacatgggtccttcagcccacttggtcagcctgctcccctctgctggttggtttcaggacatatgagacatcgctgctggtagaagaggccattagtgaggagcttccctatagtggtaaggaccaccccacaacacccccataacaggaaggccattctcaccagattccagaatgacctggtttgaaggcacatgggaaattttacactctcagagctctgcagactaaacccctgggctcagagcagggaagagattgggcagctattatgtaggtgctctggatgggaaggaaaaagattgggaagtcttgttagctgcctttctcagtctgagccatactttctcctctcctccccaagaatacttcgagtactttgccccagacttcacacttcatccagatgtcagcacccgcatcgagaatcagaactcacgccaggtcagcagctcagaaaagctgagcacaaacttctcctgaaaggtggagcccaggagaggtcaaagatgtgggaagtaggaaaaaccaaagagaaggaagttctaagccatcacagtcactgttattgactaggaggcagtccagtttaaagtagaggcagttggggttggtggggagggagagctatcagttgggggacctgaactagaggtaccactgagatgaaaaccagtatggtaggggtaaaaggcagctaggagattccatgtcctgggaatctctggaaactgctcactctgtattcctcatttccaaccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggtctgggagcagggacttcagcctactttcaataggcttgctggggaggtttaaaagggaaaaagtaaatgggaaggtattagtttaattgcctctggcttacctcctttagtctgctacaatttcctcactcttttctttgttatttttaatgacaaaagtaacacgtatttattgcaaaattttaaaacagcaccaaaatatggtgttggcgttcacacaatcccagacctattccacaggagtaaccactgttaatagtttttattgttttggatagacctttttctatagattgcaaatatactattctgtatgtacatataaacaaacacatatacactcatttacagtttgtgtggtttttggtttttcgtaaatacaaatagggtcattctacgtatgctgctttacatcatatagctgttttcagctagctaatatagatctgcttcagtattttatcagctgtataataatttactatgtggatagattattttccatttttttggtattacaataataatgtggcaatgaacccccttacattatacatctttgcattcttgtttgagtgggttagatagtagaatggttgctgctaggtcaaaggctgtgtgcattaattttttttttttttttttttttgagacagggtctcattctgtcacccaggctggagtacagtggcatgattatagctcactgcaatcttgaactcctgggttcaagcgatcctcctgcctcagcccctcgagtagctggaatcataggtgtgcaccacgacacctggctaatttttttttttttttttttttttttttttttttttggtagagacggagtcttgccttgttgcccaggctggtctcaaactcctgggctcaaatgtcctcctgccccagccttccaaagtgctgggattataggcgtgagccactgagcctggcctaaaattttttatatttgctgccaaattgccgtccagaaagtctgtagcaccctatagtcttgccagcatttttctcagtctttccaggtcttgagctggacaggtcactgcctgcgtaatactctctaaggctctttgatttctttgctctgttaattttttcgggtgggataattgcattgtggttatgttttttttttttttttaaaagtctttatctttctgagatacatacaaaatatttgtagatggaatgaattaggggggaaaaaggataggatggaatttttttttaatcccaaaactttgctgaaaaatgaaagggaaagacaacagaaccaagaagtgcagaaacagatgcacttaatggggaacagatttccttacatgactgagggataaccacagctggacacttgtgggacacgctgtcttgctcccacgcagggttagaggtttgagccggctctgctgcagagcctgatgggcttctcagccccttctagaatctgcttctgtcttagaattcaggcctccgaatctctcctctggacctgggctttactgctctgactcttggggatctctgcaactctcttcctccaaggatatcccccgatcccttctgagtgaggaagtgtctgaacatctggaagtgtctggcttcagggcttccaggactattggaaattgcttttcattgtctggtttggtttggtaaaacctgtttttaagttcttccttttgggttttttatcaatagctccaggctggcatctggacctagtctctgcattataataataccaagccctgtcacagccagcagaagcctcaggcctcttcctgttcctaagccctacctctctgtcaggccacccactgagtttctgttcttctttgatgcctatagctccagcttgcatatgacttgcagagtagaaataggaagagttaccactttttgtaggtttgccaagcaccagacactactaagtgctatctattacaacatatatatgatcattctgttgccatcagacaactctgatggctcttattttcagattaacacgggaggaatctaaggctcagagagtctaagtaactttctttctttcttttttttgagacggagtttcgctctttttgcccaggctggagtgcaatggcatgatctcagctcaccacaacctctgcctcccgggttcaagcgattctcctgccttagcctcccaagtagctggattacaggcatgagcctccacgcctggctaattttttttgtatttttagaagagatggggtttctccatgttagtcaggctggtctcgaactcctgacctcaggtgatctgcctgcctcggcctcccaaagtgctaggattacaggctacaggtgtgagccaccgcccccggcgagacttaagtaactttctgaaggtcacatggctagttaaagatcagggctgagattcaacctgattctctgactccacacctttaaccctgtgcacttagaagtaactgagacattgctcaccatgcagataaggcctttcctggcttagtgcctcagcttctctttgatgactttctcaattctctgtgtcccagagaatactttttcttttctttcttttttttttttgagatggagtctcactctgttgccaggctggagtgcagtggctaatcccggctcactgcaacctccgcctcccaggttcaagcgattctcctgcctcagcctcctcagtagctgagattacaggcatgtgccaccacacccggctaactttagtatttttagtagagacggggtttcaccatgttggccaggatggtcttgatctcttgaccttgtgatccacctgccttggcctcccaaagtgctgggattacaggtgtgagctaccacgcccggcttttgagaatactttttcaaaaagaaagaaaccaatattgagtacctgttgggccctgttttgctttcacatccattctttcactatgggtttataataccacgtcactcttcttaaaattaaaactctcctttaccttgcacttagaagaaaatccaaaattttgactgtggcttaaaaaggtcctgcatgctagcccttacctacatccaggatctcatctctaactactctcctccatgcacagtgctcccggctgtcctggcctccttgttcttactggaatacatcagtctctttccatttcatgacctctgtagttggttttcttgcagcttggaatggccttcctgaagtctttgcctgcttagctcctcctcagactttaggtcttatgtcccaatagtcctgtctgaaatttcacccttttcctctcatcaccttcagtcctatcacttcattttattaattgtactctccatcatctgaaattattatatttatttactttgttagttactagtctcatttattaggtaagctttttgaggatagacaaccttgtccagcttgttactctactgtattgctaaggtttatgacagtgtctgtatagagtagttccttaatgtttatttgatacgtgaatgggtgaatgaatagcagtctctaccaacaagaggaggagtggttctcaacggggcctgagaaatggctttggaaaagggtgctgggagaagattagaacttagagtgagatcctgacctctctccccttgctttgcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtacctttcgcctttctaggaatgttaattcttgctagtttcctatttatgaaaggagagggaaatgggcatgatgatgcatgtaataaaagcatagttaacattcattcagcacttatcctacgttaggccctgtgtatgtattctacatttattattgtaaatataagaagttaatagaggattttggttaagagttagacaaacctgggcagatttgagaggagtagaagatgacttcaggtttttgaatctgggtgtttagagtagtgatgctagttggtgaagatacactgagataaaacatgttaagtgcttagcacagtgcctgacagaagaagttgcccattatctgtctatgtgaagaacaatgctaaatactgtagtagccacaaacatgaacctttctctagaagagtttacattccagtcagtagtatgataaatattgtagcagatacagactgatacaagaaagaggactgatagatgggtcacttcctcccctccattctctgattctgtctgttctcaacactagcttagaaagtagcttttggactttttagacaaaatgtctggaaagctcagcactaagtcaagtttgaagtatgggatggacagctctatgtaacattctatccgatcaccatcagaaggtctggaccacaagagagatgaatgccaaatttaggagccagccagcttggcagagtccctggtatatctcaggcccttgactaggtactggggctctagagtaagtaagtcactgactctgcccttcaggaacttatgcttgaaatcttgctagctgtggtcaagaatattcagtccatattgtgaaggccgactggtagccacgtaactgtcacacaagggacagatgtagctgggagaatggatgaaattgcttagggagaaagtcatgctagaagagcaaagaatatactcttggagaatactcattcttttcactcatgtttggtttatgtcagtggggaatcctggttaaacatagggtttggcagcaaatcagactaagctgggtttaaattttatatcaattatgcgttcttgggcaagtcacttcaactctcaaaagtccaaatttactatttataaaatggtgaggctagcagaatctatcacatgggactgtggggacttagaaaaatacatgtagagtgtttgcctagtgcctagcagagagcaaagggcatggttaagtggtaactgttattgctgtttaggcacatgttggcaataattagtttgtcctgattagaaacaattagatggtacctaacctggaattcgaactaggaaattaaactccagagcgagtctggtttagtctagtgcttgccctggaccgagctctgttcttgctaccttgctttcaaaacatggtggctatcactataatttttttcatgtgttccatgggtattgcacacattgaaaactgcattctcttggaaaacctgtcactaattttctgccaggataatggtctcacgcgatttttggtctgggatgtgagagggtccaggctgtcaggctgtacagccacgtgggcgctgcgtgggagccagaggcctgcgctgctccaaccgccagggggcggtgctctccgccgcggccgcggagagctgcaccgcccactcaccacccccccccacgtgggtccgaatggttaggtccgctgggcaggtagcgcgcttccgcggcttccctccgcccctctcccttcccccattggtaggggctgcgggtccgggcggaagtggggcaggcgggcgggagcgaggcgtcgtcgttgtatattcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcggga

SEQ ID NO: 16045 - DNA, 39601 bp, Human
[428 bp omitted]tccagagagctatttctgttttacagagatccaaaatccaaaaattctgctttacagagatgccttgtgtagaaactcaaaagtcaaacagataaaagtgaaaaagccagacaccaaaagttaaaacagtaaccactacaccacctgccccccaaatacatcagtaatcaaagatttcttaactttttgcccttcaaacaatgtgcagtcctcaatacagtaggaacttgattaaggctagctggaactgttccctgcttatctggtgtaattctaagctcaaaggcagaaacttttgcttctcctgcaatatcttcctcggaacaaaacagtgcctaatgcatgttactttgatttcagaaacagagaggagaaaatcaggagagttgggtaattgatttttgtgggattaaaaatgacatttttagtttttttctttttttatactcttttcatgaaggtaaattttgtttttttgggccattgacactggcccaatgctatgacattccaaaattgagagaatataaactttttaaaacagaacacttgattttgactactaatcagaggagtggaattgagtaacaaactcaaacattttatgaaaaataaacagactttatgctatggtatggttccatttatgtttatataatagactaagtattactcattacaagtacaataaatatttgttgatccggttgatgtaaccgtaagccttgttctctctcagtccagtgaaagtatacattttactgataatctaaaagtattaattcctatacaccaaaagatctgcgtatcatccccctcttggaatacacattcacttgcacatatccccagcctgctcctcgcaacagagcttgctttggggaggaaatttcaggatcacctccagaagaaaacaccgacagcgctcctagagccatcgtggtgccctctagcaacttacgggctccaagcgaaaaaagagctcgggttggtgcgggggggcggggagcgggaaactccatcacagacgcaagtgaaaactcctgcggcttctagattccatccgagaaggaaagatgaaaatcaaggttagaaagcagtggcagggcggtgtcccctgccttgctttaattcacgcggctctcgtaacaagccacagatgtgcatcactcaagcgggcttcccagtcctcatctcccctctggatggtcttctgcgaccgcagagtggtagttagggaagatcgcagcgggcagaaactccgccaggggagaaaggagcctgggggcgacggtccgcctaatcgttccaggaagcccctccgcgtgccggtgggcgggcgctcaggcccgaggatgcggggcgaggaggcgggtactggtgattctcctggcagcccccgcccgccccgccagggggagcgtctgcgcccgacgtaggctgcggggcctgggctggcggcgcagggcggtgactcggctcggtggctgccctcccgcgtccccaccccctccccgcccgcccccggcgcggccctgcccgccccctccgccccctcccgcagcgccatgcgcagactcagttcctggagaaagatggcgacagccgagaagcagaaacacgacgggcgggtgaagatcggccactacattctgggtgacacgctgggggtcggcaccttcggcaaagtgaagggtgagaaccccgcgggactaggcttggccccagctgaggagccgcacgacttccgctttccgcacctcttcatcctcccccgcccgctgcgtcccttctttccagggctgggcagcccctgtcccggatcctgcgggagctctccccagccgccgcggggctgcggcgcggccagcacaggccgggtgggggtgggggtggggtaggggccagtcgccatggcgacggcgccgcggcctgaggggctggtaggtgcgaggggctgggatgcgaaggtgcaaactttcccaggtggggcaggcgggcggcgcggcgcgctctgggtgctgggagggggcgccgggcgcgatccccggggaggcggcatcttgtgcgcccgggttgtgctcccttggctcagggccagcccatcgcttccttggcggtccttggcgttgtcggtatttccgtcctctgtaggaggctgtcgatttaccggcccctgctgtttcccgagtgcgaaatgtgtttccgcagaagtaaggtttctttgtgggtagccgacatcattttttttaaagaccatgtcgtcggaaaggatcactggtttccttcggagcagttaatgagtataaactggttcagtatttgcgatgcatggtttacgttctgaatgagactgtgcctttagtgtttccgaattaacaggagtttctccgtgcgaaacttcgttgttagttcagatgttgcctccagatagtatttattactttattagtacagttcatttccacttattttcaaaggttatttgtattctaataaactctttaagtgcacatcattcgaacttttgttttaagaaaggtgtattgggtgcattgtacagcattcgggtgacgggtacactaaaagcccagacttcaccactatgcagttcatctatgtaaccaaaagccacttgtacccctaaagctattgaaattaaaagaaaagtgtggactctttcaaaacactattctggaaataaacttgctctacagtccaccaattctggcaaaaaaacgtttaattgcaagttttgtaaggcatgattttttttttctttaacatatttgactttgttataagggatgcagagaaaggaagtttggaactgataaaaataattcatgcattggctttggataaataatagactgacttgcatatactaagttcttggtaaatatttgacttgaaagaaaaaaagtttgccaaagtctgtacggtaactcaactgagccttactcttccagagctaaataaacagtttctgattttatttagggttagaagagaagaacgcttccttctcttgccattttctgagtcatagaattggaaaattgttgtatatcccacagggaagcaactgcctgaaccttcttatgaaaatctgcaaggcggacaatgtcaggaggaagtaagaagcaaatgccagaattgggtaataacagctattaggacaggtccatataaggccagtaagatgtttctgtgccatggaagttttaactttatctttggctatgatatttcttgttagcaattacaaactgctttttagtttacaagtgtttgtaaaaaaaaaaatgttcatttttgcccccatcccttcccagagttctgcctggattagggtgttcatcattcccctaatatagacttgaatgcttgaataaagtcaggtctatttttttttcttttttcttttttcttttcccgagatggggtcttgctctgttgcccaggctggagtgccgtgtggtgtgatcttggctcattgcaacctccgcttcctgggttcaagcagttctcctgcctcagcctcctgagtagctggaattacaggcgcccaccaccacacccggctaatttcatatttttagtagagatggggtttcaccatgttggcccggctggtctcgaactcctgacctcaggtgatctacccacctcagcctcccaaagtgctgggattacaggcgtgagccactgtgcccggccaggtctgttttcgtatttgctaagtggtttttggcatggcaggtagtaaagcaggaagagatttttcatcttctggatttgatctgtgatatggctgtgacacgaatgtctccagtgactttgctgtttcttaaccttcacttccccacccacactaacttctcttggagtaccatattctgttaaagtcaacaaactctccaaatgtacaaaggccaatattagtccaaggatcataggtttcatagatatggttaaatttgttcatgatcacatttgttgatgttgatcagaatctttaacctgttcattttttaagttaacagttgggatgctttttgccacaagtaatagaaaatctagctttgcctagtaaagaacttatctgtggttctctttccacagataagtccttccagcagggaaggccagcatatctcttatgagtctcattggctcatccagtccctctggctaggaatgccatgtgccagttggcttatgcttgtattcctaagcaggcattagcaagggggatggcattgcccttggaggagtatgacccaccctttgatgtgtgtgtgcaacagaggtgggtgggtgggagacatcttttttttaaaatttgttttattttttaaatttttctttaagttattggggtacagatggtatttggttgcatgagtaaattctttagtggtgatttgtgagattttggtgcacccatcacctgagcagtatacattgcatcatatttgtagtcttttatccctcacccctctcccactcttccccctcaagtccccatagtccactgtatcattcttatgcctttgcgtcctcatagcttagctcccacatatcagtgattagaacatactgtgttggttttccattcctgagttacttcacttagaataatagtctccactcttatccaagtcactgcaaatgctgttaattcattcctttttatggctgtgtagtattccattttgtgtgtgtgtgtgtgtgtgtgtgtgtgtatatatatgtatacaccacagtttctttatccatacattgagtgatgggcatttggattggttccacgattttgcaattgtgaattgtgctgctataaacatgcatgtgcaagtatctttttcgaataatgacttcttttcagaagagattgctggatcaaatggtagttctacttttagttctttaaggaatatctacactgttttccatagcagctgtgctagtttacattcccaccagcagtgtagaagtgttccctgttcacccttttcaacaaattgtgctgggataattggccagccacatgtaggagaatgaaactggattctcatctctcaaccttatataaaaatcaactcaagatggattaaggacttaaacctaagacctgaaactataaaaattctagaagataacattggaaaaacccttctagacattggcttaggcaaggatttaatgactaagaacccaaaagcaaatgcaataaaaacaaagataaatagatgggacctaattaaattgaagagcttttgcacaggaaaaggaacagcagagtaaacagacaacccacacagtgggagaaaatcttcctaatcaatacatctgaaaaagtactaatatccagaatccacaatgaactcaaacaaataagtaagaaaaaacaaatagtcccatcaaaaagtgggctaaggatatgaatagacagttctcaaaagaagatatacaaatggccagcaaacatgaaaaaatgctcagcatccctaatgatcagggaaatgcaaatcagaaccacaatgtgataccacctcactcctgcaagaatggccatcatcaaaaaatcaaaaagcagtagatagattttagtgtgcatgtggtgaacagggaacacttttttttttttttggagacagttttgctcttgtcacccaggctggagtgcattggcgcaatctcagctcattgcaacctctgcctcccaggttcaagtgattcttctgcctcaacttccctagtagctgggattacagacgtgtgccaccacgtcctgctaatttttgtatttttagtagagatggggtttcatcatgttggccaggctggtcttgaactcctgacctcaggtgatcccacccgcctcggcctcccaaagtgctgggattacaggcctgaaccaccgtgctgggctgggagacatcttctaagtacttggatagtgtggggggacagggtagacacctacacataaatggatgttgttaggagagagaaagggggacatggatactcagtgaacacacagaaatggccactattgtggtgatgttggtaattaaacaccaacagccttaattatgcaagaattcttgcaaataatagggttaaccatatgtttagacaatttggagtaaagaaagctttaaaaattacttatacatattggtaaatttaacatgaagagggatctaataaaatatatgatattgatatgcagaaaaagtctaagtatgatattccatgcttataggaaatttaattttgcggggagagtaggctggaagttcggagtgattgtttcctgttacaggccaaaaaatttgtttggttacttagtggtagcattttgagaggaaagtttacagaaaactagggttattttgtgattatgcttgaattgtctttattgtttccaaggcatcttttttttttccttctagttatcaagatgttaggttctgtgcccttgtgggccttccctctgcccaaaaaaagcatggatgagcagagtaatatcattaaaatggcagtctttgttagtttttctagagaagatggtctctttggtaggctgggtgtatcttcggcaaatgagttatttatacatataaactattaagttggcaagtatttcttttttttctttttctttttttttttttgagatggagttccactcttgtcgcccaggctggagtgcaatggtgcgatctcagctcactgcaacttccacctcccgggttcaagcgattctccagcctcagcctcccaagtggctgggattataggcgcccaccactacgcccagctattttttttttgtatttttagtagagatggggtttcaccacgtcggccaggttagtctcgaactcctgacctcaggtgatccacccacctcagcctcccacagtgctgggattacaggcatgagccaccatgcttggcctaagttcgtaagtatttctgtgtaaaactgcaatttcagctacataggtactttgtgaatgaatcatagtagaagttatttaaaaattcctttaagtaaaaattataaacatgaactagagctatatatatcagtgtgaatgaatcttaaaaatataaggttagacctcgaaagcaagttgtataagaatatgtatagtttgctgttatttatataaattttagaaacctacagaaccactcatacaatgctggtagagtataaattggtatcctacctctacatgagagagtgacagcatttattaaaattaacctaacaattcaacttctaggaattattttatagatgtactcgtgtatgaaataatgggttattcgctgccatattgttgtaaatattaatacaaaactttcgaagtaacctttctaatagtaatagttatggtttatccatatagtgaaataccttgcaaacattaaggaagaaaaagggaggaactttgtatattttagagaacaatttccaaggtgtatttttaagaggaaaaagtagaacagtgtgttcaatatgcctaccacttatgtataaaaggcaggggcaaatctgtatcttaaatgtgactgcttttatatatagagtatgtctctttaaagatacacacaagactggttacgttagttgctcagtataggggactaggtaaaggaggacattgtgttgcaccatagatgcttttgtacttttgaactgtgtgtatagtgcaggtattgtgttatcaaaatatatgcaatgacatttgtaaaaataaatatgaaaaataatgttactatattttttatggattcctacccatgtaaaaatatttaaacgtgggaaacacaaacaccaaattcaggatagtggttacttctgaggacagatgaaggataagggaatctgggaggagtcatgcagggcttgagttgtatttgtaatgttttattgcttaagctgatggtggctcatgggtatttggaatgcccttggtgtgcttgaaatgtttgtttgctttcttaaattacgatctatagcttttaaagcccacccttccccaggattaagctatttccttaacacgtttttattctttcaattttaaagtgggaatgaaatggttaggtgtctagaatatctttagtagatatttctatctttgctgcttctctgtcctattaaaatcctctgtttcaaagtatgatcttgtttcccttcaggattatatatctaattagaagagcatttgttacaatgttatgcagttagacaaagttccctttagatagcaatagcatggttgttagctaatatttagttgactaatctgctattcttgtgagggggacattgtgaatgctggtaatatttgctctgagtaatgtgcaagtcttccgtggccaaaatatctgtcttccgtttcatttaaaagcaaaaccttagcactattctaaaaactgacagtctgaagaataaagtttgaattttgaaaaaggggggaatcccttagtagtgcatatgcctgacagagtccatttactacattcattgattgactatggaacagcatttagtttggctacaactgagtttactcactggggagaatatttagcctggttttgagaaaacagtttagtttctgataccatgccaagccctttgtccctctcactgcacagtgatggtggggagagtggataggtcaaaagacttgggagtcggaagacctgtcccaacttgatcacaatagctttacttccacaacttacagaatctcttagagcctcagtttctttatctgtaaaagacaatacctccatcataggtttatgctcaaatgtgataatgtgagtgtctcctaagctattagatgccatattttaaaaagtattatgctactgaaggccgggtgtggtggctcacgcctgtaatcccagcacttttgggaggctaaggcgggcagatcacgagctcaagatattgagaccatcctggccaacatggtgaaaccccatctctactaaaaatacaaaaatcagctgggtgtggtggcatgcgcctgttgtcccagctactcgggaggctgaggcaggagaattgcttgaaccccggaggcagaggttgcagtgagccgagattgtgccactgcactccagcctggcgacagagcgaggctccatctcaacaacaacaacaacaacaaaaaaaaaaaaaaagaaagagttgactcctgatagactatgaaggctgggatacaaattcaaaaagcggaaaaccacacgagctggaacactataggctgggagcaaaaagccctatcctgctaaataactcccactgctgtcactgtgtgagggtataaggagcagttgatactcataagttaacatttgtttggttcccagtcttcatgtacatgtgttccatttaagaagtcatgatcatgtgtagtacaattagaaaacctgttttcaaaaaatattacttctgttaacttgttaattttaatggtgaatatcatagtttagaaaatccaccctccttttcttgtcagggactgagtgtgtggtcctgctcctgttatgtatggaggcaaagggaaagggctccggccccctcaaaatcatgtctttggtgccagccggttctgttctcagtcacctggatactgaactttcctgagcagggcagaactgagatccagtgggcttctccccaggatgcttacgctttttcatttgatttcaggtctcctctttcgcttcctattgcaaccaatgaaggccattcctaccataagtaaataaaaaagaaaatctatctttaataaataacaattgtatatatttatggggcacaatgtgatgttttgatacatgtatacattctgcactgatcaaatcaggccaagtagtatatccatctcctcaaatatttatcatttctttgtggtgagaacatttaaagttcccttttttaactcttttgaaaaattaatatatttactgtaatcatgatgctatgcaatacaacaccaggatcctgttcctcctgactgtaattttatgtagccattgaccaatatcttccttttcccctccagccccacttaccccagctactggtaatcaccattctactctctacttctgtgagtttgacttttttagattccaaatataagtgagtctcagacacctctgacatactgatttcaattcctttggatatatactcagtaatgggattgctggatcatatagtaattctatttttagttttgtgaggaacctctacactgttttacaaaatggctgtatttatagtttcaccagcagtgtataagtgttccatttctctgtgaccttgctaacacttatctttcacctttttgataatagccagtctaacaggtgtgaggtgataccttattgtggctttaatttgcatttctcttatgattagagatgttcagcattctttcatctatctgttggccatttgtttgtctttttttttatttttatttttgagacagtgtctcactctgttgcccaggctggagtgcagtggcatgatcatggctcactgcagccttgacctcctgggctcaagcgatcctcccacctctgcctcccaagtagctgggactacaggcatacaccaccacgcctggctaatttatgtatgttttatagagacaaggtctcactgtgttgcttagactggtcttgtattcttgggctcaagtgatccacccgcgtcggcctcccaaagtgctgagattacaggcatgagccaccatgcctggccggatattagctatatatctgatgcatgatttgtaaatacgttttctcagtctttgggttgtctcttcactctatttgtttttgcttgtttgtttgtttttttgagatgcagtctccctctgtcacccaggctggagtgcaatggcgtgatcttggctcactgcagcgtccgcctcccgggttcaagcgattcttttgcctcagcctcatgagtagctgggactacaggtgtgcaccactacgctcagctaattttgtatttttagtagagatagggcttcaccatgttggtcaggctggtctcgaactcctgaccttgtgatccgcctgcctcggcctgccaaagtgttgggattacgcgtctggcctgtttgtttgttttttgctgttcagaagctttttagtttgatgtcatcccatttgtttattattgcttttgttgcctgtgcattaggggatcatatacaagaaatgattgcccaaacctgtgtcatggagcttctcgcctaagttttcttctagtagatttgtaatttcaggtcctaaatttaatccattttaagttgatacttgttaaggggtgagataagggtccatttccattcttctgtatgtggctatccagttttccaaatgacattattgaagagactgtcctttccacattgtgtagtcttggcacctttgtcaaaaatccattgattatagatatatgcatttattctgggctatccatcctattccattggtggacatgtctgtttttatgtcagtgccgtgctgttttaattactataggtttgtaatatattttcaaacatggtagtgtgatgcctccagctttgttctctttggacctaaagtctattttgtctgaaataaatatagctatctctgttctctttttgtttgcatttgtatggaatatctttttcagtcccttcattttcagtctatgagtgtcctttatggtgaagtgagtctctttataggcagcgcagagttggatcttgttttttatccatttagccactctatgcctgttgtttggagaatttaatctgtttacattggaagtaattattgataggtaaggacttagtagtgccattttgttaattgttttctagtgtttctgtagaacctttgtccctttctctattactttccccctttgtggctcgattgctttctgtagtggtccactttggattttttctttttatcttttgcaaaagcaaaggcttttgctttgtagttaccctgtggcttacacaaaacatcttataactggtatataagctgataacaagttaactttgatcacatacacacattctacatttttactccccctcttccatgttttatgttcatgatgtcacgatatacatttaaaaaataatttgtatctttaacaaattattgtagctttattattattattattattattattattttgagatggagtttcactcttgttgccgggactggagtgcagtggcgtgatcttggctcaccccaacctccacctcctgggttcaagctattctcctgcctcagcctcgtgagtagctgggattacaggcatgcgccaccacgcccggctaattttgtatttttagtagagacggggtttctccatgttggtcaggctggtctcaaactcccaacctcaggtgatatgcccgcttcggcctcccaaagtgctaggattacaggtgtgagccaccgcgcctggctagctttaactatttttaatagttttatcttttaacctttatactagatatataattcatttacttaccaccattacagtattagtgtgttttggggttgacagtatacttactttttccagtgagttttatacttttcatgttttcctgtcactcattagtgtcttctttattcagcttgaagaagtttctttaccatttctttttctgtttctttttgtttgtttgagacaaagtctcactttgttgcctaggccagagtgcagtggtgagatcttggctcactgcaacctctgcctgctctgttcaagtgatccttccactcagcctcccaagtagctaggattacaggcgtgcaccaccactggcagctttttttttttttttttttttttttgtatttttagtagagacagggtttcaccatgttggccaggccagttttgaactcctaacctcaagtgctctgcctgcctcggcctcccaaggtgctgggattacaggcgtgagccaccatgcctgaccactgtttttcattctttatccttttttcttcttcagattgtatgatttccagtggcctgtcttctaattactaatcttttcttctgcttgatgtagcctgtggttgaacccctttattgaatttttcagttcagttatactattcctcagctctatgattactgtttggtacttctttagaaaatccacttttcaactgataaactaactatatccatttctagggctgccgtaacaatgccacagactcaatgacttacagcaacagaaaattattctttgccagtactggaggtgagaaatttgaaatcaaagggccatcagggccatgtttcttctgaaggctctagtggagaatctgttccttgcctcttccagctgctgctgcttttttttttttttttgagacggagtctcactctgtcacccagaatagagtgcagtggcatgatctcagctcactgcaacctccgcctcctgggttcaagtgattctcctgcctcagtctctcaagtagctgggactataggtgtgttccaccactcctggctaatttttctatttttagtagagatggagtttcgccatgttggccaggctggtctcgaactcctgacctcaggtgatctccccgcctcggcctcccaaagtgctgggattacaggcgtgagccaccgtgcccagccctctttcaccttcttgtggctcctgatgttccttggtttgtgatagcataactccagtctctgcctctgtcttcaaatggctgcgctcgcttgctctctctctctctctctctctctctctctctctctctgtgtgtgtgtgtgtgtgctctcctcttcttgtaaggataccaggcattagatatagggctcaccctaaatccagtaagatttcatcttcaaatccttcactagtcacgtctgaaaagatcctatttccaaataagataacaatcagagattctgggttgacatagattttgtggggacgttattcacttcactacacttgtttttatattttgtatacttttagttttatgctttctttcttagtttttgagtaacttttaaattggtttgatagaatgtattagtaaaatgtctgtgggctgggcgtggttggttaatgcctgtaatcccagcactttgggaggccgagggggggcggatcacctgcggtcaggagttcaagaccagcctgaccaacatggtgaaaccccatctctactaaacatacaaaaattagccgggcgaggtggtaggtgcctgtaatcccagctacttgggaggctgaggtaggagaatcgcttgaacccaggaggcggaggttgcagtgagctgagatcatgccattgcactccagcctgggcaacaagagcaaaactccgtctcaaaaataaaaaataaataaaataaaataaaatgtctgtggaatcctaagacattgaaattgatatgaggcaggttttcagtacactggattcatgttctgatacaggaaggaggtcatagtagcagtgcctggcacatagtaggtgctggtactcaaatatttcttgaatgaatgaatttgtatgattgaatgcatttctggataattcttattactacaaggaattcagtctattcttttcaaaactgtatatacattaagaatttctctgatatgtttaacttccatttatgttttattaaaaggatgtgtatttttacatgtcttctgaggattatctttttaaaaaaatcaaatttcacttaaccatgttcggaaaaagcataactttaagagtctgacctgggttgaagttttggcttttccactcattagctgtgtaactttgggcaagttatttcatctttctgtgcctcagtttcctgtaaaatgttgctaataatgccaagtcttccaggttggtgagagtgtgtcagtatgtttgggtacaaagtgagtatgctgcaaatattaactagtaagttgtatactttaattatgtattgtaaaggaactagatttatgttgtaaaaaattgtttttgttaaaaaaagagcccttgtttattaaaactcacatcaaattaagctgcttttttcctctgtgttcttctgtgaccaaacaagtgttcctgtagtaggtgaaatcactgtcaaggattggtgttatgtgtatatatgtctgatagtaatctgttgaacattaaccaaagtcaggaaatgagttgaactttggaaggtagaaatctgaggattggtggtagtggtggtggggtaggagtggtggagcgggttggagggattgaagtatatgggaatgggagctagatacattaaaatgacagctattatttatttagcacttatgtacctggataaaggaatgctattgcatctacatggataggtatcaccaatcagagctgagataaaactggctattcagagattaaaacaaataattcagggctgattagatacagatgggggaacaggtctgggagcagtggaaaataaataaccctaaataataaaggctaccatttatttatcaatcacttgctatatgccaggcattgtggaaagtgctttacaaacactattccatgtatctgttatagtcacccttatggagtatgtggtattcttattttaaagatgagtaaatagaaggttgtagtttctttaacttgcccaagtcaaacatctagtaagtaccttcaaacaggaataaaaccgaggtctgtgcgactataaaatctatgctttgtatacatactgctttcacatgtgcaattggaattaggggttcaaccctattcaactctacttccaaaaaaggtgaatctgctaatactacttccaattgtttttttcccctttggaaatttttttttttgagatggagtctcgctctgttgcccaggctggagtgcagtggcatgatctccgctcactgtaacctccgcctctcgggttcaagcgattctcctgcctcagcctcctaagtagctgggattacaggtgcgtgccaacacgcctggttaattttttttgtatttttagtagagatggggtttcagcatgttggccaaactggtctcgaactcctgaccttgtgatccacccacctcgtcctccaaagtgctgggattacaggcttgagccaccgcactcggccttggaaattttttttctaactgataagaatacaaagcagcaagtaaaattcaaaaagtatcacagtggaataacttttcattttagcatattaacatttttatatgatttttttgtgtagctaaaaaatgtaaaatgcatatataatttttttttatgtttgtaagaacattttctatagttttcctatgagagtctgttaggttggaataacaatgtattaaactgttctctgaaattggtcagccttttgttcttacataatacactgtaatgaacatatttatgcacatttttttcatcaacttttaaatcaaattcttagaaggaaaactacagattaaaaaagaaaagatcctgatcatgtaatttgtgtgtgtgtttatgaatttgaatgatctcttggcatggctgtcagggcactgcctctattcctgccactgtgatacgatcatacttttgtgatttcttctattacttcaaaagggaagaagttataccaccatactttaaaacaattaatttataatttgatgaaatgctcaagtattagaaaaaagttttatggtatatcttgattggttatggattttgttctgcttattatgccttcttttgggtggttggggggcttctgttatttacaggtggattaatattctgctccgtattactcatgagttaaattatactcaattccctattccgtagttaccaccttccctcctatttttgctaatttcctcctcattttttgttgtgtgttctataaaatttcccatcacattattattgctactacctactgttttctaaatgattttaattgtattgtaaaattcttcttgctctgctctaatttcatacctcctatattttcttatcactctgaaaatagttaataaattttgctaatacaatcatgcatttcatggatgagtttaatgtctattcatttttttgttttattcttttgtattataagactttttgctttttctcactttactgttatttttgtcatcattacaggccgggaaggtcccatagcccaggttgcttttggtcaatactgttttccccagcagcattaactggcatgtaggagatgctcagtacataatgccaaaataatgaatttgagagaatgctttgaattcctattccagttccttattaaatgacaggatatatgtccagagttttggataagctccagtcatttcttaaagttaattggggttgaagttcagttgagcagggtatcataggagtttggttggtttgtgatggtttgggagttcaggcccaaattggattctgtcttagtattctttccaggtcttgagtccaccagtattatccagtattgtggctatttcccagtcctgtttcagctgagcagctgtcaagagaaagtctgtgccaagccagagcttggagattcttggaggatgtgtttagcaccatgcttaggtttcaacatacttgttctaagaaaaaagatacttcctgaagcaagctttaacagtcaagttggctgctcttaatcacatctaattagtactggagattggagaaagccttattagaaattagaatgtgcttcatttccacagttgatttcagctgtgattatagggttgccttccttctttctcttatacatttcatactacacccccatcctcctaatatagttatatcgtacttttaataaaacctatatttggttttttcataattgtggctgtgtaaatactatttgctaagtcagtatctatgactatgttttatttcttacagaactttaattttactggcattcatgaattatctcatttttttcatttgtttaatttttttacctaaagcttaatttcttacatcttccagtgcctttgtaaaatccctcagaaataactatcttggattctctgtcacattcctgtctggatttgttgccttctaggccttctccatatgttactgtgactttgcttcaccattttgagattctcttagtttttctcctatattggatcccttctttgctggattccatgccatctttcttgggtttcttcctgattttgatggaatatatattctccagtaggttcctgagaaagggtgcacaaaggttaaatttttggagacttagcctcatgactgtctaaattctactggtgatcatatccccaaaagaccaaatccctaatgccataatcccaaatgttgaaatactgaaagatcaaaatctctaaaaatcagaatccctaaattctaaaaatctcacacatctgaaatcctgaaaatcagaatcatgaaagattaaaatcccaaatgttgaaatgctgaaagccaacacctggggtagaaattagtgcacattcggttgtatgaaagatagttgcatcattttacttgcatcatattaggtggaaccgattgcctttttattgtatttatttggaaattaagtatggtttaaggagatggtttatgggtgccaaattgacgaggggtggattcatggatttaattttaggtgtcaacttgactggattaagaaatacctagaaacttgttaaagcattattttgggtttgtctgtgaggagattagtatgtgagtctgagtggactaggtggggaagatctgccctcaatagcggtggccaccattaaatctgctgggggcccagagaaaacaaattgttgcctttctgagagctggaacggacttttcttctgctgaattgaacatcagaactccaggcttgttggcatttggactctaggacatacaccagcagccccctgggtcctgggctttcagcctcagactgagacctggtttggcttggttctgaggtctttggactgagccaagctaccagcatgccagggtctccagcttgaaaatgacctgtcctggaacttatcagccactataatcgcatgagccaattcccctaataaatcgtctctcatatatctatgtatatatatatcttattggttatgtctctcaagaatgctgtctgtcgagaattatgtctgtcgagaatgctgactaatacggatttggtattgagaaagccaaatatcattccttcttactgtattccttacagcacagtggaagagacctgtgaaattgttcccttgcaaaaaggctgtgataaattaagtataccaggctacttaatgctgaaagagaaaagtttaaaagctaattattattggtgttgtgaagacagaaaatcacttaattgcaatggccaagcaataaccagatttctaaatggtcagcatatacttacaaaatatttagaccacaaccgctctagtctaaacacaagtgaatgttttgaagatcatagaagtgaatatgcaggtgaaaaatataagaaagctcccctgccaaattattcaatcaggtatgacttctgccctttcacacatagtgccaatttgctatgctatgtattttatctttgcatcatttctaatactgcaggtataaattctgtaaaggcttttagagaattctaattcattttatgcactttttttttgcatatttgactccatgaaagtgcattatcacaatgtgacgtaatgtgtaagcattgtgcatgtacataaaaatgttgaaacttgctcagtaaatgaagagatgtccgttttgttcatctgtatttgtgaaagataaaatttctcaagatcttggctctttgggtgactctattgcagtttttgtgcaaacggtagtgacccattgcagtttttgatcgatcttgtcagaagattcaggttgtctggtatttcagatgaccgcagttatgaatctgggtgcacctgattaccaaccatagtgatacgtgtttatccattttgctttttaatctatttcttcatgaatacattttctctgttcctattatacccatgcaatggttgttagtatacctgagtatttatgcttgcaaaaatatgttattagtgcctattttattgtgtaaaggggcctatgaactgttccgttgtgtttttatgtttctcaaataaatcttttaaaaatggaaataagtgtcttttagagaactttttacaaattatttttccagaattcaattttttggattttgttcttttgggattgtgatttttggaattttagattttagggattttgatcttttgggatttcaacatttgggattatggcatttgggattgtgtcttttgggattatgtcctaaacccaaattctgtcaccaccgactgtctagtgataacatttaaaatggaaagataaaatgacttgattttttttttccctttatttttaactgcatttaaaaaaatagaggctgggcatggtggctcacacctataatcctagcactttgggaagttgaggctggtggattgcttgaactgaggagtttgagaccatcctggtcaatatggtaaaacatcatttctacagaaaaatacaaaaaaattatctgggtgtggtggggcctgcctgtagtcccagctacttgggaggctgagatgggaggatcacctgatcacctgagcctggggaggttaacgctgcagtgagctctgattgtgacacggcactccaccctgggtgatagagtgacaccctgtctcaaaaaaaaaaaaaaaaaaaaaaaaattaaaaaacaggaaaaaaaatttaaaacacagagaaaccaaaaaaactagaaaccacatgcacatgaaccagaatttcaaaggtataagaggttatggatggggaaatgtatctatgacatgagagagtcttttgggatgatggaactgttctgtatctgactatataatgctggttacaccaatttctatatgttttaatatccatataaatgatactaaaagaaaaattttagtctgtatgtatgataggttaaaaggtgaaaaattaaaagaatttaaaaatacgaaaaggtatacagcaaaaaagtctccttcccctcttcctttagtcttctagctttctcttctggaagaaaccactgttaccaatttcttatgtattctcctatgtaatcactcttaaacatctgaacatttgggatgaatctggcaaaagagaaaataacttatatttgcttagctattttctgaggatgctagatgactactcttataatatgtctaaatatattattatttttattttgttgaggcagagtctcaatcatcaccccagactggagtgcagtggtgcaatctgggctcactgcaacctctgcctcccaggttcaagtgattctcctgcttcacctcccaagtagctgggattacaggcatgtgccaccactgcacccagctaatttttgtatttgtttgtttgtttgagacagagttttgctcttgttgcccaagctggagtgcagtggtgtgatctcggctcactgcaacctccgcctcctgggttcaagcgattctcctgcctcagcctcccgagtagctgggattacagctgtgtaccagcacgcctcgccaattttttgtatttttagtagaaacggggtttcaccatgttagccgggctggtctcgaactcctgatctcaggtgatctgcccgcctcggcctcccaaagtgctgggattacaggcatgagccaccgctcccggccattaatttttgtattttttagtagagatggggttttgccatgttggccagattggtttcgaactcctgacctcaagtgatctactcgcctcggcctcccaaagtgctgggattacaggcatgagccactgcaccgggccagaatatgtgtaaatatattattaatcatacttagtactaatttattaaattacttcttttacagttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaagctctgtttatattaaatatagtccagtcatcttttcatcttttttgttaacctacttaatgtgacaagtgagaaaaatgactgacacttctttttgtttcctaagggttttgaaaagtttcttcctaggctgtgtgcggtggctcacacctgtaattccagtactttgggaggctgaggcaggcggatcacctgaggtcaggagttcgagaccagcctggccaacatggtgaaaccctgtctccagtaaaaatacaaaaattagctgggcatggtggtgggcgcctgtaataccagctactcgggaggctaaggcaggagaatggcttgaacctgggaggcggaggttgcagtgagctgagatcgtgccattgcactccagcttgggcaacaaaagcgaaactctgtcccaaaaaaaaataaaagtttcttcccattcatgtatttttctaaccccattgatggtcatttaagcctgtgttcatgttttgcccttgtgcttatcagctgttatcttctcattctttcctgtctcctggaaagatgctcttctggtaatgtttggtgccccattgctgtaaaaccaacagtgatctgctagtaaaaactcttgacctccaaatgcccacatgatgtcagttagcctcactagtgagaatgcggtagtagaaagggtttttccccatcctgcttatacctgaacatatagataacaaaatttcaggaatccaaggtttcaaaagggcagtaatcttactgttgttttacagttgccagttatagagtctacaaataactatttcctgctcagcttctgctttgttatgcaggcaataacttaaagatgcttaggtttttctcctgaactggctgactcaaacttgtttcactcttacctcttctcatttgttgagtgctaggttttaaataccatccatatgctgaccacccctaaatgtacatctcttgctttaagatctcttcttacaccagacttatttgctcactgctgactttacatttccatttggatgttcgcaagacatttaaaactcaacccggcccaaaatgaactctttattactctcccaaacctgctcttcccacagttttcaccatcttggctaacagccaatgacccagggctaaaacttaggaaccatttttaacttccctgtttctttcactttctaccatgcatttcatttcttccttcacaatcaagctaggatttgattgcttctcagttcctttattgctgtcaacctggtctcagccaccatctgtctcatgaaatcctgaagtaacctcctgtggctacctttactgttgacagttaattcttcacattgctgccatagttttacttttaatatgccagatcacatgactgcttaaaacgtacgatagcttttcatcttccttggagtaaaagccaaagccttatcatggcttgtaaaattctgtgtcttctggcctgcagttaacacctttgactctacatcctatttctctctaatattcctcgaacatgccaagcaggcttctacttggggacctttgcagttgctattccctctcccagtttcgctttcctcctagataattacataatttgttcccattcttcttttaggctcagctcaaatgttactttattagaggctttcctttagcactctgtatacaaagattccccttcatttgctttatttttcttcatagcatgttccaccacctgagatattgcttatttatttagtgtctgtttcctggttcctggaacatgaactccatgagagcagagaatttttgtttcctgcagtttttctagctcctagcctagtacctggtatactataggtgcttagtaaatatttattgaatgaatgaatatatgtgttttaatatttgtagacaatgttttctctcaccaggtaccaggtcatcagtacaccatctgatattttcatggtgatggaatatgtctcaggaggagagctatttgattatatctgtaagaatggaagggtaagctgttctgctttaattctgtatgtattttgtaactcccctttatcctttactagcatcaaaatgtcagcaaccaattttaagaggtctatttaataaccagttcccttagtcatatatttgtttagaatcataaactatgtagaactagaaaggatcttaaagattatctccttagcctgtttatacagatgtggatactgagcctcgcggcttatatgattgctcacagtaacgtgatttattaatgacggaattggcttgagcccccagaactcataatcctcagacttatgcttccagggtatacaaatactttgaatatgtatcttaatgtaattaatcgttacaaaatatattattattacttaaagatctaggccttgctagtcaattctagccacatttaaattgcattcattttttggtttcagaaatctgatgtacctggagtagtaaaaacaggctccacgaaggaggtaggaattagatataaagaatttacagctggaaggaactttgtaggacattttgaacactaccttaagttacagatacaaaaactcaacactgccctctgcccatactttttctcatacccaggttatgtggtatgcaaaagcccctttgtgggagagctgtagctagccctgaaaagagagcttttctctcaattttaagttatttacattactcattcatttgttctatatagcatgtctatttacttttatcaaaatcaaacttattaaccaagttaattttgattttactatttcttaacatgattcatttctatttcaggtactcccctttactcctgcttctccttaccaaaaaaaaaaaaaaaaaaaaaattctgcctggagaaatgggaaacaggcacaattgatatatatttttcttatcttttctgttgttgtttatttcttggttttaccttgtgggtatttcttcagttttaccagttgaatattaaaatttcagcacccgtattttctatttcaaaagtttcttattttctgaaattttcatttttttagtctgctgttatttgcctcacagatataataacctagtctgaggatggcattttaaaaaaagtcttcctctgttccgtcttgttctgtaccttctgtgctctctgcattcattttattcatttttgtctttgatgcatggcccttcttcagatatttggtgattcttggctgtccactaaatatttaagaatagggtattaaatgccaggctcatgtgggtaggacttactgattgctgggttttctcatagcttgaataggtagggacttgtctgttttattactgtataccaaatgctaataataacaaatatgttttcttggatcagatatttgctccagaagaaaccttcccatttccttaaaggccttagcttagctgccagtgctccaggagctgagtggagaaaagagatgcaagtctcactagttagtatgttgactttgtcttagcccccatgttttccttaggatgccttatccctgccttggtgtccttgagagcagagctggttcagccttactagagtaaattataggtcttattccccaatatgggtgagtttaaaagcttcttacttcaagcacttgtcctgttttcagctcatctctcacttctaccttgagcagttccctgtgtttccaatttctaaggcttcccaggctttgtatgcagatgtttattttttactggtttctacccctataggcttaggttttagctttctcttgtaggcttagtctttattactgtttatctattgtcatccttggtgactcctcttgattactgctgtctcttttgttctttttgtctttatatgcctgttttattgctgatgtcattttagtgatgtttcaagagttggagacaaaagatttaatctgttacatttaattggaaatgtattttgacttttctaaccttcctttatagacatccctttctccatcctttgtaattgtacttgttactaatacagtataattttcatttttgtagcctgtctattttactttttatattttgtttaatcaagttttctcctattttttcatatttgaacagatactcttttttttccccatgaacctacaaatctagaaataaaagtattagaatgctaaaggattagtatttttctagaggaatggtatcttataatagtttcttgtttcaaaataaattactgatttgtattttctcccatattatccatgccctttaaggtgtaagtctggttttagaatgctaatttgtgacctgtgttagagaattgcatattggagtccttcgcctagaggattaatagcttatttattaaatatgacttcttgggagcaggcatgtccaagtaatggctgtcacttatgttgaaaaaagtggtaataatatatggatacatagagaagtttaaaaaaaatacttcaggctgcatgcagtggcacatgtctgtaatctcagcactttgggatgctgaagcggtagattgcctgagctcaggagttcgagaccagcctgggcaacatggcaaagtcctgtctctatcagaaatacaaaaattagtgggcgtggtggcatgtgcctgtggtcccaactacttaggaggctggggtgggaggattgcgggaccccagggaagccgaggctgcagtgagccgtgatggcatcactgcactccagcctggatgacagaacgagactggatctcaaaatatagataaatttaaaaccccgcccccccaaaaaaacacaaaaaacaaaaatgaaaaggtagttgctatgtaagattttttttttagcaagcatattaaagataaaatgctatgatattttattaaatgaattaaggtgtttgttgttaaaatgtcttctattttaggacatatagcaacatagttgcttgctggtttatgaatagtgcttaaatattacttcctcatggtctaaaatagtgtccctcaccccactatcactcactgcacctatattttgctttatttttcttcaaaacagtatcactccttctgactatatttattagtctattttcatcaactagattagcctttgttttattcattgctgtgtaatgagtgtctaaagcaatgtgtagcacgttgaaggtattcagtaatttgttaaaagaatgaaagagtaaacatttgccgcttataaaaggaaatatgccaaatttcaagtagatattgaaattatttgaaataactcatgagatatagaggaaggcaagctgttacaatgtagtcatatgcaaatgataatattagaaacttgagttactgatttgggttccaagaccatcttagcatttctgttttgtgctgcaggtatctcctcctcatgtcaaaagtatctcataagtgaagttcattcggaagattttcatgtattttgacaattttataggttggagaattatagataggacaatttactttgaaagacacacctttaaaaagcctctctaacttttcttagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtaaggataattttatagtttcttaacgttcatttctaatgttcttatagtttcaatgaacctacctagaattcttcagataactgtaaaagattacataaagtaatagactgagtatatcaaagtattctgttttgtctatgaagatacaaaaagaagaaaagctaagaaatcatcttttcttagctttaaatgtctttattactattattttatagaggcagggtttcgctttgtcgcccaggctggagggcagcgacgtgatcatagctcactgcatccccaaactactgggccaggtgaccctcctgcctcagcctcctgagtagctgggactgcaggcgtgcactaccatgccaggctgttttgtctttttgtagagacaagttctcactatgttgtccaggctgctcttgaactcctggcctcaagtgatcttcctaccacagcttcccaaagtattgggattacaggtgtgcaccactgcacctggctctttaaatatctttaaaattaaattttaaacaacttaagttggtagtattagagagactatttgaaaagagtattatttgtgaaagagaaggtagcagctttatttccagtatgttcaaaagaatcaagtatggagaagaaggaaagtgagtgggatggaattatttaaaaccttaaaaaccagaagtgaactatgtgaatttaattatttaaaattatttaaaacaattttttaattaaaaaaatttatttaaaaatttaaaaatgttttaaatgatagtaaattataatttgtttaaagaacattttgattgttaaaaatgaatttattttggctgggcgtggtggcttatacctgtaatcccagcattttgggaggccgaggcgggcggatcacctgaggtcaggagttcgagcccagcctggccaacatggtgaaaacccatctctactaaaaatacaaaattagctgggcatggtggtgcgtgcctatagtccccactaccctggaggctgaggcaggagaattgctggaacccaggaggtggaggttgtagtgagttgagatcgcctgtccggcctgggcgacggagtgagacacggtctcaaaaaaaaaaaaaaaaaaaaagaatttattttttctgtatttcctatataaattgccattgaccttactaaacctaagagaaaaaggaatctcttcttttctttaggttggttttagttcaaatcagataacttttttttgtttgttttttgttttgagacagagtttcactctgtcacccaggctggagtgcagtggtacgatctcggctcactgcaacctctgccttccaggctcaagtaattctcccaccttggcctcccaagtagctgggaccacagatgtgggccaccacatgcagctatgttttttttaatttttggtggagatggggaatcactatgttggccaggccggactcgaactcctgagctgaagtgatccgcctgtcttggcctcccaaagtgctgggattacaggcgtgagccaccatgtctggcccagagaacattcttataaaaattttcctcagttttgactacatctatgtatctatatctataactatatctatttaaatgttcagagattaactggaaaatgccaaccaaacctgagctggttgttttggtgttttgtttttttttaaaatagtaattggctaaattatttgaatttcttattcctcagttgattatttttatagggtgcatttttgagggagcaacagtttctttttggagtaaaactgtgagggaactttgaaattcaaaattactgttttttttttttttttttttttaaagaatcagaacaggcttaataggaactttgaattttaatccttctattcatctgttatagattattttccctagtgatttctgtattaataaaacttaaacatggcaagttttttctaataagcaaaataaccaacagcttaatatatttgtattaaactctaacagtgcactaactttaaatgttgaaatagattacacattttagggcataatggcagaatatttggctacaatagaccataggattttgttgaagcaaataacaaaatgatgatttatcattttaatgcaaactcaattttattgtttaatgggattttaatttttgtctttgggaaatcttttgagtagctgattttgtgcactttcaggtctttcaaacatgatgtcagatggtgaatttttaagaacaagttgtggctcacccaactatgctgcaccagaagtaatttcaggaaggtagtatttgataccctgcctccctcaatacatttgaaattgtctttttctcctagattttgttagtctatagtgtcatatttaattctaatgaaaggaaagaaagataaggcttattcttaaccacatttatatgtgaatgagggttaaggactacaagtcaacattatattaaagttgttagaagagagtacattaatttttttcccaggtggaagaaatggaaagtttaaaactagggtgtttaaaaagtaggtaagacactggaaacttgaataatacagaaatatctagtagttagaaaaggattactatttacttagaggaaaaattaaacatgtaatgtgtagctttaattttttacatagatggcattttgtagtacctttatgtttcatgataaaatgtcttggggaactgggctgaagtaatctttagacttcatttatgttgaatctttgttctttaaaccttttagagactgcaatattataagaattttaacctctcaatttactaactaccagcattgagaacatgaagatatttgtacagtgtcgctttttgaatagtttggaaaacaggagaatttaatatttttaagaataactctttgtccttcactatactactgaaattgaaaacagaagctgaagtttgctagatttataatgaacttttaataacttttcacccaaaccatgcttatttgtgtgaatgttttgcatcttgattaactcaatgcagaaatactgtagtattttctatttttataagcttgttggcctagactgctcaaagaaatgagatttgtgtaaaaatatggctgtgagtaaggcaggagtacctaattttagatttgtcaagtttcatcttttttttaaatattaacttaatgtcaaaaattatttaaaaaatttttaaaaaaatggtgttgtctatcttaattcttttaggaataaaacaattcaggacatggagactgtggaaagttgttatttaaataaataaaaagaaatgttataactgtgcatatatgcaatgggctattactgaaatttaatttttctagtttggataaagtctttcttcaagctcttggtgtatgagaacttttactttcaaaataatatttatcgatcagttcagcagtacataaatttaaagaaatccttttcctgaatccaggctttgaatgggtgatctaactagtctgcagctagttaaggcacttgactacaatgcactgcaaacgggatttaaaaactctgtgaaccaatttgcctggctttctttcacagcctcaggatcctttcaccttggtgtaaggggtcttgtgttattgggattgtgggctcagagtccattactaaagaacattctcagttgatgaaatatcacttaatctctcctctgtaacaaaaaccaatggttttaaattgaatagtgatatgtttgttcaagatttggccctattgtcagatcccatcagggccatagtaaatagtagaacagaattttagccatggtgtgtaatttacaaaacttcttgacttttgttttcaaagataatactgatggaattaacgttgtaacatgtagtagtggctataaaaaccatattctgcttaagaattctttatgaaatatccatatttgaagtttttgatgaactgaatcttaggttaaaatgattctttaatccaattgttatttcctgttacagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcaggtaataaagcagtttggaagttatcagatctgatagtatccatgataaaagttatgtgaaaaaaaaaaagttgcagaacagaatatacagtgtaatcctgtttttatgtgaaaaaaatagagtgtatagacacatttattttattttgttattagaaatacatagtaaactggttaccttagggaagtaagattcgtaagagggagggctttcactttttacttacacatctttgttttgaaatttttacagtgaacatcatattactttttaaattaacaaaaaagctaatgaaagattggtgctgtggctcacacctgtaattccagcactttgggaagctgaggaaagaggatcatgtgagctcaggagtttgagaccagcctgggtaacatagcgaggccccatatatatgtatatcttttatttttatttatttattttttttgagacaaggttttgctctgtcacccagcctggagtgcagtggtgtgatcatagctcactgtagccagtaactcctgggtcaagtgatcctcccactttagcctccctagtagttgagactacaggcatccaccatcatgcctggctgttttttgttgttattgttttgctttttgtttttgtttgtagtgacagggtcttgctatttttgcccaggctggtcttgaactcctggcctcaagtgatccttgtgcctttccctcccagtgttgggattacaggtgtgagccagtatgcctggcgttaggattaatacttttcagtagtaaatttgtgggtggctattttatttcttatctcatgaattattgtattttttttctttttttaatcccaaggaatgagatttaattgacatgtttttcctggtagtatacattgaattacatgcaaaattcctgttttgtaggtaaaagtcagtataaccagtttcatctggttcaacctaatagtttaaattagacaaaaatgacgatgacaaattttcttctcaaattagagtgagccatttctgatgaagacttaaacaattttattgcaagccttgtttcttttttttcccccctgtggaaattttggtccttttggtcttctaatggctagactgcacatttatctgagaaggaagaaagaaatcagatatggatctaggaatagtaaatatgaaagcattagtataatgaagaagaaggaaagattatatgtggaacttgaagcttgattactttccacttactacacgttttagactagctaaaaaagagaccatgaatggcacggcatgattttatcaccaaagggaaaggacaaatcattctctaaaatttatattttaagatatctaggtaagaaatgtttttgtttgtattttacctattttcttccaattaaaatataatacatgacaattgaaaaaacttagaaaaacaccaacaatagagaagagaataaaaaattatctttaatcccatgacccagaagataaccattgttcttttcttgttttttttttcgtctctggattttatttagttttagcaaagtgacatagttcaggtcaaacatattcttaaatatacgaagttagggaattagaataggaaatcattcagggcatggcctttccagtcacacagaactgggtcataatcctggttctgtcacttactgtctttgtgaccttgagcatgttccttgattttttttttaacctcaattccttcatttaaaacaaagagatattatcttcatataattgtttcgatgatgaggggagatagtgtatatgaagtgtttagcataaaacttagcatatagtaagtactcagtagttgtctactatttttcttgttgttacattatcttcacttaacattatatcaaaagagtattataatgaagctacctaatatgttctctttctaagctggaaataagctgttcttttcattgtttgtcgctgtcatttgtcccataacttttttccccccattgctgtgtcaatacattctccctcttaaaactggagggaaattggagcatttccctcaacatacacaatgaagtgcgagctagaagaggaaaatttcagtgcaaaaagtgacaataatacagtatgaatataaatataaattaagtcatattctaaattccctaaactgttactttcagtctcagctctattcaaagtccttctcctgatcctgccatttttctctcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggtaagaaagaaataacattttgattattagcatatttggcaaacccatagtctataaaatgttttatagaagaattacttttgacttggtttttgttataccatgtgctaggttgtaaacccatattatttgcgtgtacgaaggaagaatcctgtgacaagcacttactccaaaatgagtctacagttataccaagtggatagtagaacttatctactggatttccgtagtattgatggtatgtacatcacacaaaacaacatagattagaccttgttactaacttggtattttacgccttgattcttttgaggcttcttgacttgttcctagtaattcaactgcaaaggaataaaaaatgtgatttcttgtgcctttgcaatattaacatttatgaatcttatttttcttgtaatcttatagcatattgtccttttaagattatcatcttgtaaaatccttaaagccaggtgtagtctgatcctaaggtgatagttttctgctgcatttgtttttttggtgtagttcattttgataagagacaatgttttatttagaaataaatattgactcttctgtaagcttttatttattattaaataagttttcagttaagaatgaagttatggcaattcttcattggccaattcaattgcattaagctacgctgttgagtgcaggtgtggtggcttatgcctgtaaacagcccagcactttgggaggctgaggtgggaggatggcttgagcccaggaatttgagaccagccttagcaacatactgagactctgtctttacaaaatattaaaatatatatatatagtatcacctttgcttatggaaggttgcatagaattattagatgaggttcacgtttgaatttttttcttctttataaactcaaagatagtacacacatagtagcagaaagacacaggtttgagccatgatatgttggccaaaccagtttgtctggttatctttaggtccatatagtacgtatctgctaacatatactaatgcagtctgaaatacggaatgagttttatttttcttgtatttggatcaaatttgcaaccttagatttactagtactggggtataccaattgaatgcccattttgtttttgtactgtgttcccaaccttagtttttcttcgatttttattcattggaattgttgctcttttatgaaatactaaatgaaatatgaagggaaagtggaaagtaaaaagcactgagctgagacttaggagagttgggttctagacttacctttctgttcatttgttaccttgggcaagtcatttctctgggtttgttttcttatcaataaagtgaggggctggatgagatggtttccagtataccctccaaattttaagtgcatcgattctatgattttaatatagagggattactttttattgctatagaataatatttattaatccctagattgttggtttactgggctcttaaccttggattgcaactgatgagtagctatactgtacccaactttggttagctatcttgagaatacatactatatgtaaaaaagatgaatagtttaatacaggctcattgactgttttagaaggtatttagaataagcgtgctcttgatagctggccagcagccccacttaaagaagcaaattcaatactgttacaaaaatttttgggagaaggtcatagactataataaattgaaattctttttacccagatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagtgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgt

SEQ ID NO: 16046 - DNA, 6758 bp, Human
gaacactagagagaggaggaaaaataattctctcctgtcttcaattctgggaatgtctggagtaaagagactgacataatgcctgtcacactgcttggttccttaatggttgacacctgtcctaccttttctacactgacctcatttctcatagtccccgtggtaggcagaataatggctgtctccaaagataacaaggtattaatcccctcaacctacgaataaattaggttatgtggcaaaggacaattataattgcagagggaattaaggttgctaattagcgaaactcgagataaggaagttacctggatggagtcaatgtaatcacaaggggccttaaaagtaggagaaggatggcagggcacccgaaccctttgagagaccaagacaggaagattcaggagttcaagaccagtctggacaacagtgagaccttgtctctactacaaataaaaataaaaggaaaggaaaaagaataagacagatgcagaataaagagtaatgcaatgtgagaaagactacagtagtctccacttatccaaggtttccctttgcaggatttcagggtttgttaccccatggccaaccatggtttaaaaatagttgagtacaggacaataagatattttgagaaaaagagaccgaccacattcacataacttttattacagtatactgttatgattgttctattagttgttgttaatcttttatggtgcctaattcataaatttaacttcatcacaggtacacatgtaccgaaaaaacagtatatatagggtttggtattgtggtttcaggcatccactgagggtgttggaacttaacccacagaaacgggggggaactacagtatcactggttttgaagatgcaagggagcaataaaccaaggagtttgggcagtctctagaagctgagaaaggaaagaaaacagattctccctcctagaacggaaagcagctctggcaacattttatttttagttttctcagttttttttgagacagagtctcactccgtcatccaagctggagtgcaatggcgcaatctcggctcactgcaacctccaccttccgggttcaagcctccctccacctccaccccctgagtagctgggttggcaggcgcgcgccaccacgcctggataattttttgtattttttttgtagcgacagtgtctccctatgttgcccaggctggtctccaacgcctgggctcaagagatccgcccgcctcagcctcccaaagtgctgggattacaggcgtaagccacggcgccaggcccttggaaactatattgaacaagttccatgtgtgattccttggcacaatgaaatatgggatcagataacttgcctctgatttactacagtaacaacaacaacaaaatcactgtctgcttttccctttatattctaagctccagctccatgcctccgtactcctagcgacctctcgcagggaaagtcagcgtcggccaaaagcctccgggatcggaatgaggaggctgctggagaagttgctttctcctaaaagggattatcccaggcgcacacggtcattacacgccggggacgctcagtcggtgcgggtacccctgggcagggccagccccgcattccaggttctccatgtgcctagaagacagtaatcgacggtatagcaacagatctgactgctaacgtgcgaaaccgatcagtagtagcagtagcaccagcaacagcagcacgaaaagcaaaactgtaatctaaacggccctcagggtctaagcaggcccgacgaagactcgcccatccggtcgccagaaaactgggagtcccgcccgcctttccggcactgaaacgcgatcggccctgcctggtaccgcatcctcctcttgaccccacctacactacgacgacggacgctcgagaacgctgcaccgcgccccgcaggaagtgcttccctgggcggaagcttctgagcgtgatatagcggaagtgccttctcttccggtctttctggtctcggccgcagaagcgagatggtgagttgtgactgtggtgtttgtgaatcgcgttccatcctcgtcctttgtgcctctctgtttgctgtgcttggggggctggcaagattccggataaggggaactggtgggctggaaagaggcatgcggtggccctcaagagccagaagaatgactgctaactggtgcctgggggacctatcccgccgtaattgtggtgctagagccgcattgtgtcctttgcctcggtccaacctttggagacctttcacggctctagccttggttgggagccgagggaaggagtttgggaatgtttggctctgtgtaacaatgaaataattcattggtgatgctctctggccggagtctgtaaagataaggtgcatttcagaacattgcaactcttgcggagggttttaggtaacgtgaaatgcgggtagtggtctctgacttggcattcgtggaaagaggcttctcccgcagtttcgatctttacgattgcctttaaattttatcagtaattggtttcccggagaactcgagtaaatctagaagttgccaggtttcagaactatttattcctttaatgtgcagacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtgtaagtaacatttttcaggccaactgtgttagcttttgtttgtattgcacttaagtgggggcataggtttgaactttatttggtgcctatcttaaaactcgtacatctgtatgccgatgaggtggcataaaactcgtgtgttaacaacacctacaaggtgtgtgggagaacaccgtttgaaatcttttctgaacttatgttttagataactggagtgccaaggctaaaagacgaaataccaccggaactggtcgaatgaggcacctaaaaattgtataccgcagattcaggtacagtttgtatgttcgatcataattggtccagtgggcttgaatgaaaccctcgtgtttacttgtaaaaagataacagtaccctgatggttactggggatgagatgttggaagctttttatttattgttgtttttgaggcagggtttcactatgttgcccaggcttgagtgtagtggcacgatcacggctcagtgcagcctcagtctccccagcctcaggtaatctcatctcagccgcccgagtacccgggactacaggtgtgcgctgccacatgcccagctaatttttgtatttattgtagagaatgggatattgtcatgttacccaggataatctcggaactcctgggctcaggccagatgttgaaagcttttatcttctgccgctgtaaccttgacatcagttagtttggattttattagtagttttttcactaaacagtagtataaattaaataacaggagcattgtttgaactagggtcccaaagtgttgatatttattaggtttaattggtgtcaaaatttgtcaagacagtagtgaataaggtctggagtcaggcttggttcaacctttagtatagtggctgtgggcaagagtgctgtagaaaattgccctggttgctgctgttgccttgggctcttgttactcaagtcttggccttagagttataaatgcagaatctcagctccgccgtagacttagctgagagaacctgcatattaaagagtagtttctaagagattaacccatctaagatctcagctaagattcagaatgatgcagacttaactataaagctggtgctccttccgttactatgttctatttcagcaattctcagctattgatactttgggctggataattctttgtggtgggattgtccagtgcaaaattgaatattttgcagaatccctagcctctacccactcagtctccggagtgtccagttttaaagatagcaagacagttcagggctttgtagacacccataggtgtgttcatgtgctgaagcaactttctttgcatttagggtcataacgtttttgtgggcttaatgttgagtggtctgttagtacaatataggagttaagagcttgaactgaagccaggcttttaaaagtaggatagttgacctttcttagagtagatacttcttagagtagatacagatgttaaataagttaaaatgcaaagctcttggtttagaaaatgtctgccattaaacatgctaattgttttttccttgcttagtgaaagtagttgggatctattctcagtatagggaaccattttcacaaataatctgtgatctcttgccaaatatgaacaaacatactggcccaatgactagtatagccaaataagtttttgagcctttattgcagttgcagttaactatatccgaaaatgggtatctttaagcaaagtgaagaatttcagcttatcagtgatgttgtaaaaataaatgtctgaacatatgaatgcagtattgatttcagcatttaactgagataagcgcattgaaatctgtttaacaaaaattaaaatgtatgcatcgatgttgctgaagtaacttgttcttgtttttgacatcctgcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatgtttaaattacctttagcaacatgttcatctgctatgctgtcatgactagggggatgattattagtcacatagagcttgggagtaccactggaaacgtatgggtaggagtttaggtggcttctgtttttcaaaagatgatcttatcctagtatctgtaatgctcacttggcacacctgacttgtgggctgtgtgtaaggtggctagctaagtgaaaaaagcctgctaggtgtgagtcaacttaagaatatgtaaataggtttgagaaaaagtagggcttgggtgcaagtaaagattgagcaggaaataaaggaaaatcaagtataatccctgagatttgtagactaaaggcaatgatgtgggactacttggtcgaatttttttagccctcaacttggtaattgggtgtttctgtgttaaagcactgaaacttgctgtcgtgccttcctagttttcgtggtttattgacagggttgggggttttttttgtttttttaaaatgaagggacaaagtcaactggactgctgagtgagagggcaggggcagttgaagggaacatgaattgctggaacagctacataaaatagtgatgtagccaagtcatgctatttaaattataattctccactgtgtttagaataacatctgaggttcttaacctggccttggaagggtatcacttttacttgtaacctggaatggctttataatgtgctagctaattgctactctcatcttgtattttaactcctaatttacccttcaggtctcagcttcagaacattcacttataaagaaaccctgctgattaaatctctcttgggcttcctcccgaaatgtgagactatactttaaagatgtatggttagagtccaattgccattgcctttcttgtttacagatagtgcaatggcgcaatcctggctcactgcagcctctaattcctgggctcaagtcaagtggttctcctgcctcagccttctgagtagctgggactacagatgcacaccaccacacctggctaatttttgtgttttttgtagagatggagattcactcgactaattctttttgtattcttagtagagactgggtttcaacatgttgaccaggctggtctcgaactcgacctcgtgatccgccgcctcggcctcccaaagtgctaggattacaggcgtgagccaccactcccggctgtcatcatcaaattttcaagtgaagatagtctgttgaagattgaacaatgaccttgaaagacagctgagttgctgtgggtataatgtaaagctggtgaagtttggccagtttgggcttcagaagtctaagtctagtgaaaataccctgacccccatataaacaacccttgaggccggtgtggtggctcacggctgtaatcctggcactttgggaggccgaggtgggcggatcacaaggtcaagagatcgagatcaccctggcccacatggtgagaccccaactctactaaaaatacaaaaattagctgggtgtggtggcatgtgcctgtagtcttagctacttgagaggctgaggcaggagaatcgcttgaacctgggaggcagaggttgcagtgagctgagatcatgccactgtgctccagcctggtggcacagtgagactccacctcaaaaaaaaaaaaaaatccttgaactaatgactcaaattttcaaatgaaacaaaataagca

SEQ ID NO: 16047 - DNA, 11375 bp, Human
ctacaaactcctcaaaagacacagaccattccttctaaacctcatgtcttatgtctcctcatagagtacagatatttagtacttcctctgtacatagaaaaatcgtaattgtgccagccttttaatttctagaatttccaggttatactaacaattatgtgtagcttcaggtaacttaaaaagcacatcatcatgaaactcaagaaaacctttcctaaagtgctgagttttaacataaaattccttagaaagagagggagtttttatgtggaaagacatgggcaccatggtctaccagcgtgacgccaaaattctagctctacccaagctcccagtggaaggggtgaaggatatccaactcccttgcttctttactcctcactttccctgacattgctcttcatatcaaagattgtgatttatacacacacagagattaaaggatttaaggaaaaaaattttactgggtcaagtcaacctgttacctatcacacccatgccttactcttccaactaatcgaaacatgatatatacaacgctgtacaggcagaattctaagctagttccccacattcctggcccctagagagcgcatctacataatcccctcccctggagtttgggtagaacctacaaatatgagcagatatcacttctgggactaggttcatcaaaagggagatctgactgagtcttacttaatcaggtgagcctttaaaaggggctgggggctcccgaaagccacgaagatgggaagtgttagaaggcctgtaaaaggtctagctgacacacagctggcctctggccaacagctggcgagacaaaaagggacctcagtccaacaaccacaacgaaattctgccagagggcttagaaggaccc[450 bp omitted]cagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctgtaagttctcgcgcaggccaatatatcggggggaacggagtcgtgacggctcagtaggcccacagctcggcctctgataccagagaagtaatctggggagaggcggctgcaggcgcttcctccagacgcgttgctaacgtggagctgcaggcctgcgtgctgctggggcctacctcgcggcgtagcctcttccggagcgtttcttcctttaagtgcagatccgtcccacctcccaccccttactttccgatacaggacacggtgtgactggggtgggccccagtgtatgcgtatgtgtgtgtttttcttttttttttttaactgcgagagcaccctcaccctcccactcaaagtgattattgggcatgaggctggcagtagacaagactttgggaacccttgttttcgaacaggccagctgcacgttctaaaggaacctggcaggatttgggagggaaaggggaagataaaggcttgtctggagcacagtgactattcagtcagttgctaactcgaatgcaacagcctattttgacatcctctagcctcataatctgaatttggacttggattacaatgaggtgaaatttggcaataataagttgatacactttggctttttttttttgccacgtgaaagcaattatctgttttacttagaagcaagacttttaaggatttttaatgccactttgtacctactctgctttcagcaagatacacgtgtgttcagtcatttatagctgtatagcctaatgaaaatatagcaacatctaaatatattttattttccagagttatgcagggataatgaattttctgtaacatttcttttgcttgcagcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaaggtattttaatcattggaaacaatttgagtcttgcagattttctagcatcttaagcagtcatttttccgctctgcacatagaagtgtactgacatctcaaatatattttcaattgagaggaagaaaataatatataaaatggaagaaatacactcttcccccacccactacattgtgagtgggctgaatattttgatgttagaaatctgatatggctaaaaaaatagtcttcatcaactcccttagaagtggcttttgcagtaaatgtggccaaatggaacaggttggaattttacataattataatggtgttcactatctgagacaatatacactacatattctcaatataatgtattaattttctgtaactaattaattttctgtagtctaatgttatcattacattaagatcaaggaaattggattcaaccagagaactaaacttcaaaaagagaaaagattagctactaaataacagaacactcacagtttttttgtttgtttgtttttcacgtatttctatttgtcgttttcaaaaattctgccagtgattcagtaagccttttctgtctgaacactcgtttttctttagctgaagacattgatgtattacctgttgggtgaatacttgttcttcatcgatttctttttcctttctagaattcctgttagtttttctttcgtgttaccctccacttaggattctcatttctaattgttcaagtgtttctcccatttgatcttctaaaattttaaaaagtactacagcagccatcttttttttttaatttagaaattatttcttttgttgttgaccagaaatgtgtcttttttaccgtttttattgcatttttactaacccatttttaatatgcccttccaatgatggccatgtgaacttttttagcttggtaactctctttcaagctatactatcctctagataaactgttaacattgccttgccatttatgtgtacaggaggggaatcccacaacaacctgtggatgtcaggtctcaaattaacaggcaagggaagatagccctgttgacattttggcctgggtatttctttggtatgggtgcttttctttgctttggtgtgggtgcttttctgtgtgttatagaatgtttaccaacaactatggcctttactcaccaaatgccagtaacaaacccccttgctctgacaaccagaaatgcctccatgtattatattgccagatgtgccctaggggacaaaactgcccttggttgagaacttctgctatagtagattggtattgtcaaaatagcaagatgagacctcttttggtgtgggaatagacctctgttctcaagtgtacacaggaaagacactgataagagtgtccacctctcccagagttgcatccaaaattgggggtcaggaataaatcatctatagtgattcatagggctgtactcaggtcgtttggcctggaacctctagacaactatggatgtgtgtttttatcttaatttgctggagaagcaagcattgcctaagccaatggtttttaggttgtctcctttgagactgcgttaatgacatttcaccttatttgtgtctagaccttcctatttaacttgtcccttttattttagttaaagtggaaaaattgctcttccctagaggcaagttgttcggtttgttttttgtttggagtctcactctggcaccaaggctggagtgcagtggcgtgatctccgctcactgcaacctctgcccccacaccacagcctcccgagtagctgagattataagcgcctgccaccgtgcctggctaatttttatatttttactagagacagggtttcaccatcttggccaggctggtgtcgaactcctgacctcgtgatccacccacctctgcctcccaaagtgctgggattacaggcatgagtggctgctcatgttttgttttgctggccaattgttttgttttgaatgtaatttcctctagcctttttcagggtctttatcctgttctctcttatattttctgcttctgtgttttgattttaattatccccattggtttcatctctccagttttaaaggaagagcaaattaccacccagtctccttttcagagtgaaactaataaaaagttgttgataaatgccagggatcacaaggcccacaggccacatccaacaagtggcctgtttttgcactgcccacaagctaagagtgtttttacacttacaggtttgtttaaaaataagcaacagagatcttggtggccaataagcctaaaatatttagtaattactctgtttctttacaaaaacttcgctgactcctgaatatgctgtttcaatttccaagattacttcaaggctcaatctgagcccccgttctgtgtttataatttctctataggtgatctctgacctgtgtatagcttcactaacaacctctgtgtagtcagctcacaaacttacatctatcccaagcctctttctccagactcatatatccagcagctatatctttatgtagctatcccagagacaatgtacactcaagtatactaaaaactaaatttaggatcatctccaagactgatactctttaattctctttttttctctcaatgaatgactaaaccgtccagccagaaataaaagaaacttggaagctgtccctgaatcatgcttcttccttactatcgtgactaaacccaatacgttttaaccatgaaatctcttaaatctacctattgctccatatctaccagtttatcctcctacaagctttcattaactcttgcttgaattactgattgactaactagtgtctctagatcccctctttaacatctccagtccactttccgtatcacggctagaatgatagttttgaaatacaagtctaattgctttacatcctgttcacacacagtaatgacttccctggtcttgaagtatatatttttttaatttgatccaccaggctttgcatggtctggctcctgttaatcttgcaaggattactttgttttattttgtttgtttgtttcttgattgcacttgtagtgggctgcttccagccctctatatgctcttcccttggcagtatttgaggcctgtatcttctttcgtatccttttgcatatttaatgctgtttatccctagagctaaactcagaccttttctgacctccctgagtggctcaaattttcctttttttatgctctcattgcatcttacatctttctttcatagcagccattacaatgataatttctcatttattggtgtgatgagtagattaatgcccatctcctatgcttttatgttggattaggatgaaactaccacatgttcagtattctgtcctcagcaccaattactgtacctgatacagatactgagaatttgaaaacagaagttagattattgatggtgcaaattttcttgcacataggaggaggtcccagatagcagtggtaggaatttgctgaggatagggagtgggacccgagaagagagctactttatgatgcagtggaccaagaaagatgccttcctttttatatgttgcagattggttatacaagtgttcagttcagaaactggttgtagttatctcaaatattgaaagtggtgaggtcctggaaagatggcagtttgatattgagtgtgacaagactgcaaaagatgacaggtaaataggaattacattatttctactttgatatattttttttcaaaacttgtttttattactaattgagttctaattgtattgaactagttttatataaaatatagtttgtttctaatttatattttctaagatatcctcagtcacctatggaaaagaattgtgctcagtttagcatatcattgatttgtatatataatataattttaacataattgcctttagtctaaatcagtagttttcaaacagtatttatggtgatatatacaaaactacacatgatatactagatgaaccatttaataattgttctaagatatttttaactataaggaatgatattagactcacacaatttaagatgtagctctgctgtacttcctttaatgccatctacttcctaagacacttcataaatttctgaaggttccagactccctggaagagaaatgcattgtcctaggcatgctcttctataaactgagaaccatttcttatagtgaaatgtagtttgcttctgaaggctttggtgtattttaggaaatttttagcttataaaataatttgatatacaatttaatgttttatttgagaaaataggaaattagacatttaggcattactaaaaatgctgaaatgattataccaatacatattttagatatcacttatttttatttcaagagatgctgaagtttcctgaacttgaagtgattggcaaattttctagtcatctgatactaaatgacctgacactaagaccagctctaaaagatgactggcaggataaatgaagtaataaggatgaatgttgtgcctactaggttgtaggtctgaaggatactttcactcacattttttacaaacctcctttctcaaataagccctgcttatttgatgttgagagcatttaatcagataaataatctaaccactatgtttgaaataatttgttaagacctgaaatgaattaattgatttgatttttttttgacagtgcacccagagaaaagtctcagaaagctatccaggatgaaatccgttcagtgatcagacagatcacagctacggtgacatttctgccactgttggaagtttcttgtaagtattatacaacttcttgttgaattaaattgattggcaaaaagactaagctactgccgtaatcacccctttattaaattttgtcttatttatcagatttatgtaatataaattgaaggaaaaacattatcatgcaaaagtaatgtatcgtagtctccctttccacagggagacccacagtgaatacctgaaaccatggatagtatgaaccctatataatgtttttttcttatgcatacatacctatgataaaatttaatatgtaaattaagcatagtaagagttaataataaactggaacaattataacaatatgctggcatcactattcttgtgctttgggaccattattaaataagataagggttacttgaacacaatcactaaattgcacggaagttagatacaatattttctttactgaaataaatgttcattgagcaaaataaattaactagtgattggagaccaagccaaatgaccttttccagcagtgagtggttcaaaatagaagagaggcagcaagattagttttacttttagaaaataatatacttcaatgatcttatccccaatttaggttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactggtttggtgttgatatagttaaatggtaattagaattgattcagcatagctaatgaattcttgttcctacgaagttatagaacttaagggtccaaagttgagtgagtcttgaggtgtcttcaatctaatggataaactttgatcacatcctgttcatctcatagcaatagacttaaggctattacttcatcattgtgaaaagataaatgtcctttggaattagtccaacaattccagttgaacaagtgttgattttagtactttactatactcttagccttattgtcagcctacttttccttatatacttaaatactatgcttattcctgtgctttcattaataccctcatctggtacatgctttctatccagttctcacctgtttttccaaggtcagtttaaggcagatttgtaaagtcttctctaatctctaatctaaatctgacctcattttgtaaaaattcagtttattaatgtttattattagacactaagttctttatgtgtattaacttatttaaccttcactatttttaagtaattgcacatagtctgaatctgttcattcagaaattacatattgagcaaatactgtggatcagtggcagtttctgggttctcagtgacaaatttgtagactcttcatatctttatggaataagtggaccactggtgttaccaacctagatgatttcaagaaaagtggcaattaaatgcttcatttgtattttaactatttgagaagtcagactaaattctgcgaaatcacttttcccccccaagatggagtcttattctgtcgcccaggctggagtacagtgacgcagctcagctcactacagcctctgcctcccggattccagccattcttccgtctcagcctcctgagtagctgggattacaggcacgtgccaccacacctggctaatttttatatttttagtagagagagggtttcaccatgttggccaggctagtcttgaactcctgacctcatgatctgcccgccttgacctcacaaagcattgggattacaggcgtgagccactgcgcccggctgaaatcacatttttaaaggttgtgtgtatactctggtcatttcaactcagctaccaatattaacaggattaaattcttagatttttgtatcatttgcatgctactatttactctgaggtttctggagagctagtcatgatgagtcattttaccccttacagattatataatcaattaagaaatacacattttgggctgggcgcagtggctcgcgactgctaatcccagcactttgggaggccgaggacaggtggatcacgagatcaggagtttgagaccagcctggccaagatggtcaaaccccgtctctactaaaaatataaaaattagctgggcgtggtggcgggcgcatctcagctacttgggaggctgaggcaggagaaatcgcttgaacccatgaggtggaggttgcggtgagcaagaccgtgccactgtactctagcctgggcgacagagcaaggctccatctcaaaaaataataaataaaaaagaaatacacattttggagctgagtgggagccaaactatgagttttattgaggtgaagctatactggaaaagctttgccctgtagctccaagtggactgtcccatcctctttctagaccttgaggcttacctcaggaggatgatgtttaaatcaacagctgaaagacttgtgagtggtttctacaccatgttaaagagaaggttctaagacagcatgataggcctctaggcctggcctggactctggctcagtgttgcttaccatatgtagaggatgaacagaggttaagcccatcaaggtctgaagtagagcccaggaggaactgaactgtatctggctttcaggatccttttcccagtgtcatcaatcagagaagtcaaacctctgtgagaatgcttgtgcagaggtataacagtctcatgtatt

SEQ ID NO: 16048 - DNA, 32881 bp, Human
  misc_feature (1)...(32881): n = A,T,C or G
tatttcaagactctgagtccaataactcatcgattttgtcagtatttagctgcaggacatagagcaagtcactaacccatgatgagtctcatgtccctgtaaaatcaatgattgttaaatacaggatctctgaggtcctgtttaactccattaatgtgagagtagaaagtgagagaagcaaactgagttcaagtggatatgggtgagaaaaaagaatgctctaggcaagactacaggtcctgcttttggtgcagggcagagagaaagtagaaaagctggagcaacggagacagatgctcagaaaagggctgccttcagatatattaatacctgtaaagaaaacccgggggaggtgctgacttggggagagcctgaggctgagtagacagctgggctggtggagaggaggctcccagaggaaaggcaacccgccagtggggtgggggtgatggggttggcaagctccacaaattttgcaattttgcctcctttcccagagaacaaccactctgttgtgactttgtcagggctggaataggcatgtggttcacacgtgaaagcgaatgagaagttctatacaaagaaccacatttgctgtccatttaatttattcttcctcattctcaaagaagactagatcctcatctcttacccttaacctccacgttgagaagcactttgcccttcccattctagcatatgtctagaacactgcatctagtgtcgcaaacttgtcctcttgccccctctgccctggcaccttccctccccacaccagtaagtctgagaaggtccctgtgtcttctacttttccttttccagcatatggagacaaaagtgattatatcccggatgctaatccgccatgttgacctttaataaccccagtcccatgaatacctcctgattcctaggattttttttttaaactgtccttagcataagaacatgtcaaccttgatgctattgcccacattgtaggctatgaagcatacggcattctcacctgttccggagggctgcctttaattgtcttgcacagagcagtatactctttccttacggtatataaggccagggtctggggagtaacagtgcagaaatttatctgcttgccgccgcccaaggccacgcttctgtctaccacatcctccaatagcacccctattacctacagactggatttgtctgtctcgttctttggtttcttgactccttcgcgtttgggggctgctttgcatataaagccctttcacagaacacagcaccatgctagtacaatacgctgtagattctccctccctccccctctctctcatatactcatatattttatgttgaaccaatatgaggcattgctcaaatttaagtcatattaaagttctaggctagttttgaaaacagaaactgattggaagcagaggttttcaaatagcccacatacgctactagaaggctgtacatttaagagagggccatctaggaagcaataataggcattaaaacaacaacaaaacaacaaaacaaaacagaaacaaaaacaacttgggaaacggccctcctttcacgttttttctatcccatcgacaaaggcgcgctgtccttagctgcgatgattttgtctcgcctccaaaaagacgcccacgcactatgttgagcacccaagtgaggctacggttcctgcggtcacagagggcagggaggctcaagcacctccaaaaccccgagccctggacagctccccaggcccttcccgcggcgcgaggacaagaggtctccggggccctcgggggagcggcgcctcctcctggttccagcagctctgcggccgctccccacccaggcccgcgagaccagcgggacagtccgcgccgcgggagaccaactgggacgagccgcgacccacgcaggcgcgctgaggccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctgggtgagtggtcgcagcccggggagggggctccttctggagaggagagcgtggtcgcggggcactggattcgcgcggacgctcggccgagagctgtcccggtagctgcgagagggcgggtcggccccgtggcggggccctccgggctgtctgagcgccgccgggtccccgcggacctgcgcttggggagggcacgagttgcaaatggcgcgctaagcccgaggtttcttctcttttgcagtcctgcttcaccttcccctgacctgagtagtcgccatggcacaggtaaggccgtgcgccccccactgcgctggatttacccacaactttgtatgctgcgacgagggacttttaggatttgtctgagagccaaaaagtttaggaggaaagggaacctgctttggggacatcgcttccacttttcttgttccccctttgcttccctgcccccgtttctgtgtcccggttcttcccgctgagcgccctccggaaccagcaccgacgccgccaagctgccttcgcgcgcaacagctggtgacgtggccggatttgtgtgcgctcccttttcatgagtgaatgtgtaaaagtgggccttccccaaaatccagagagtagctcaaattagaaccggagcaagaacagctcatcgtggtcatgtgaggcgaacgcattccccccccaccccgccccccgacttcctttattttttttccgcaaagttttctgtattttaatactgtgattgagcattggctttttccagttgctcagcccagttttactaaaactgtaggacgtaggctctgattttttttttaatccaaaagattaaacacaagcgctgtttttcttaagcaatgaactcgtggaacgagttctcaattgaatttgccttgggactgtttcagaaattgataatctactacaggctttctttactgttttttttttttcctttttttttgagacggagtctcactctgtcgcccaggctggagtccagtgacgtagtgatctcgctcactacaacctctgcctcccgggttcaagcaattctcgtgtctcagctttccaagtagctgggattacaggcgccccaccatgcccagctaattttgtatttttagtagaggcggggtttcaccatgttggccaggctggtctcaaactccttgcctcaagtgatcctcccgcctcggcctcaggactgtaatcccactgcgcctggtttctttactgttattaatgtttatcaaaaatgtaggaaagagaagatagtttaaggtctttaaatattgaccatgttatacagtcttttgtgaataagataccagggcttaaaaactctaaaactgatttcacagatcttgtcaatctaaccggcttgtcagagtccagatagttttttttaaacaagtgttttaactgctaaaacaatgctgtctcttatttatagttcactttttatcagattgacttatcaaaattgaaaaaggtttcttggtcctttccaagtgaaaatgggaggattaagattagttgattactttatgaaacttacacagtgatcccattcttacctcctcttttgcacttaaatgttacagtaaaccaattctcatattacttcaagtggaaagtttggtttaagttcttctccatagaaaggatacttttatgtggaattaactttcctgagtaatatttttcctatcttgatatgctggtgtggtgatgtacatgaagatttaacaagcatcgaataataattccctctatctttgctcatttagcagtttcttgaatctcttgtaagttccccagtgatgtctgagggtccatcaattccttttcgttatgtagactgtttacccaaatagtataagtgaacatattttccagttgtggacattaattttaataatttcaaagaatgattagtatcataaaggccatgtgtatagaaaacctaggagaatggtggtttgcatataaaattatgtacctgagccctatgacaatataacaccaagactgttttctatcaaaactacagtttttactaatcataaaagttacaagtaatgttttaaaaaagatacagagtgttaaattttgttctagttttgttactatttttggaaatcatgaaagtaaaacattttgttaaaatatttagtattggccaggcatggtggctcatgcctgtaatcctagcactttgggaggctgaggcacgtggatcacgaggtcaggagttcgagaccagcctaaccaacatggtgagacctcgtctcttctaaaaatacaaaaattagctgggcatggtggtgcacaactgtaatcccagctactcgggaggctgaggcaggagaatcacttgaacccgggaggcggaggttgcagtgagctgagatcgcgctgctgcactccagcctgggcaacagtgagactacgtctcaaaaaaaaagtttagtattaaagttgggtgcggcgtctgagcagtaagaatgtcatgaaggcaaaactaggctacgtaattgttcattagaagcttcatgaacatcagaatttttttgtttattttttatttattttttattatatatatatttttattatactttaagttctagggtatgtgtgcacaacatgcaggtttgttacatatgtatacatggtgccatgttggtgtgctgcacccattaactcaatatttacattagctgtatctcctaatgctatccctcccccctcccccccgcccacaataggccccggtgtgggtgtgtgatgttcccctttctgtgtccaagtgttctcatgaacatcagaattatctctatggtatatgtttaagttacaaggtttgatcagaaatattttcggttggtttaaaattattataataatttaaaaaagccctgtgccgagcaagcaggataaatgtaaataaataaatttgagatgaaactccttccagaggagctgactggatattgattgcatcttttcatgccattcattttttaaagtcaagtctctctggagctaatgttcacttttgggatcttagatcagggttacctgtttacccgtggcctgtgctgctcctggtgatttctcttggttccttatctgtttaactcttaagttcattttggctgctgagaaagaactagatcaaaaactacttggctgctttgcaagccactgagcaattcattggcattcagcaaaccctgatttccttatctaatatccagttctccttggaaggcctacataggtgatcaggctagttacaggcaggcagtccggctttcttcttttaatgacttagaagttcaaaatggtaaaaatataacagtgcttttacagcatagattcattcctgaaatacattttattcatataaccttcatactattctaaaatttcacaaatgcatctgttttttaaaaattagggctcctaagacctttgctttaagtgcttcttagacgcagtctttcagtttagttagtttacataatatgtaaacatatcatcaattgattaattgcaaggaattatactcctggcttcatttctttggacactagttttttgggtttttttttttctccccggagatggagtctcgctttgttgtccaggctggagtgccgtggcgtgatctcagctcactgcaacctctgcttcctgggttcaactgattctcttccctcagcctccagagtagctgggattagaggcatgtgccaccacgcctggctaatttttgtatttttagtagagacggagtttcgccatgttggccaggctagtctcgaactcctaacctcaagtgatccgtgtgcctcggcctcccaaagtgctgggattacaggcatgagccactgcgcctggtgggacactagttcttaactgttctctttttcatccatgcatgcattcatgaatgcatgaggcttttgcattttcactatgtgccaagtattgttaaacatgagcgcaatgggaaatggatctaagatttattgatataatagatgcattgccaagtcttttgtgtgcattatttagtcctcataacatagttttggaaataggtattactatttttgtttcacagaaggggaaattgaggttacttagctggcattctttgtatgggacaaaggagggaagccatcatacagagaggtaacaacagcaaataaatacttaggggtgtaaaagagtttggcatgatggagtgaaactgcagtgaggtggggaaatcaagccttgtcttggaagggatagaacttttcaagtgttattcatggaatgcccaatggaacaatttggtaaaagagcatactctcctctgaccttcaatgtgaactcatgggaggccaatgccacctgctcactttaactcactcaagacatcactggagttattcttgggcaacttgagcacacaatttaactttccattttattggtgtttgtcaagggaagtcattcttacactggtaaagagacacaacattaaacacagagcattaaagaaatacacaacaaaaatttaaatcattttacaaatcttcactttgttatcaaaaccttcttttctaccacgatgcaaacaacttagtctgttctccagtgatgttttttttcccttgcatttgattttaagaaacaggtcaaaggtggtaggatggatagacaaatggaaagaagcaaaaacaagtaagatggagcatgaaaaggaaaggaaattacacaaaagtaagcaataggccagttcgagtttaacgctttgaactatatcattcactttttctgagttgggattagagcaagggttaggattgggggttgagagcatgtctctgacctctgatgtgtttgtactcctcagtcttcttggaggtcctaattttttccctgataattattttgctttacagctcaaagcataatcaggtcacactgacatttccctcttttatgcccttcttatttttttcttagtacagtgataaataatttattttctcattagcgggaaccattattgcaggaaatattaacgggcctctaatacgtacataaggtagggccctagtgtacgtacatggagtggggaggcaattgtcttcccagcttactgttttttggagtggctccaaggtctttggaaacctgcctcagaagaaccacccttaaaaatcactgcatagcggcttagcagttgctcagcttgtggtttgcttcatgatttccagctcctagttaatattacgtggaatgctggaggtgggggggggtgcggtatttgagtaaatattgattatatggaactggagaacaaagagagtttagtccttttctgtgtcttcaggaaggctttatttaaaatgttccagacaggtgaatactttctcatctttaaacttgaaattgttatttatgtctaagttctgtgtctagaaaagctacccttcccttgttgtttggttggtcttattcatttttttttggcatacctagtccttgcgggtaaagaactttttcatttagagaaaaaaaaagccagcaaaattatagacctaaagaatggatatttttgaaggtgagaattaaaagagtgaattgtatattttggccaagtattatctaagaatatattataattatcttcgtaaggcattggtggtagcagataaagggaattgaggatgaactgaggatgggtgaatgggtgagggaacagtacctacttaagagttggcattaatctgggtaaagtgtggggactccaggaaacaggggaagccctcttgaatgagtcatttaaagtcacatttgcagacagttttgggtgggcagtgatggggtttgcacaggatgtccaaacaagggttctgcccttcttactcatttctctgattcacatctggtctcttaataccgctacgtggctttgctatccttagtggatgactctgactgtatggaatgtagcaaaagtgtttcacaatttctagaaagctctcaaaaagaggactagcagttgtttcttcatgcttagtaggtgagatttttaagatgcttttcttccattcatctttcacctaatttccttcagtctctggtgtcagatatcttttttctttaggcaaatccctcatgtctcttctgtttctaacctctccctgtttttcacctctctgtctctccagaagtttcttcatagcctacaaaccttatcaagcctttttttttctcttaactgtgtttttaaaagcctgctttgcaaactgttgtttcattgagaccgtctttccctcaattcattcctgagtgtcctatagccagactgttaaacaccaccaaagatctcctagttaccaaatccagtggaccctttcactcttagctcttccttgacttcctgtggtattggacactgcctcctctttctttcctcttggaacatttgcctccttcagcttccatgccatcaccctccttggattttcttcttgcctttaggagtacagtgtagcttcatgggtaagagcccaggagccaaggtcctgtggcttcaagtcccatctctgctacttgcttgtttgatggtcatttgggtgactcacttgctaaaacctttctgagccagtatgtttctttgtctgtaagatgggatttccctgagatgatctatgtgaagctctgtgcacggtgcctggtgcattgctgcactcagcagatactagctgccactctgattgtaggtcaccttccctttccttctcctctggctctttccaccccattaatattgtcttgcgtggtggccccctccagctactaccggcgtatgctgacaactcaccaagcctactatggagaaatgcaaagtcagccatcctctttctcatccaaaaaacagaatcaccctaagtagttcctgtctacctggggcctgtttctgtccctgcctttgtttaggtcttcctttccttctttgtgttgttagtttctaagcagtcttcttgtcactcttgcacagtcggttccatcttgctgtgcagagttgacattgttcttccctgcctgagtgtcctccagtggcttcctgttgcctacaggatgaggtccgcacattttagcatggcttttgtgcccttcccctcccttcactgtgacctttcccttgtttttgtttcaaccttactgcttgttccagtctgctgaaatacttaactctttagccaaagtaccaagattggcctggcaaattcacaggcaactttcaagactgtttggaatttttttccgaattttttctcttttcacacttcccaatatagtcctctcaaatgtgctcacattgccctaatccagcctctgtgtgtacatattctactgcacttgattagttatatgcctgtcatttcacacttaacttgagggatcctgacttttaactagtagttagtataatactttggacgggggagacattcaaaagatggtgagtcaatgagtaaaaagacagatggactgcaaggggcattcagtcctaagttctcacattaagaaaacttgtagagtttattcatttttacaatgatactgatcaatttgaagtggtctcattaaagagaagctgtaacttgatctgagagaaagaactttcctaacacaggctaattttgagcatcatcttctcaaatcttatcaatttctcttctaaactataactccttttatgaagttgtcagtattcaaccattcagtttcatatggattaaggtatcgaatgaatggcagggaatctattggtctttatgtatctgtgctccttagatggggtggaaatggagactagcctggctgtgggtggatttccctcttggtggaatgaacagctctggcttagtttcataacctctccacgagacaagtgggagagaggctccccttccccttttcctagttggccacagtcccttgtttagctgaggcacagagggagtgaaagctgctgccagtggtgctttcaacaacctggggctgggacatcaacctggaaacacctctttttctcttgaattatattcttttggcctcatgatcataccacttgacttaggagttaaggtcgtgtggggcttcatgaggtcaggttttctgataagttctctcatagctgaccctgttccgaggaaagaacagtgtgtcttctcttcttgaacaagggtaaggactacagttgaagaaaaagttattctggtggtaaggaagacctcagtcaagaatactacaatgtaagtcatgactgttatcacaggggagagagattaggttcaactctgaatacagtgaagacaattggggatttatagctaacaagcagagtgaggtcagtgcatggaaagttactaacaggaaacatcaagttagggggactcgtgctaaactgacttaataggattcttgctgaaggcaggccaggatgatcagatgttgggggaggggatgaggaaattgatcagatatagagggtgccttagttcattgggctgctgtaacagaatactatagactgggtggcttataaagaaggaaattcatttctcaaagttttggtgactggaagtctcagggtgccagcatggttgggtgtggtgagggctctcttctagacattattgtagcctaacgtgacagagcagagagaggcaagctgtctctggattcttacaaggatgctgatctcattttgggggccctgctttcatgacttcatctaattctaattatctcgcaaaggctctacctcctatttaccgtcatgtggtggggtagggtttcaacatatgaattttgaggggacacagatattcggttcataacagagggtgatcagataccaaaagtaggggtatcctccttaaactgacttagcaagcttcttgctaggcaggcaaaggaggcccaatgacaaggactagttgagaagagggctcaggggagcctcttcaaagtgtggtcaaagggagagtctttgtcactatctcctggatccatgagtgccactttttcaggaagcctaatttagtgccactaaagagagaaggccactgaactgacctttgacactatgccctggggaagttcttcaccatggctatctctctctgttgtcatcttttaaaatttgattagtattatgttattgttggcatagcaacaattggaggctaagatggaaaagaaactttcctcctttttggtgactgtgcttttgtgcatttataataagacacgtaagattgtaaacgaggctagctttacagtccttttagctgtttgtttctcagtttagatggtacctaagcaggagttttgagggaatgtaaaaacatttattggtaaagtaaattctgggagcctccatttagcgtaagataaacatttatggctcagtattaataaagccttatgactctcaggatctaatgatatcactaacttttttttttttttttttgtgagacagagtctcgctctgtcaccttggctggagtgcagtggcgcgatcttggctcactgcaagctccgcctcccaggttcacaccattctcctgcctcagcctcccaagcagctgggactacaggcgcctgccaccacacccggttaatttttttagtagagatggggtttcaacgtgttagccaggatggtctcggatctcctgaccttgtgatccgcctgcctcagcctcccaaagtgttgggattacaggcgtgagccactgcgcccagccgatatcactaattttttttgaaatacgaagatattttggttattaaaagcagtgtatatatatgataaagtaatgtgtaacaggaagctttatgaagaatgtcttccaatacacctttataaagttctaaattcaaagatttgtattcctctggcacgtgaacgatcatttcaggctttgctgggttatcgtaaagtccctaagtaagtatacagaaacaggacttagatcaaaaggcacgtaacaagagcactgcttaaaattgagtactcaggatagggtattaagatttagtgcgggctcagtatgcttgtagatcaaaatggtgtgagacttaatgggaagggaacctgcaaagatgtgccctctgtgaaccaggaggtgttggtggggtttcgtcacagagaagagggagccagccttcccactgatggtattacaggtgatcaggatagcttctgtgctgaatcggccatgccaattcccattgtaaatggttcccttcccagttcaaaaggggtcacaaatcttatcaaatggtaaatttatttaatgactgaatatgatatatagcaagcggcttcctgtttgtgttatttactttgtcatattagtcatgatatgaataataccactgtgtttcgtgaattaggttctcagaggcactgtgactgacttccctggatttgatgagcgggctgatgcagaaactcttcggaaggctatgaaaggcttgggtaaatttagcttcctctttctaaagcaaatgtgatatttgtttttccaaacaagtcattaattacagtaagaataattttagaatattttgatctgaaatctgtaggagaagagatatgttaagataacaaaataatactataaaccagagtgtccagtcttttggcttctctgggccacattggaagaattatcttgggccacacataaaatacactaacaataatgatagctgatgagctaaaaaaaaaaaaaaaaaagcaaaaaaatttcataatgttttcagaaagtttatgagtttgtgttaggctgcattcagagctgtcctgggccacatgtggcttgcaggccatgggttggacaagcttgctataaaccatccctaatattcagtctctagaactgaacaggcagttaaattcagcctctgtgcttttgagcttgtcaccctcacctgtgtggtagaggcccgagtcgataaggcagccatccctgcaggtgagcagctgtgcagctctgttcccaatcagatatcccattctcattctgctagactcttctctttccccagcctcttttctagtcatttaaaaacctctcatctcaaggatttccatgtgtcactgatctcctgtgctcaggctccttttgtactactgttcatgtgctttctggccctgtaagtccttccattgtatccagcccaccttttcagactcatctcccattactgtttaatgtgttctcagacccaaccatcctggcttatctgctgtttatgaaagccctgtatttccccactgctgagcttttctctcattctaaacgctgtccttcctttcgtcactgcctttcacaatccttccatccttcaatacttgtgggtgtcaccttctccatgaatcattctccaagattcccttccacctcctatcagctaggagacccttctttgagccccatttaacacctagatctctcctgaggcacttgtcacattttgccttagctcatacttatttgtgtgtttttaaaaaactaggtgccctaagttttttaaaaggcagaagtatttttccatctacttcacaataggttgggaatggggggtagaatatattggaaacgtaacattttatatattgtaaatttttaataaactgtttaataaaacatttatatatatgtgtgtgtttgcgtctgtgtgtgtgtgtgtgtatatatatatgtgtgtgtgtatatatatatatatatacatattttttttttttctaagagatgggggtctcactatgttgaccaggcaggtcttgaactcctggcctcaagcaatcctcccatcttggcctcccaaagagctaggattacagatgtgagccactgcgccggccataaaatatattttatattcgcatagggagaggcaaggaaataaggtgactgggaagcgagttgccaagatcgttgggagagtatgcatgtaggagccaaaatgtaattgttaaccataaattgcaggcacagatgaggagagcatcctgactctgttgacatcccgaagtaatgctcagcgccaggaaatctctgcagcttttaagactctgtttggcagggtaagaccacacttcatcccaagagagaatgggagaacagctatcagttataagactagtttggaatatactgatattcttttgtaagcatcatttattttgtgattccgacttccctacttctgtttcttttccactctcctctaaattatcagctcttaggatacagtgctcacccagcttatcctcacataattgtttttccttgcctaatgctgtagaggtgccaaaagatcctgtagtgagaactgtctctcttcttttcctctgtgtttcccactcagcattcacatggatgtcttactatccgttttctaggtgtaagcctgtattaaaatatgttttgttttaacacagtcacagtcttggttccttttgtcatgattttaactaatgggtttttaattagttgatttaaatgcttttatttgattaataattcaaaaaaatttatttgaattatttaaatgaattatttgaattatttaaatttaaatgaattagtgcatgcatggaaaacttaaatgtagtcttgttattctgaaaacgtatgtcacttaactaaggaaacaagtgcaaagcaaaaaagaaagtattctaaacaccatttttagttgtgtggtatgctgaaacttataggtaggaaatactgtgttttttttttcacaattacataattttttcataattacatacacaatttccccataggaacagatatctcccagtggtcaggagtcataacaatgactataatctattatgtgtttgaatgttattacatattgagagaaaagaaaaaattattacgtttgggtatgagagactaaatgttgtcctttgtaaatttcattatatgattattttttgaaattacaaagaagatatgtttctcagaatagtatttttataaaatagttttagactacttttaaaggtattcttttttttcaagttaagaaaaacatcttttagaaacaaatatcttgacgtataagtgggtttgctttagtttaagattttggtcacaggttaaaagtatgttattcaaggttatagggttttgtttagctcatgggccttctacttggagacagcaacataaagaattcattagagcaaaggactgtcattcatatttaagaagaatcttattacaatttctgctggttaacaaatttgtattttctgtgggttaggatcttctggatgacctgaaatcagaactaactggaaaatttgaaaaattaattgtggctctgatgaaaccctctcggctttatgatgcttatgaactgaaacatgccttgaaggtaaaaaggatgagtgaaaggaacattcttgcatagatagtattattttgttttggtaattacttcctcttatttgttatatttaaaaaattttatctgattatttcagtgagagttgcttggcagacaaaactgggaggcaataagcagtaaaggagggagaaaattacacgtgtgtcatttcatctttttgtagatttaaactcaataatactgggctgtttaaaattttcatatttttatagctttttgtattttattttcatgcctgtcttctgattttgaggatgtttaaaaaatattacagatgagctattttatctttttcagtagaaaattgcctgattagggaaccataatattgctcatcattttaggttaaaaggtaaagcttcagagagaattttcaagataaatattttctcatactctttccttctttcctgcccctctaaacactaaaatgaagtagctggtaaacttgctataatttcagttgcagcaaaaattaaatatgtattcccttgactggtgtttggaatgttgtataaatatgaaggcattgacacatttgtttaggctcatgggacaggaagtagttcagttgttagctgttagattttgaatgggcacattgagatttaacaaggaaataatgtttctcagggattcttactgatggagtggagagaggagaagggtcatcctgataggagctggtttgtgctcagtctcttcattttcctatggtgattcttttggaataaacaaaaatctgaggttattgagaaaagcactttttttgctaagtacttctgaaatgtcagcagtagttgaaattctgccagagaatgaactctaggtttttcagtgcttgatttttggcaaaaaatagaaatataaagaaaataaggcttcaatatactatcttttaaaaaaaattaagtccagctatatcgttgcatctcttagtttaatcatatagatgtgatttttaaaagcagaaaaaggaaagccaactaaaatgatttttcaaaaatccagaaagcaagtcccaattcctttatactgttctaattcctaataattaagtattgctatatttattgttacctttgatgtagaattttcctgtgactgcacagcacttaacttgggggtcaggggtttatcttttgaggtgcttattaagtatcagtgctcttccatgtacatttacgtgaagttttcatttttactctttcggtttttaaaaaattacttcatgtttcatgaaaatgttttacttttaagctagaattaactgatcaaattaaaagttacaaatttatgtaactggttatgtatacgtacacatatatacacacatacacatgataaacattgttttccattaggcaaaaagaataaaatggtctttggagagaaaatcatttaaaacttgttatttctataactaatagaactcatatacaaagaaatccatgttatactggataatatttatataactatgcaatttgggtaacatctataactttcttttaataactttctttttaatcttattgacatgttttctctattaaaatctccaaacagggagctggaacaaatgaaaaagtactgacagaaattattgcttcaaggacacctgaagaactgagagccatcaaacaagtttatgaagaaggtaaatgtttgtgagttatattttgacttcacctccactatcacttccttcatttctgtgatttgaatgcagtcctttgtaggtatgggaggcacgcagtaaatgatggatgaatgaatgaatgaatgaatgacctgcaattcaagctatttttctccttcagtaaggaaaagactgccttgttatcctctactattttcatattttataagaagctactgctgaagatggagtttacttttgcataggatttgcaattagtgtagggatatacaggttgtctttatgttaacattaaggtaaaaatggtttttcctcctttaaaaatatttagctttatgctagcaaaatttaggagttatataaaaagtacttttggaactttggaagagaaacctaaaccctttcccacatcagagttgataaagtacatttgagtaaatgtatgttgtcttagctaatggcagtgcttgaataaaatattctgcattttgatttttctttttagtgtgtcttttatatgaacagaaatctgcatttcggcctaaaatatgtctcatgaatagaatcaagaaaatgaagtaaaaagtagaggtagagagtccttttcttaccagatttcttgtagccaactctttctcctgcctgactgaggagggtcagactatccagtttctcagctcagtcaacagactccaagcctagtgtcttttgctaggggctgtatcttgccattagtttgttaatcttagaaatggctttgttaacccagcaagtcaaaacagcaaaaaattgtttagagcaactgtataattacctttctaaagggctgaatctctctttcctgcttctctttttataggcagtaagttcccaaccgctaaggcagaagtgatacatgtatctcaactttgaactttatttgatgtactattcaaagatctctttctggggatgttgacgttgatgagagcctttgtgctactggattacaaatggtgtgctcaaagggggtaataactgtgtggtctgtcctactcagccgtgtaattgagcactggctatgtgtctggcagtgtgttaacaggctgtcatgagtgacaaaaggtgtgcataacacagctcctgtcctcaagcagtttgtgtgcagtctcctcagtgggtgacatgacagaatgactgcaatatttaaaggataatgaaattcaaactaaagtaaaataccaatgatgttaaatgcaataatgcattcagaagagagaggtcatcatagctttggatgttagggaggcttcatggtacaaatcacacatgcagcagagtttcaagactaggtgggtttacaaagtgtccattgacagatgaatagataaagaatacgtacacacacacacacaaacacagacacacacacacaggagtactgttcagtcttaaagaggggaaatcctgtcatttcaacatcatggataaacgtggaggacataatgcaaagtgaaataagctaggcacaaggcataagctatgcatgatctcacttcttatgttgaatctaaaaaaattgaactcatagaaacagatagtaaaacagtgtttgctagggtgtaggggtggggtgaatgggagaagggactggtgaaatattggtcaaagcatacacgattttagttaggcaggatgaataagttctggggatctcatgaacagcgtggtgactatagtgaaagtataactattatatgcttgaaatttgtgaatacagtatattttaaatgtcctcaccacacacaaaaatatagactatatgaagtgatggatatgctgattaacttgattgtggtaatcatttcacaacgtacacatatatgaaaacatcatggtgtataccttaaatatatacaatttttatttgtccatcataactcaataaagctgggaaaaaaagactaggtgcattttgagtaggtagaaaagatatttttgggtgaggtactgcctgtctttaatggcatggagactggactgtggagagtgtattgagggacggagagggcctggctgctgtggaggatgtgtgcatgtccattgtgggaggtaaatggaacaagcgaggttaggctcagatatagatggttttgcatgactggattaggaatttggatttaattcacaggcactgtaaattcctgaatgagcagtggagtgctgaaggaacaattgagggaggaaggagatttgaattgagaggctaattggatagttatgtgtgtgggaggtaagctaggtatttaggaattgtggcctaacctaggtgagtgagaggtgtgaggaggataaatcagggacaggagaaaagtgataggatttaatggttaatatttacaggtgttggtgtagaagaaagaattaaagattcctacaaggttttgtatttgggtaacttgttgaaataaacacgtaactcttctgggccttttaaaatagaagtttcaggcttttaaagttcgtttgcttttgcataataattaaatatttaaataccttagagtaaggcctcctttcctttaatagcatctgtttgagagtagtgagaaagacttgtagactcttgtagatcccagttctccccttttatatgggcttacattgagcagctggaaatagaggtgggaggggggcctactttaaaatatcattgctgtctctcaagagttaactttatttctgcagaggaaaaataccttattaggaggagtgatggccatgcccaaagaaataaatctcagaatattagagatagaagacatttggaagctaaccatataaaagatttgaaagaaagcataacagagtttaagcttatgattgattgtgttttggagactttccagtaccatcatgtatctatagattaatgactacattggtcgagagaatttctaaatggctgagtcttgatttaagtttgaattgagtgcctttgggagactttaattcatttttgtccaaccactcactgaaagcatttgcttagagcattcagagatggaatagagggaatttatgttaaccaaatataattatttcttcttttacatcgctttcatttgattaatggggcaagattacttttctagttgaaagaagatgtaaataagtatgaaattattttgttgcagaatatggctcaagcctggaagatgacgtggtgggggacacttcagggtactaccagcggatgttggtggttctccttcaggtattgcgtggagattaattacagtttgattaaaaagcctgaagttggactgggctgaatctagttaagtaaggtcacttaaaattcttttaataatttgtggtacttgctgattcttactgcgatgattctgactgtatgttgcctgtgcttgtttgtgtttcagaatatctggtctaaattcttaacagctaactcatacatgttttagatagtagtatcttgttcctttcatagaatgatagcggtatcttgttctttcatagaatttaaaatcagtagggtcattattggttttggacagtgctgggtgatgataacgtgaaatagtgcaggattgatcttaataaaagcatattattcctagagaaagagtgttattgaataaccatcaggtggaaccatttttccttttgaatgagaatgctctatagttcagtaatgtgacatattacctctcataggctaacagagaccctgatgctggaattgatgaagctcaagttgaacaagatgctcaggtgagtgacaccaggatatgatgactttattatgctgtagaaatgaagaaataattcatggtaatgaaaaatcacaatgtatgttgtaatagcttctagtgataatcttgttaatgggttatttacatagcataagacctacataagtagctttttcttattctgacctggtcagcaaaatattttaccttaaagctgaaacgaaataaaataaattatatagtgagttccaactagacatgtttttttttgtgattattgaacattcacaaaatagagaattttaccaaaaaacagtgttattacttccactgccaattatgcagtgggtctcttagcaggagaagataaagaagaaagaataaagtatttaacagtaagtggtgtttaattacataagagatgacaagttattttggtattaggaaatttctctgcatttccttcgacagaattttaagtaggattggtcttctgtcagcagctttttagtgactccaaatgaaaatttcctcttaagtgacttataaacccctataaagtctcagtctggttaataaaacagttattaaaatataggaaaggaaatttgaaacatgagagctgaaaactggaaattggtaataaaggaattacttgggttcctagaaccaccaatcatagacctctttctggtcacatgtttcaattaagagaatatacaattcttggttgtttgtcatgtatcattgaaaaaggaagagccatattcattcctccagtggaacaacccatggatatgcgatctcactttgctaacaggaaagaggagagcggttattcttttgggtaggttgattttataatggtttcagaatgctgtcatctctgtctagctggagagaaaaaaagaactgaatgtttaccgagggctctctgtgcagtatttgactcttgcttcactctgtcttagaaaatgcaagccaattgtgtccagccccttcagactctggtggttccattgccctcaggataaagtccgggttcctgaatgggttacaagcccctttgttatctgtgtgttgtttacttatgcctccagcctctctcacatgctctctctgccctcttgcccctcccaccccgcttcacctgagtcctcttcaagagtcagtcttcagcttagatactttagagttaggtgcccctcacagggaaaaccatacccccccccgcccccaggcttcctgtcacagttcttgccacgttctctggaagccatctatttacttcactgccttcctgggccccctgagctgtcagttcaattgtatcctcagcttctggcatagagtaggtgctcagtaaataactgatgaatgaatgagcacataactctaccagaaaggggcaatttcccttttatggataaagaaacaaacccatggcttccactgaatagcagtggagttggaattcctaacgaggcctgtctgactccaaagctctttctctttcactagaagatagtcagtgttattgaatattaatatttcactataagaatatttcactgtaagatattcagtgttcttgagtattagtgccttccctgattttctctatcattaaagggcttattaaatatcaactcaagcatagatctagcttaattccaccttctttcgggaagagggctagagcaaccctacagagttgtactcctgttaggggctttgttcagtactgaggtgatcttactgctttccaagcattggttgtggctttgctaggagatagtgctgattctctcattcctactgtcaagagtaggataggagttctgggagcttttcagggtcacagtgtaagaaaccaactctagtcctctcagatgtctgcagtgaggcctgcattcacaggcagagggcagatttcccagcatagttggtgatgtaatgagagcattgctgcagcacgaggctcctgaggggaaaacagtacattttaaccttgttttcattgatttctgtccttggagcacttactggatagcactgctgctcaaactttcatgggcatgtggcgcacctgggacctttaattgcagattctgattctatgggtctgggcaggggctgggagtctggattttgaacatgctctcaggtaatgcctgcattcttggtcctttgattactgaggctgtataggtgacacttacgtgtcatgcagtggatataaccattcagaaccctgagagtacatgtgagactgtacatgtgaaaactgctttatggagttactttaaagtatcccttgaatggaatccaagcttttcttagccttccagtgactaggagcaatacagaacatgttacactggctattatttttgattctttcaaatgtattattattaattaataaacctgttgaaaacaaataatcttttggcattataaaaaggaacacaccaacttgtacctcgtagcaagggcagctggactgttatcactagtgagaatttgagatttcttaattgagagtaagctgagacagctaaagggctcttttataagcttttgcatttttgtctctactgatacctggcactaagaagatttctattatttgagaggtttgataagccatagtgagtcattcacttgggaactgaacgttttgtagataatccactttttaacatttttaatgtgttaaattgatttaatacttttaatgcattaaaacagatttaccttcttccccagtaaatccttgttttattctttctctggagggagagttgaactcttagaggaaagagggagaaggagaagtaatcaggcactttttacttttactgggcatttgctactgattacctgacactgttcagtgcattatcttagttatataatctccgttaatgactatatacactgaggctgaagaggagattaagtagttcatctgagatcttgcagatagaccacatctgttttgactccaaagactcatcctttgcactgaaccagggcttatgaaactgtactcaggctgaaccgtaaagcttagggaaggggtgtaagggtccctcatccagatggatccatgaatattgggcatcctcatttaggagaaaggatacttagattaaaacaaaactgttaaatatcattgttttacatgaagaagccatcattattattgcatatgattacttaataatagttttacagtagatattgatcccaaacataattctcccaagaaaattaaaacattgtggtaaaaataactgacatctcaccaattattcccatataacaggcttaactcctgtacctactagagaacatttctagacatttaaaacagttgataagaagtgtgtgcatcaatgtctgtgatattgtacaagatgagtcctttacccatttaggtgttaatgtatttgtatattttatctacatgtagaaacataccagaagtagtaactagcaccctcaggaaattgatattaaatagcaacttttcttttctttcctttctctttcccctttctcctttttccttttctttccttccccttttccttcccctcccatttccttaccctccccttttccttcccctccnnnnnnnnnnnnnnnnnnnnaaacaattctcttgccacagcctcccgggtagctgggattacaggcatctgccaccgtgcctggataagttttgtatttttagtagagacaggttttgacaggttgcccaggctggtcttgaactcctgggctcaagcgatccacctgcctcagcgtcccaaaatgctgggattacaggcatgagccactatgcctagcctgcaacttctattttcttatttttgttctttcttagttttataaaatttctcaatgaacttgcgttgtttttgtaattagattttaaaagttattttaagaaaggtctgtgtcatcatgatatagttctaaagtttagatgcatgcatgactttcagagttactgtcttttcaggttttaagagcatgttcacatggccagaattgatattattcatttttatctttaaaataattaattttaaaattgagcataaagatacatgagtctcatttttttcttattctccagaaatataataaaaaatagatctttaccaccataatctacatttttaaatatactgtgatcaaaacttctatattcaagcctgttattatcacttcctgtctttatttggattgctgcttgtgggtataaggccaactgcaagtagcagcctcagcaaattgcattcatcttgctttaatatgtagacttagtttgaaatgaataaaaggatagtacagtcattgtaaaggttgattctttgggttttaataaattattctcacgtcaataagtggattcagagttaacgttgatgtttgtatataagcttatttttttaggcagctatacgtgcacaagaaagcatattttttccccatgtcaaaaaggaagtatgggcactcaaactattcaaccactacttattgagtgcttctatatgccaggcactgtgctatacccacaatcttttaaaaatttattgtgatctttggaaatatgaaaacattttatagctagccttggttaaatctcagttgtaaagagaaaatatgaagtgtacttttactcatgtgctattgaacagctatagaacaagcaaaacagaaaaggcagacaacttagcttccagttaaatcctttcccagtctatacatggatgtatcaacagtgaggtagtcataactttctcctgacccatactgttgcttctgaaagattggaggttatggcagacattttgggaacatgtaaccttgcaccattgccgtgctttgttgcttggacccatgaatcttctgtggcacagttcagtggcaagctccaaaggtgctccaaactcagtgagctgagtttcagagtaggacacattagaaatgaaaactattaatacaagatgatgaatcaagtgagttaaaattcagggagtaaaaaacaagtgtgtttaagaacctggaaatgagatggaggaacaatttattaattgagtttgaaatttttgcaggctttatttcaggctggagaacttaaatgggggacagatgaagaaaagtttatcaccatctttggaacacgaagtgtgtctcatttgagaaagggtgagtgaaaaaaatctgtatggggcagatacattggtaaatttggaaagtgcatgagccagtgtgacagaatacctgctacatagcagggacttagagaatgaatcagtttttgtatttcttccttttggtgacctggagaaatctcaacattgtttttgctgctgttgtagcttttacaaactagagatcctgagtccacccttcactattggaggatggcaagggaggtcagttctctagattgttcctctcatagtcacacatcactgaatagtggctcactacacgtatttcctcctagaggttggtacccaggaccttatctctggatagtcatcagcacttgtggtatcagttgggaatgaatttagtgcaagtgacagagaaccctaatagtggctttaaaaattgggctttttttccagaggtgggattccatggttgatttggcaggacctgagatctttctggtttttctttttgctccattatccctagtgttttggttttctttcttcattatcataagatgtctgctctagctccaaacttaaccatttcacagcaggaaggaaagaaaagggtaaactagtcctatctgtgtatcactttttgtaagtgaggagatttctcagcatcccctccagtagatttacctttaggtctcattggctataactcgtaagggggctggcaatcagtgaacaaagtatatttacaatccattgcttagggcttggcacattgaggctttgagcacaaggttctgtcagcaaggaagaaggggagatttgtgttcagtaagacactacctaatcaaagtaaataccatctttctggaaagagtgatccctacatgattagggaatcatttttattttttctagtgtttgacaagtacatgactatatcaggatttcaaattgaggaaaccattgaccgcgagacttctggcaatttagagcaactactccttgctgttggtaggtgatttacaatgtattgatatttttggtggtaagagctaaagcattttattcaattgaggctgcatctgaaaataaccacctaggtgtgaaggaagagcttgatatgatatttaggggaagcaaactcccaaatttccaattcagaaatttattttgatgttggaaatacaggattgtctggttagttcatctaaatcctatggaaatactaagataattgtttaaaaatcattttgaagctgcattaaaaatattatttattgataaacctgaaatgtcgtggacattatctcagaggcttgtaaacattatttctgatacctgtggaattttagaatttttttgaatactgttctctcagctttgaggcagactaagaaattgtcatctggtttagaaaagaagaatatctttgatgtaatagaagatgtgatgatggttgttttcaaattaaataatttagttttattttaattaaatattcagaataatctggaaaaattggagaactgaatctgtgcagttgattgcagtattatgtactccaaagctagggagaatctagtttgtgagtctcctgtggtccttttgttcatatgggtctgcagtgagcctctgtctgctgtttgttccaagtatttggccttgagctcacacttttgtgctctctgtcttcaggagactaagctaaagatctgcatgaaccaactctaaaagtagcctttcacttgagtacacagttaatgtacttttaccagaaaacttttagacaggtccttcataattagaatacgcatacaaattaagacattttcagttactggtggctgtttttcttaagacttagaaaagggagaattaagaaatctccacatgcaaggattatttttgtatattaaggaattttcatgatagattttctgaagctaagcagactgaggtctgagcagccccaacctacattcaacatgtacatgttcagagaagagatcctttctgatattgatttatctgtttttgtactgaaatggataaatctcatgctgctctgtgtgaatcattgatattaaagaatatgtagagagtataggaagatcacccaagagtttaaaaaaattaggtagtaatcttgtattatttgctttaatgtcttggaatgaaaacttccaagggatttgtgtaatttattggtgatgaagaatgttgtggtattatgataataatccaggctgcccaaactgcagtatccaaaaagtcttcacagaaccaaggcgcatagaaaaacctgtgcccttattctccatgcctttctatgcagacctcagaactccaaggaaaacctgagccagtgtctaagaaaatacttggtgagtgaggaaatcagattagcttacagctctttagcctctggtacttttgtgtttttatagaagtagagctataagcaggaagcagcacttgatttttaattacttaatcctttacatatcaaaatagcatttgaccattgtattgtttattttcttagtgaaatctattcgaagtatacctgcctaccttgcagagaccctctattatgctatgaaggtaagtggagaccatgaaccttctatctaatacatttctctttctaattattattcttcacttttgtttatgttttagatgatagaccttgggaatttttcccttataacattcaacccagttctactaaattgttataccttattgattcacccgcacccgggagcatttgatcctatgtttgaagtttttaagcattttgcttctctctttttttttttttttaaagggagctgggacagatgatcataccctcatcagagtcatggtttccaggagtgagattgatctgtttaacatcaggaaggagtttaggaagaattttgccacctctctttattccatgattaaggtagtagaacctttctttaaattacgtttgggaatccaaagcagactggtatgttgcatgaaagacaaggataagagaacctgattcttgtgttaagtttaaaattttagtgacacgattagagcaatgagttaaaaagcttagcataatgtttcctgaagtagagatgatggctcccaagtgaaagcatgggtattgatgtggctgaggctcttggtgaactcagaagcattatttagtagtggtaacagatgactcaacaaaccaaaccccttgcctatgataataatgtgttctttctgtcttttatcaattccagctctctttattagtccttcttttatttcatatcagcttttcctttctttatcgtctgttatcaccttatctctgatgctggtttctaattcaggaaagagccaaccaggtcatattgggagtaaagagcccctaggtattagtatcatttttgttctttttaaaacaaggtgctctgtggcctataattacatttagcttaaagtcttttgacttttttttttttttccagtaaaggttaatgtggaccatgtgcaaagcaagatttcaattgagcagaagcttttagtttagcatgtttgtggtttggctggcccaaaggacactagagagtttacccatgcacttttagcttgaaacattaatttatcatgcatgtctgcatgtgagacaagcagatgcaaagcatgttctgcccttctgtctcggagggagagccatgacagccctgcagccccagcactgcccgtgttagctgatatataccaagtgatagaaactattctgtctagaaggcttgatttgactatagttgttaaagttgcctggttctttgtgttaccagagggaatactgagtgtctgaggttacattggtaggaaactccctgcataacattcctgatgtgaaagtcacagagattacccacttgggagaagagtcttatgaataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaatgttctctctttttaagctaataattgacagtggtgttagttgagaactgaatttacagttggtcttttgggcagtaagaaatgcaaaccatagactgaatttccttcatagtacatgatttttcctaaatataggaaagatcgaaggggtctctggtttatttgcaccatgtttatttaggcatctattaaagcaatgcttgtggtgctacttgcttagtagaaaagctaattataaaacttaatgcaaaaattcagagtactacctttctctttcctctttcctattgtgaacttgcctcccatttactgtctgtcactttctttgagataaataaaaaagacaataattttttctagaaagaagcagtttatcgatctcttctaatatttgcctttcagttttctgttttcaaactgccatttcagttggtgtcatttttctttttgtacttatgcccttctggttgcatttttttttttaaagccaagtaattgccattaataagcttttttaaataaaatgaactaatcttcctttgaaaactttaaaatagtgataatattcttttcaccaccgttgatgctcatcagaataaccaggggaatcttaaaaactgtatgtgtacacatgatattggatttttgtttttttgagaggcctcataggcaattttaatgcagaggcaagttgagaatcagttggttatacttttcacatagaagatgatatgtttcaaagagctctgttctgttattgaaaataggccactggctttaaatataagccctggattatttattagtaacactttaagagaaatccacctgtgagctttaacatttgctatattttctgtaggtctggatctgaaaatttattaataaaagaattaaaaaaataaaaatccacaaaaaacatttgctatatttatttacttagtgaccttcttcccagctctctgtgagtttattgggagacaaatttttgtggaactagataagctgattgtaaacatcatgcaaaaaaggaaggattgttagtaaaacttgagagtagtgagggagcactattcttctattctttacacagattagactacatatcctgaatagctgaaacagtataatactgtggcatgaatagacagacaaaacagcaagttcagatatggaaacaaatcatttggaaatttagtatatgttaaaggtaggtcttaatttgctgggtaaagatagcatttttttctaacaaatggtgtgaagacagttggggagccatctaggaaaatataaggctgattctatacctcatgtatcaggtaactctcaaaatgaaacatttaaacttaaaaataaaatcataaacatatgagaaagaagcatggagggatttcatcatacctgcaccttctagattctctgggaagcagatgctgagatggagttagggatgcaacaggtttattgaatggaacaggtagaaggcaggattgggcaaggggtgtcatcagattgcactgcagacctgaccaaatctttgccagtatcatgtggaactctgaggcaaagagttcctgcaaagagccctttgtgagacagaagtgcctgggccctgtgccaccaccttccttactcaattattggctaagtgtcttctggagaagagcttggcttggctggaaagctgaggcaaaacctgaaggagattaagagttggaaggctgtcagcaacccacattttcacagcttggaactgagtattttcttgaaaggggatctaagtggtgcagttccatgtctgccataatgatcttgaagtgtgaggcctttctatcacccaaaatccagaagccataggagaaaagataattatttttgatttcctaaaaatcaaaaactacatggaaggcaggccaggcacagtggctcatgcctgtaattccagcactttggg

SEQ ID NO: 16049 - DNA, 8546 bp, Human; identical to SEQ ID NO: 15114
  misc_feature (1)...(8546): n = A,T,C or G
